United States Patent 12,569,549 (FLAVIVIRUS VACCINE) - sequence listing, part 57

SEQ ID NO: 20141 - RNA, 9876 nt, synthetic construct
  misc_feature 1..9876: note = derived and/or modified CDS sequence (opt5) from DENV-2__EU482701__SS-prME
  source 1..9876: mol_type = other RNA
agcgctggaatgatcattatgctgatccccaccgtgatggctttccacctgaccacgagaaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgaagcaaaacgaacccgaggatatcgactgttggtgcaattctaccagcacatgggtgacctatggcacgtgtaccacaaccggggagcaccggagagagaagagatccgtggcgctcgtccctcatgtgggaatgggcctggagacacggaccgaaacgtggatgtctagcgagggcgcttggaagcacgcccagcgcatcgagacatggattctgagacatcccgggttcaccatcatggccgctattctcgcctacacaatcggaaccacccactttcagcgggttctgattttcatccttctgacagctgtggccccttccatgacgatgcgctgcattggcatctctaacagagattttgtcgaaggggtgagcggaggctcctgggttgacatcgtgctcgagcacgggagctgtgtcaccacaatggcgaagaataaacccaccctggatttcgaacttattaagacagaggccaaacagcctgctaccctgcggaagtattgcatcgaagccaaactcacgaacacaaccaccgagtctcgctgtccgacacaaggagagccctccctgaaggaagaacaagacaagagatttgtgtgcaaacatagcatggtggatcggggctggggcaatgggtgtggactgttcggcaaagggggaattgtgacctgcgctatgtttacatgcaaaaagaacatggaaggcaaaatcgttcagcctgagaatctcgaatacacgattgtggtgacaccccactctggggaggagcatgccgtcggaaacgacacaggcaagcacggcaaagaaatcaaggtgacccctcagtccagcatcacagaggcggaactgaccgggtatggaacggttaccatggagtgttctccccgcacaggccttgatttcaatgaaatggtgctgctccaaatggagaacaaggcctggctggtccacagacagtggtttcttgacctgccgctcccttggctgcccggggctgataaacaggagtccaattggattcagaaggaaaccctggtgacattcaaaaaccctcatgccaagaaacaagacgttgtggtcctcggaagccaggagggcgctatgcacgccgccctgaccggggctacggaaatccagatgtcctctggcaatcttctgtttacaggacatctcaagtgccggctgcgcatggacaaacttcaactgaaaggcatgagctactccatgtgtaccgggaagttcaaagtggtcaaggagattgcggagacacagcacggaaccatcgtgattagagttcagtatgaaggcgatgggagcccctgcaaaatccccttcgagatcatggacctcgaaaagcggtacgtgctgggaagactgattaccgtcaaccctatcgtgacagagaaggattctccggttaacattgaagccgagcccccttttggcgactcctacatcattatcggggtggagcccggccagctcaaactgaattggttcaagaaaggaagctctattggccaaatgtttgaaacgaccatgcgcggggctaagcggatggccatccttggagatacagcctgggacttcggcagcctcgggggagtctttacctccatcggcaaagctctccatcaggtgttcggggccatttatggcgcggctttttctggagtgagctggacaatgaagatcctgattggcgttatcattacctggatcgggatgaactccagaagcacgtctctgtccgtcagccttgtgctcgtgggaatcgtcacactgtacctgggcgtgatggttcaggccgattctgggtgtgtggtctcctggaagaataaagagctcaagtgcggaagcggcattttcatcaccgacaacgtgcacacctggacagaacagtataaatttcaacctgagtccccctctaagctggccagcgctattcagaaagcccaggaagaggggatctgtggcattcgctccgttacccggcttgagaatctgatgtggaagcagatcacaccggaactcaaccacatcctggctgagaatgaagtgaaactgacgattatgaccggagatatcaagggcattatgcaagccgggaagagatctcttcgccctcagcccacagagctcaaatacagctggaagacctggggaaaagcgaagatgctgtccacagaaagccataaccagaccttcctgatcgacggccctgagacggccgagtgccccaataccaaccgggcttggaactctctcgaagtcgaggattatgggtttggagtgttcacaaccaacatttggctgagacttaaagaaaagcaggacgccttttgtgactccaagctgatgagcgctgccgttaaagataatcgcgcggtgcacgccgacatgggctactggatcgagtctgctctcaacgatacatggaagatcgagaaagcctccttcattgaagtcaagaattgccattggcctaaaagccacaccctgtggtctaacggcgtgctggagagcgaaatggtgatccccaagaaccttgctgggccggtctcccaacacaattatcggcctggataccatacacagattgccggcccctggcacctcgggaagctggagatggacttcgatttttgtgacggaaccacggttatcgtgacagaagattgcggcaacagagggcccagcctgcgcaccaccacagcctctggaaaactcattaccgagtggtgctgtcggtcctgcacgctgcctccgcttagataccggggcgaggacggctgttggtatgggatggaaatccgccccctgaaggagaaagaagagaatctcgtgaacagcctggtcacagctggacatggccaggtggataatttctccctggggattcttggaatggcgctctttctggaagagatgctgagaacccgggttggcacaaagcacgccatcctcctggtggctgtctctttcgtgacccttatcacagggaacatgagctttaaagacctgggaagagttgtggtcatggtgggcgccaccatggccgatgacattggcatgggggttacgtacctcgctctgctggccgcgttcaaggtgcgccctacctttgctgccggacttctgctccggaagctgacatccaaagagctcatgatgaccacaatcggcgtcgtgctgctttctcaaagcaccattcccgatacggtgctggaactcacagacgccctggctctggggatgatggtccttaagatcgttagaaatatggagaaatatcagctggccgtgaccattatggcgatcctctgcgtgcctaacgctgtcatcctgcagaatgcctggaaggtgtcctgtacaattctcgccgttgtgtctgtcagccccctgcttctgacctccagccagcagaagaccgactggatccctctcgctctgacaattaagggactgaaccccacggccatcttccttaccacactgtctcgcaccaataaaaagagatcctggccgctcaacgaagctattatggccgtgggcatggttagcatcctggcgtcttccctcctgaagaatgatatccctatgacagggccccttgtggccggaggcctgctgaccgtctgctacgtgctcacgggccggagcgctgacctggagcttgaacgcgccacagatgtcaaatgggaggaccaggctgagatttctgggtccagccctatcctgtccattaccatcagcgaagatggatctatgagcattaagaacgaggaagaggagcagaccctcacaatcctgattagaaccggcctcctggtgatctccgggctttttcccatctctattccgatcacagccgccgcttggtatctgtgggaagttaaaaagcagcgggcgggagtgctgtgggacgtcccttctccccctcccatgggcaaagccgagctcgaagatggggcttaccgcattaagcaaaagggaatcctgggctattcccagattggcgccggggtgtacaaagagggaacgttccataccatgtggcacgttacaagaggcgccgtgcttatgcacaaggggaaacggatcgaaccctcctgggctgacgtcaagaaagatctgatcagctacggaggcgggtggaagctcgagggagagtggaaggaaggcgaggaagtccaggtgctggccctcgagcctggcaaaaatccgcgcgcggttcagaccaagcccgggctgtttaaaacaaacaccggaacgattggcgctgtctcccttgacttctctcctgggaccagcggatcccccatcattgataagaaaggcaaggtggtggggctgtatggaaacggcgtcgtgacaagaagcggcgcctacgtttctgccatcgctcaaaccgaaaagtccattgaggacaatcctgagatcgaagatgacatctttcggaaacgcagactgacaattatggacctccatcccggggccggaaagaccaaacggtatctgcctgcgatcgtgagagaggctattaagcgcggccttcggacactgatcctcgccccgacgagagtcgtggccgctgaaatggaggaagccctgcgcgggctccccattcggtaccagacccctgctatcagagccgagcacacaggacgcgagattgttgatctgatgtgtcatgcgaccttcaccatgcggcttctgagccccgtgagagtccctaactataatctgatcatcatggacgaagcccacttcacagatcccgcttctattgccgctcgcggctacatctccacgcgggtggagatgggggaagccgccggcatttttatgaccgctacaccgcctggaagcagagaccccttcccccagtccaacgcgcctatcattgatgaggagcgggaaatccccgagcgctcttggaatagcggccatgaatgggttaccgactttaaagggaagacagtgtggttcgtcccttccatcaaggccggaaacgatattgctgcctgcctccgcaagaatggcaagaaagtgatccaactgagccggaagacctttgactctgagtatgtgaaaacgcgcacaaacgattgggacttcgtcgttaccaccgatatttccgaaatgggggccaattttaaggctgagagagtgatcgacccgcggagatgtatgaaacccgtgattcttacagacggagaggaacgcgtcatcctggccggccctatgcccgtgacccacagctctgcggctcagcggagagggcgcatcggccggaaccctaagaatgagaacgatcagtacatttacatgggagaacccctcgagaatgacgaagattgcgcccactggaaggaggccaaaatgctgctggacaacatcaatacaccggagggcattatccctagcatgttcgaacccgagagagaaaaggttgatgctattgacggggagtatcgcctccggggagaagccagaaaaacctttgtggatcttatgcgcagaggcgacctgcctgtctggctggcgtacaaggtggccgctgaggggatcaactatgccgatcggcgctggtgtttcgacggaattaaaaacaatcagatcctcgaggaaaacgttgaggtggaaatctggacgaaggagggcgagagaaagaaactgaagccccggtggcttgatgctcgcatttactccgaccctctggccctcaaagaatttaaggagttcgctgccgggagaaaatctctgacactgaatctcatcaccgaaatgggccggcttcccacattcatgacccaaaagacgagagatgcgctggacaacctggccgtcctccataccgctgaggccggaggccgcgcttataatcacgccctgagcgaacttccggagacactggagaccctcctgctgctcacacttctggccaccgtgacagggggaatttttctgttcctcatgtccggccgggggatcggaaagatgaccctgggcatgtgctgcattatcacggcttctatccttctgtggtacgcgcagattcagcctcattggatcgccgctagcattatcctcgaatttttcctgattgtcctgctcatccccgagcccgaaaaacagagaacacctcaagacaaccagcttacctatgtggttatcgccattctgaccgtggtggccgctacaatggccaatgagatgggctttctggaaaagaccaaaaaggatctcgggctgggatccatcgcgacacagcagccggagagcaacattcttgacatcgatctgcgccccgcctctgcttggacgctctacgccgtcgctaccacattcgttacccctatgctgcggcactccattgagaatagctccgtgaacgtgtctctgacagccatcgcgaatcaagccaccgtcctcatgggccttgggaaaggatggcccctgagcaagatggacattggcgtgcctctgctcgctatcgggtgttactcccaggttaaccccatcacgctgaccgccgcccttctgctcctggtggcccactatgctattatcggacctggcctgcaggccaaggcgacaagagaagcccagaaacgggctgccgctggcattatgaagaatccgaccgtcgatgggatcacagtgattgacctcgatcccatcccttacgaccccaaatttgagaagcaacttggacaggtcatgctgctgatcctctgcgtgacccaggttctgatgatgcgcacgacatgggccctttgtgaagccctgaccctcgcgacaggccctatttctaccctgtgggaggggaaccccggaagattctggaataccacaatcgctgtgagcatggccaacatttttcggggctcctatctggctggggccggactccttttcagcatcatgaaaaatacgaccaacacacgcagaggcaccggcaacatgggggaaacactgggagagaagtggaaatctcggctgaatgccctcggcaagtccgagtttcaaatttacaagaaaagcgggatccaggaagtcgatcgcaccctggctaaggagggaatcaaaagaggcgaaacggaccatcacgccgtgtctcgggggtccgcgaaacttcgctggttcgttgagagaaacatggtgacaccggagggaaaagtcgtggatctgggctgcggcagagggggatggagctattactgtggcgggctcaagaatgtgcgggaagttaagggactgaccaaaggcgggcctggacatgaggaacccattcccatgtctacctatggctggaacctggtccgcctccagagcggcgtggacgtgtttttcatccctcccgagaagtgcgatacacttctgtgtgacattggggaatcctctcctaatccgaccgtcgaggccggacggacactgagagttctcaacctggtggagaattggcttaacaataacacgcagttctgcatcaaagtgctgaatccctacatgcctagcgtcattgaaaagatggaggctctccaacgcaaatacggcggggccctggtgcggaaccccctgtccagaaatagcacccacgaaatgtattgggtttccaacgcttctggaaatatcgtgagctccgtcaacatgatctctcgcatgctcattaaccggtttacaatgagacataagaaggccacctacgagcctgacgtggatcttggcagcgggacacgcaatatcggaattgaatccgagatccccaacctggacattatcggcaaacggattgagaagatcaaacaggaacacgagacctcttggcactatgatcaggaccatccgtacaagacgtgggcgtatcacggcagctacgaaaccaaacagacagggtccgccagctctatggttaatggagtggtcagactgctcaccaagccttgggatgtgctgcccacagtgacccaaatggctatgacagacaccacgcctttcggccagcagcgcgtctttaaggagaaagttgatacacggacccaggaacccaaggaggggaccaagaaacttatgaaaatcacagccgagtggctgtggaaagaactcggcaagaagaagacgcctagaatgtgtacccgcgaggagttcacaagaaaagtgcggtccaacgctgccctgggcgctatttttaccgacgagaataagtggaaaagcgcccgcgaggcggtggaagattctagattctgggagctggtcgacaaggaacggaacctccatctggaggggaaatgcgaaacatgtgtgtataatatgatgggaaagagagagaagaaacttggcgagtttggcaaggccaaagggtcccgggctatctggtacatgtggctgggagcccgcttcctcgaatttgaggctctgggcttccttaacgaagatcactggtttagcagagaaaattctctgtccggggttgaaggagagggcctccacaagctggggtacattctgcgggacgtgagcaaaaaggagggcggagccatgtatgccgacgataccgcgggctgggacacacgcatcaccctcgaagatctgaagaacgaggaaatggtcacgaatcatatggagggggaacacaagaaacttgctgaggccattttcaaactgacctaccaaaacaaagtggttagagtgcagcggcccacaccgcgcggaaccgtcatggacatcatctccagacgggatcagcgcggcagcgggcaagtgggaacatatggcctcaatacctttacgaacatggaggcccagctgattagacagatggaaggggagggcgttttcaaaaatatccagcatcttacagtgaccgaagaggtcgctgtgcaaaactggctggcccgggtcggacgcgagagactctctcggatggctattagcggcgacgattgcgtggttaagcctctggacgatcgcttcgccaacgcgctgacagccctcaatgacatggggaagatcagaaaagatattcagcagtgggaaccctccaagggatggaacgactggacccaggtgcccttttgctctcaccatttccacgagctgatcatgaaagatggccgggtccttgtggtgccttgtagaaatcaagacgaactgatcgggcgcgctcggattagccagggagccggctggtccctcagagagacggcttgcctggggaagtcttacgcccagatgtggagccttatgtattttcaccgccgggacctgagactcgcggccaacgctatctgttccgccgttccgtctcattgggtgcccaccagccgcacaacctggtccattcacgctaaacatgaatggatgacaaccgaggatatgctgacagtctggaatcgggtgtggatcagagagaacccttggatggaagacaagacccccgttgagagctgggaagagattccttacctgggcaagcgcgaagatcagtggtgcggatctctcatcggcctgacgtcccgggccacatgggctaaaaatattcaagccgcgatcaaccaggtgagaagccttatcgggaatgaggagtataccgactacatgccctctatgaagcgcttccggagagaagaggaagaggccggagtcctgtggtga

SEQ ID NO: 20142 - RNA, 9876 nt, synthetic construct
  misc_feature 1..9876: note = derived and/or modified CDS sequence (opt5) from DENV-2__EU482703__SS-prME
  source 1..9876: mol_type = other RNA
agcgccggaatgatcattatgctgatccccacagtgatggctttccacctgacgacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaatgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggcttccttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgggatgtaccattctcgccgtcgtgtccgtttctcccctgcttctgaccagctcccagcagaagaccgactggatccctctcgccctgacgattaagggcctgaaccccaccgctatcttccttacaaccctgagccgcacaaataaaaagagatcttggccgctcaacgaggccatcatggctgtggggatggtctccattctggccagctctctcctgaagaatgacatccctatgaccggaccccttgtggcgggcggcctgctgacggtttgctatgtgctcacagggcggtccgccgatctggaacttgagcgcgctaccgacgtcaaatgggaggatcaggccgaaattagcggatcttcccctatcctgagcattaccatctccgaggacggcagcatgtctattaagaacgaagaggaggaacagacactcaccatcctgatcagaacagggctcctggtgattagcggactttttcccatctccattccgatcacggctgccgcctggtacctgtgggaggtcaaaaagcagcgggctggcgtgctgtgggatgttccttctccccctcccatggggaaagcggaactcgaggacggagcctatcgcattaagcaaaagggcatcctgggctacagccagatcggggctggagtgtacaaagaaggcaccttccacacaatgtggcatgtcaccagaggggccgtgcttatgcacaagggaaaacggattgagccctcctgggccgatgttaagaaagacctgatctcttatggcgggggatggaagctcgagggcgaatggaaggagggcgaagaggtgcaggtcctggctctcgaacctgggaaaaatccgcgcgccgtgcagacaaagcccggactgtttaaaaccaacacgggcaccattggggcggtgagccttgatttctcccctggaacatctggcagccccatcattgacaagaaagggaaggttgtcggactgtacggcaacggcgtggtgaccagatccggggcttatgtcagcgccatcgcccaaacagagaagtctatcgaggataatcctgaaattgaggacgatatctttcggaaacgcagactgaccattatggacctccaccccggagctggcaagacaaaacggtacctgcctgccatcgtgagagaagcgattaagcgcgggcttcggacgctgatcctcgctccgaccagagttgtggccgccgagatggaagaggctctgcgcggactccccattcggtatcagacccctgccatcagagctgagcataccggccgcgaaatcgtcgacctgatgtgtcacgccaccttcacaatgcggcttctgtcccccgtgagagttcctaactacaatctgattatcatggatgaggcgcatttcacggaccccgccagcattgctgcccgcgggtatatctctacccgggtggaaatgggcgaggctgccggaatttttatgacagccaccccgcctggctccagagatcccttcccccagagcaacgctcctatcatcgacgaggaacgggagattcccgaacgctcctggaactctgggcacgagtgggtcacagattttaaaggaaagaccgtgtggttcgttcctagcatcaaggcgggcaacgacattgccgcttgcctccgcaaaaatgggaagaaagtgatccaactgtcccggaagacgtttgatagcgaatacgtcaaaacacgcaccaacgactgggatttcgtggtgaccacagacatttctgagatgggagccaattttaaggccgagagagtcatcgatccgcggagatgtatgaaacccgttatccttaccgacggcgaggaacgcgtgattctggctgggcctatgcccgtgacacattccagcgccgcgcagcggagaggccgcatcggacggaaccctaagaatgaaaacgaccagtacatttatatgggcgagcccctcgaaaatgatgaggactgcgctcactggaaggaggccaaaatgctgctggataacatcaataccccggaagggattatcccttctatgttcgagcccgaaagagagaaggtcgacgccattgatggagaataccgcctccggggcgaggctagaaaaacgtttgtggaccttatgcgcagaggggatctgcctgtttggctggcctataaggtggcggccgagggaatcaactacgctgaccggcgctggtgtttcgatggcatcaaaaacaatcagattctcgaagagaacgtcgaagtggagatctggacaaaggagggggaaagaaagaaactgaagccccggtggcttgacgcccgcatttatagcgatcctctggctctcaaagagtttaaggagttcgccgctggcagaaaatccctgaccctgaatctcatcacagagatgggacggcttcccaccttcatgacgcaaaagaccagagacgccctggataacctggcggttctccacacagccgaagctggcgggcgcgcctacaatcatgctctgtctgagcttccggagaccctggaaacactcctgctgctcacccttctggccacagtgaccggaggcatttttctgttcctcatgagcgggcggggaatcggcaagatgacgctgggcatgtgctgcatcattacagcctccatccttctgtggtatgctcagattcagcctcactggatcgcggcctctattatcctcgagtttttcctgatcgtcctgctcattcccgaacccgagaaacagagaacccctcaagacaaccagcttacctacgtggtcatcgctattctgacagtggttgccgccaccatggctaatgaaatggggtttctggagaagaccaaaaaggacctcggactgggcagcatcgccacgcagcagccggagtccaacattcttgatatcgacctgcgccccgcgagcgcctggaccctctacgctgtggccacaaccttcgtgacacctatgctgcggcattctattgaaaattccagcgtcaacgtttccctgaccgctatcgccaatcaagcgacggtgctcatggggcttggaaaaggctggcccctgtctaagatggatatcggggtgcctctgctcgccattggatgttatagccaggtcaaccccatcaccctgacagctgcccttctgctcctggtggctcactacgccattatcggccctggcctgcaggctaaggccaccagagaggcgcagaaacgggccgctgccgggattatgaagaatccgacagttgacggaatcaccgtgatcgatctcgaccccattccttatgatcccaaatttgaaaagcaacttggccaggtcatgctgctgatcctctgcgtgacgcaggtcctgatgatgcgcacaacctgggctctttgtgaggccctgacactcgccaccgggcctatttccaccctgtgggaaggaaaccccggcagattctggaatacaacgatcgcggtgtctatggctaacatttttcgggggagctacctggccggagctggcctccttttctccatcatgaaaaataccacaaacacccgcagaggcacagggaacatgggagagaccctgggcgagaagtggaaaagccggctgaatgccctcgggaagtctgaatttcaaatctataagcgctccggcattcaggaggttgacagaacgctggccaaagaaggcatcaagcgcggggaaacagatcaccatgctgtgagccggggatctgccaaacttagatggttcgtcgagcggaacatggtgaccccggaaggcaaggttgtggacctgggctgcgggagaggaggctggtcctactattgtgggggactcaaaaatgtccgcgaggtgaagggcctgaccaaagggggacctggccacgaagaacccattcccatgagcacatacggctggaacctggtgcggctccagtctggggttgatgtctttttcatccctcccgaaaaatgcgacacccttctgtgtgatattggagagagctcccctaatccgacagtggaggcgggcagaacgctgcgcgtgctcaacctggtcgaaaattggcttaacaataacacccagttctgcatcaaggttctgaatccctacatgccttctgtgatcgagaaaatggaagccctccaacggaagtatgggggagctctggtgagaaaccccctgagccgcaattccacacatgagatgtactgggtcagcaacgcctccggcaatattgtgtctagcgttaacatgatctcccggatgctcattaacagatttaccatgcgccacaaaaaggctacatatgaacctgacgtggaccttgggtctggaacccggaatatcggcattgagagcgagatccccaacctggatattatcggcaagagaatcgagaaaattaagcaggagcatgaaacgtcctggcactacgaccaggatcacccgtataaaacctgggcctaccatgggtcttatgagacaaagcagaccggaagcgcgtccagcatggtcaatggcgtggttcgcctgctcacaaaaccttgggacgtgctgcccaccgtcacacaaatggccatgaccgatacgacacctttcgggcagcagcgggtgtttaaggaaaaggtggacaccagaacccaggagcccaaagagggaacaaagaaacttatgaagatcacggctgaatggctgtggaaagagctcggcaagaaaaagacccctcgcatgtgtacaagagaagagttcaccaagaaagtccggtctaacgccgctctgggggccatttttacagatgagaataagtggaaatccgctcgcgaagccgttgaggacagcagattctgggaactggtggataaggagcggaacctccacctggaaggaaaatgcgagacctgtgtgtacaatatgatgggcaagagagagaagaaacttggcgaatttgggaaggcgaaaggatctcgggccatctggtacatgtggctgggcgctcgcttcctcgagtttgaagccctggggttccttaacgaggaccattggttttccagagaaaatagcctgtctggagtcgagggcgaggggctccacaagctgggctatattctgcgggatgtgtccaaaaaggaaggaggcgctatgtacgccgacgacacagccgggtgggatacccgcatcacgctcgaggacctgaagaacgaagagatggttaccaatcacatgaaaggagaacataagaaacttgcggaggctatcttcaagctgacatatcaaaacaaagtggtcagagtgcagcggcccaccccgcgcggcacagttatggatattatcagcagacgggaccagcgcgggtccggacaagtgggcacctacgggctcaatacgtttacaaacatggaggcccagctgattagacagatggaaggcgagggagtcttcaagaatatccagcaccttaccgtgacagaagaggttgccgtgcaaaactggctggctcgggtcggccgcgagagactcagccggatggccatttctggggatgactgcgtggtcaagcctctggatgaccgcttcgctaacgccctgaccgcgctcaatgatatgggaaaaatcagaaaggacatccagcagtgggaacccagcaaaggctggaacgattggacacaggtgcccttttgctcccatcacttccatgagctgattatgaaggacgggcgggttcttgtggtcccttgtagaaatcaagatgaactgatcggacgcgcccggatttctcagggcgctgggtggagcctcagagagaccgcctgcctgggcaaatcctatgctcagatgtggtctcttatgtactttcaccgccgggacctgagactcgccgcgaacgccatctgtagcgctgtgccgtcccactgggtgcccacatctcgcaccacatggagcattcatgccaagcacgaatggatgaccacagaggacatgctgaccgtttggaatcgggtgtggatcagagagaacccttggatggaagataagacgcccgtcgagtcctgggaagagattccttatctgggaaaacgcgaagaccagtggtgcggcagcctcatcgggctgacatctcgggctacctgggccaagaatatccaagctgccattaaccaggtgagatcccttatcggaaatgaggagtacaccgattacatgcccagcatgaaacgcttccggagagaagaggaagaggcgggcgttctgtggtga

SEQ ID NO: 20143 - RNA, 9876 nt, synthetic construct
  misc_feature 1..9876: note = derived and/or modified CDS sequence (opt5) from DENV-2__EU482705__SS-prME
  source 1..9876: mol_type = other RNA
agcgccggcatgatcattatgctgatccccaccgtcatggctttccacctgacgacgagaaatggggaacctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccacagagtgccccaataccaacagagcgtggaactctctcgaagtcgaggattacgggtttggagtgttcacaaccaacatttggctgaaacttaaagaaaagcaggacgccttttgtgactccaagctgatgagcgctgccatcaaagataatcgcgctgttcatgccgacatgggctattggatcgagtctgcgctcaacgatacatggaagattgagaaagcctccttcatcgaagtgaagaattgccactggcctaaaagccataccctgtggtctaacggcgtcctggagagcgaaatgattatccccaagaaccttgctgggccggtgtcccaacacaattaccggcctggataccacacgcagattgccggcccctggcatctcgggaagctggagatggacttcgatttttgtgacggaacaaccgtgatcgtcaccgaagattgcggcaacagagggcccagcctgcgcacaaccacggcttctggaaaactcattacagagtggtgctgtcggtcctgcaccctgcctccgcttagatatcggggcgaggacggctgttggtacgggatggaaatccgccccctgaaggagaaagaagagaatctcgttaacagcctggtgacagccggacacggccaggtggataatttctccctgggggtccttggaatggccctctttctggaagagatgctgagaacccgggtgggcacaaagcatgctatcctcctggttgcggtgtctttcgtcacccttattacggggaacatgagctttaaagacctgggaagagtggttgtgatggtcggcgccaccatggctgataatatcggcatgggggtgacatatctcgccctgctggccgctttcaaggttcgccctacctttgccgcgggacttctgctccggagactgacatccaaggagctcatgatgaccacgattggcatcgtgctgctttctcaaagcacaattcccgaaaccgtcctggagctcacagacgctctggccctggggatgatggtgcttaaaatcgtgcgcaacatggaaaagtaccagctggccgtcaccatcatggctattctctgcgttcctaatgccgtgatcctgcagaacgcgtggaaagtgtcctgtaccattctcgctgtcgtgtctgttagccccctgcttctgacatccagccagcaaaagacggattggatccctctcgccctgaccattaaaggactgaatcccacagccatcttccttaccacactgtctagaaccaacaagaaacggtcctggccgctcaatgaggctatcatggccgtgggcatggtcagcattctggcttcttccctcctgaagaacgacatccctatgacggggccccttgtggccggaggcctgctgacagtttgctatgtgctcaccggccgcagcgcggacctggaacttgagagagccaccgatgtcaagtgggaggaccaggctgaaatttctgggtccagccctatcctgtccattacaatcagcgaggatggatctatgagcattaaaaatgaagaggaggaacagaccctcacaatcctgatccggacgggcctcctggtgatttccgggctttttcccatctctattccgatcaccgccgctgcctggtacctgtgggaggtcaagaaacagcgcgccggagtgctgtgggacgttccttctccccctcccatgggcaaggctgaactcgaggatggggcgtatagaattaaacaaaagggaatcctgggctactcccagatcggcgccggggtgtacaaggaaggaacattccacaccatgtggcatgtcacacggggcgctgtgcttatgcacaaagggaagcgcattgagccctcctgggccgacgttaaaaaggatctgatcagctatggaggcgggtggaaactcgagggagaatggaaggagggcgaagaggtgcaggtcctggccctcgaacctggcaagaacccgagagctgtgcagaccaaacccgggctgtttaagacgaacaccggaacaattggcgccgtgtcccttgacttctctcctgggaccagcggatcccccatcattgataaaaagggcaaagttgtcgggctgtacggaaatggcgtggtgacacggagcggcgcgtatgtctctgctatcgcccaaaccgagaagtccatcgaggacaaccctgaaattgaggatgacatctttcgcaagagacggctgacaattatggatctccaccccggggccggaaaaacgaagagatacctgcctgctatcgtgcgcgaagccattaaacggggccttagaaccctgatcctcgcgccgacacgcgttgtggctgccgagatggaagaggccctgcgggggctccccattagatatcagacccctgctatccgcgccgagcataccggacgggaaatcgtcgacctgatgtgtcacgctacattcacgatgagacttctgagccccgtgcgcgttcctaattacaacctgattatcatggacgaggcccatttcaccgatcccgcgtctattgccgctcggggctatatctccacaagagtggaaatgggggaggccgctggcatttttatgaccgccacaccgcctggaagccgggaccccttcccccagtccaatgcccctatcatcgatgaggaacgcgagattcccgaaagatcttggaacagcggccacgagtgggtcaccgactttaaggggaaaacggtgtggttcgttccttccatcaaggctggaaatgatattgcggcctgcctccggaagaacggcaaaaaggtgatccaactgagccgcaaaacatttgactctgaatacgtcaagaccagaaccaatgattgggacttcgtggtgacaaccgatatttccgagatgggggctaactttaaagccgagcgggtcatcgacccgagacgctgtatgaagcccgttatccttacagatggagaggaacgggtgattctggccggccctatgcccgtgacccatagctctgctgcccagagacgcgggcggatcggcagaaatcctaaaaacgaaaatgaccagtacatttatatgggagagcccctcgaaaacgacgaggattgcgcgcactggaaggaggctaagatgctgctggacaatatcaacacgccggaaggcattatccctagcatgttcgagcccgaacgcgagaaagtcgatgccattgacggggaataccggctcagaggagaggcccgcaagacatttgtggatcttatgagacggggcgacctgcctgtttggctggcttataaagtggccgcggaggggatcaactacgccgatcgcagatggtgtttcgacggaatcaagaataaccagattctcgaagagaatgtcgaagtggagatctggaccaaagagggcgaacggaagaagctgaaaccccgctggcttgatgctagaatttattccgaccctctggccctcaaggagtttaaagagttcgctgccgggcggaagtctctgacactgaacctcatcaccgagatgggcagacttcccacgttcatgacccagaagacccgcgatgctctggacaatctggccgttctccacaccgcggaagccggaggccgggcttacaaccatgccctgagcgagcttccggagacactggaaaccctcctgctgctcacacttctggctaccgtgacagggggaatttttctgttcctcatgtccggcagagggatcggaaagatgacactgggcatgtgctgcatcattaccgcctctatccttctgtggtatgcccagattcagcctcactggatcgctgcgagcattatcctcgagtttttcctgatcgtcctgctcattcccgaacccgagaagcagcgcacccctcaagataatcagcttacatacgtggtcatcgccattctgaccgtggttgctgccacaatggccaacgaaatgggctttctggagaaaacgaagaaagacctcgggctgggatccatcgctacccagcagccggagagcaatattcttgacatcgatctgcggcccgcctctgcgtggacactctacgccgtggctaccacattcgtgacccctatgctgagacattccattgaaaacagctccgtcaatgtttctctgacggccatcgctaaccaagccaccgtgctcatgggccttgggaagggatggcccctgagcaaaatggacatcggcgtgcctctgctcgcgattgggtgttattcccaggtcaatcccatcacactgaccgccgcccttctgctcctggtggcccactacgctattatcggacctggcctgcaggccaaggctacacgggaggcccagaagcgcgcggccgctggcattatgaaaaacccgaccgttgatgggatcacggtgatcgacctcgatcccattccttatgaccccaagtttgaaaaacaacttggacaggtcatgctgctgatcctctgcgtgacacaggtcctgatgatgagaaccacatgggccctttgtgaggctctgaccctcgccaccggccctatttctacactgtgggaagggaatcccggacggttctggaacacgaccatcgccgtgagcatggcgaatatttttcgcggctcctacctggctggggccggactccttttcagcatcatgaagaacacaaccaacacaagacggggcaccggcaatatcggggagacgctgggagagaaatggaagtctcgcctgaacgctctcggcaaatccgaatttcaaatttataaaaagagcgggatccaggaggttgatagaacactggccaaagaaggaattaagcggggcgagaccgaccaccatgccgtgtctcgcgggtccgctaaacttagatggttcgtcgagcggaatatggtgaccccggaaggaaaggttgtggatctgggctgcggcagagggggatggagctactattgtggcgggctcaaaaacgtccgcgaggtgaagggactgacaaagggcgggcctggacacgaagaacccatccccatgtctacctacggctggaatctggtgcggctccagagcggcgttgacgtctttttcattcctcccgaaaaatgcgatacacttctgtgtgacatcggggagtcctctcctaacccgacggtggaggccggaagaaccctgcgcgtgctcaatctggtcgaaaactggcttaataacaatacacagttctgcatcaaggttctgaacccctacatgcctagcgtgattgagaaaatggaagcgctccaacggaagtatggcggggccctggtgagaaatcccctgtcccgcaacagcacccatgagatgtactgggtctccaatgcttctggaaacatcgtgagctccgttaacatgatttctcggatgctcatcaatagatttacaatgcgccacaaaaaggccacctatgaacctgatgtggaccttggcagcgggacgcggaacattggaatcgagtccgagattcccaatctggacatcatcggcaagagaattgagaagatcaagcaggagcatgaaacctcttggcactacgatcaggaccacccgtataaaacatgggcttaccatggcagctatgagaccaagcagacagggtccgccagctctatggtcaacggagtggttcgcctgctcaccaaaccttgggatgtgctgcccacagtcacccaaatggcgatgacggacacaacccctttcggccagcagcgggtgtttaaggaaaaggtggataccagaacacaggagcccaaagaggggacgaagaaacttatgaagattaccgccgaatggctgtggaaagagctcggaaagaaaaagacacctcgcatgtgtaccagagaagagttcacacggaaggtccgctccaatgctgccctgggcgctatctttaccgacgagaacaaatggaaaagcgccagagaagctgttgaggattctcggttctgggaactggtggacaaagagagaaatctccacctggaagggaagtgcgagacatgtgtgtacaacatgatgggaaaacgggagaagaaacttggcgaatttggcaaagccaaggggtcccgcgcgatttggtacatgtggctgggagccagattcctcgagtttgaagctctgggcttccttaatgaggatcattggtttagccgggaaaactctctgtccggggtcgagggagagggcctccacaaactggggtatatcctgcgcgacgtgagcaagaaagaaggcggagccatgtacgctgatgacaccgccggctgggacacgagaatcaccctcgaggatctgaagaatgaagagatggttacaaaccacatggaaggggagcataagcggcttgccgaggcgattttcaaactgacctatcaaaataaggtggtccgcgtgcagagacccacaccgcggggaaccgttatggacatcatttcccgcagagatcagcggggcagcgggcaagtgggaacgtacggcctcaacacatttaccaatatggaagctcagctgatccgccagatggagggggaaggcgtcttcaaaaacattcagcaccttacagtgaccgaggaggttgccgtgcaaaactggctggccagagtcggacgggaacgcctctctagaatggctatcagcggcgacgattgcgtggtcaagcctctggacgatcggttcgccaatgctctgacggccctcaacgacatggggaaaatcagaaaggatattcagcagtgggagccctccaagggatggaatgactggacccaggtgcccttttgctctcatcacttccatgaactgatcatgaaagatggccgcgttcttgtggtcccttgtcggaaccaagacgagctgattgggagagcgcgcatcagccagggagccggctggtccctccgggaaacagcttgcctggggaagtcttatgcccagatgtggagccttatgtactttcacagacgcgatctgcggctcgctgccaatgcgatttgttccgccgtgccgtctcactgggtgcccaccagcagaacaacctggtccatccatgctaaacacgagtggatgacaaccgaggacatgctgacggtttggaaccgcgtgtggattcgggaaaatccttggatggaggacaagacacccgtcgaaagctgggaggaaatcccttatctgggcaaaagagaggatcagtggtgcggatctctcatcggcctgacctcccgcgccacctgggctaagaacattcaagccgctatcaatcaggtgcggagccttattgggaacgaggaatacacagactacatgccctctatgaagagattccggagagaggaagaggaagccggagttctgtggtga

SEQ ID NO: 20144 - RNA, 9876 nt, synthetic construct
  misc_feature 1..9876: note = derived and/or modified CDS sequence (opt5) from DENV-2__EU482463__SS-prME
  source 1..9876: mol_type = other RNA
tccgccggaatgatcattatgctgatccccaccgtgatggctttccacctcacgacgagaaatggggagcctcatatgattgtctccatccaggaaaagggaaaatctctgctttttaagaccgaggacggcgttaatatgtgcacactgatggccatggatctcggggaactgtgtgaggacaccattacatacaaatgcccgcttctgcggcaaaatgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgttctgattttcatccttctgacagctgtggccccttctatgacgatgagatgcattggaatcagcaaccgggattttgtcgaaggcgtgtccgggggaagctgggttgacatcgtgctcgagcacggctcttgtgtcaccacaatggcgaagaataagcccaccctggatttcgaacttattaaaacagaggccaagcagcctgctaccctgcgcaaatattgcatcgaagccaagctcacgaacacaaccaccgagtccagatgtccgacacaaggggagcccagcctgaaagaagaacaagacaagcggtttgtgtgcaagcattctatggtggatcgcggatggggcaatggctgtgggctgttcggaaaaggcgggattgtcacatgcgctatgtttacatgcaagaaaaacatggaaggaaagatcgttcagcctgagaatctcgaatacacgattgtggtgacaccccactccggcgaggagcatgccgtcgggaacgacacaggaaaacacggcaaggaaatcaaagtgacccctcagagctctatcacagaggcggaactgaccggctatgggacggttaccatggagtgttcccccagaacaggacttgatttcaatgaaatggtgctgctccaaatggagaacaaggcctggctggtccaccggcagtggtttcttgacctgccgctcccttggctgcccggcgctgataagcaggagagcaattggattcagaaagaaaccctggtgacattcaagaaccctcatgccaaaaagcaagacgttgtggtcctcgggtcccaggagggagctatgcacaccgccctgacgggcgccacagaaatccagatgtctagcgggaatcttctgtttaccggccatctcaaatgccgcctgagaatggacaaacttcaactgaagggaatgtcctacagcatgtgtacaggcaaattcaaggtggtcaaagagattgctgagacccagcacgggaccatcgtgattcgggttcagtatgaaggagatggctctccctgcaagatccccttcgagatcatggacctcgagaagagatacgtgctggggcgcctgattacagtcaaccctatcgtgacggagaaggattccccggttaacattgaagcggagcccccttttggagacagctacatcattatcggcgtggagcccgggcagctcaagctgaattggttcaaaaagggctctagcattggacaaatgtttgaaaccacaatgcggggcgccaaaagaatggctatccttggggataccgcctgggacttcggatccctgggcggggtctttacatctatcggaaaggccctccatcaggtgttcggcgctatttatggggccgcgtttagcggcgtgtcctggaccatgaaaatcctgattggagttatcattacgtggatcggcatgaacagccgctctacatccctgagcgtctctcttgtgctcgtggggatcgtcaccctgtacctgggagtgatggttcaggctgattccggctgtgtggtcagctggaagaataaggagctcaaatgcgggtccggaattttcatcaccgacaacgtgcacacatggaccgaacagtataagtttcaacctgagtctcccagcaaactggcctccgccattcagaaggctcaggaagagggcatctgtgggattcggtctgttacaagacttgagaatctgatgtggaaacagatcacgccggaactcaaccacatcctggccgagaatgaagtgaagctgaccattatgacaggcgatatccgcggaattatgcaagctggcaaacggagccttagacctcagcccaccgagctcaagtactcctggaagacatgggggaaagccaagatgctgagcaccgaatcttataaccagacgttcctgatcgacggacctgagaccgcggagtgccccaatacaaaccgcgcctggaactccctcgaagtcgaggattacggctttggggtgttcaccacaaacatttggctgaaacttaaggaaaaacaggacgctttttgtgacagcaagctgatgtctgccgctatcaaggataatcgggccgttcatgcggacatgggatattggatcgagtccgccctcaacgatacctggaaaattgagaaggctagcttcatcgaagtgaaaaattgccactggcctaagtctcatacactgtggagcaacggcgtcctggagtccgaaatgattatccccaaaaaccttgccggcccggtgagccaacacaattacagacctgggtaccacacccagattgctggaccctggcatctcggcaagctggagatggacttcgatttttgtgacgggacgacagtgatcgtcaccgaagattgcggaaaccgcggcccctctctgcggaccacaaccgcctccgggaagctcattacggagtggtgctgtagaagctgcacactgcctccgcttcggtatcgcggagaggacggctgttggtacggcatggaaatcagacccctgaaagagaaggaagagaatctcgttaactccctggtgaccgccgggcacggacaggtggataatttctctctgggcgtccttgggatggctctctttctggaagagatgctgcggacaagagtgggaaccaaacatgcgatcctcctggttgccgtgagcttcgtcacacttattaccggcaacatgtcctttaaggacctggggcgcgtggttgtgatggtcggagctacgatggccgatgacatcggcatgggcgtgacctatctcgccctgctggctgccttcaaagttcggcctacatttgcggctgggcttctgctcagaaagctgacctctaaggagctcatgatgacaaccattggaatcgtgctgcttagccaatccacgattcccgaaacagtcctggagctcaccgatgccctggccctgggcatgatggtgcttaaaatcgtgcgcaatatggaaaagtaccagctggctgtcacaatcatggccattctctgcgttcctaacgcggtgatcctgcagaatgcttggaaagtgtcttgtaccattctcgccgtcgtgagcgttagccccctgcttctgaccagctctcagcaaaagacagactggatccctctcgccctgacgattaaagggctgaaccccaccgctatcttccttacaaccctgtccagaacaaataagaaacggagctggccgctcaacgaggccatcatggctgtgggaatggtctctattctggcctccagcctcctgaagaatgacatccctatgaccggcccccttgtggccgggggactgctgacggtttgctatgtgctcacaggccgctctgccgatctggaacttgagagagctaccgacgtcaagtgggaggatcaggccgaaatttccggcagctcccctatcctgagcattaccatctctgaggacgggagcatgtccattaaaaacgaagaggaggaacagacactcaccatcctgatccggacaggactcctggtgatttctggcctttttcccatcagcattccgatcacggctgccgcctggtacctgtgggaggtcaagaaacagcgcgctggggtgctgtgggatgttccttctccccctcccatgggaaaggcggaactcgaggacggcgcctatagaattaaacaaaaggggatcctgggatacagccagatcggcgctggcgtgtacaaggaagggaccttccacacaatgtggcatgtcacccggggagccgtgcttatgcacaaaggcaagcgcattgagcccagctgggccgatgttaaaaaggacctgatctcctatgggggaggctggaaactcgagggggaatggaaggagggagaagaggtgcaggtcctggctctcgaacctggcaagaatccgagagccgtgcagacaaaacccggcctgtttaagaccaacacggggaccattggagcggtgtctcttgatttcagccctggcacatccgggagccccatcattgacaaaaagggaaaagttgtcggcctgtacgggaacggagtggtgacccggtctggcgcttatgtctccgccatcgcccaaacagaaaagtccatcgaggataatcctgaaattgaggacgatatctttcgcaagagacggctgaccattatggacctccaccccggcgctgggaaaacaaagagatacctgcctgccatcgtgcgcgaagcgattaaacggggacttagaacgctgatcctcgctccgacccgcgttgtggccgccgagatggaagaggctctgcggggcctccccattagatatcagacccctgcgatccgcgctgagcataccgggcgggaaatcgtcgacctgatgtgtcacgccaccttcacaatgagacttctgtctcccgtgcgcgttcctaactacaatctgattatcatggatgaggcgcatttcacggaccccgcctccattgctgcccggggatatatcagcaccagagtggaaatgggcgaggctgccgggatttttatgacagccaccccgcctggctcccgggatcccttcccccagtctaacgctcctatcatcgacgaggaacgcgagattcccgaaagaagctggaactccggacacgagtgggtcacagattttaagggcaaaaccgtgtggttcgttcctagcatcaaggcggggaacgacattgccgcttgcctccggaagaatggcaagaaggtgatccaactgtctcgcaaaacgtttgattccgaatacgtcaagacaagaaccaacgactgggatttcgtggtgaccacagacattagcgagatgggcgccaattttaaagccgagcgggtcatcgatccgagacgctgtatgaagcccgttatccttaccgacggggaggaacgggtgattctggctggacctatgcccgtgacacattctagcgccgcgcagagacgcggccggatcgggagaaaccctaaaaatgaaaacgaccagtacatttatatgggcgagcccctcgaaaatgatgaggactgcgctcactggaaggaggccaagatgctgctggataacatcaataccccggaaggaattatcccttccatgttcgagcccgaacgcgagaaagtcgacgccattgatggcgaataccggctcagaggggaggctcgcaagacgtttgtggaccttatgagacggggagatctgcctgtttggctggcctataaagtggcggccgagggcatcaactacgctgaccgcagatggtgtttcgatgggatcaagaacaatcagattctcgaagagaacgtcgaagtggagatctggacaaaagagggagaacggaagaagctgaaaccccgctggcttgacgccagaatttattctgatcctctggctctcaaggagtttaaagagttcgccgctggccggaaaagcctgaccctgaatctcatcacagagatggggagacttcccaccttcatgacgcagaagacccgcgacgccctggataacctggcggttctccacacagccgaagctggcggacgggcctacaatcatgctctgtccgagcttccggagaccctggaaacactcctgctgctcacccttctggccacagtgaccggcgggatttttctgttcctcatgtctggaagaggcatcgggaagatgacgctgggaatgtgctgcatcattacagccagcatccttctgtggtatgctcagattcagcctcactggatcgcggcctccattatcctcgagtttttcctgatcgtcctgctcattcccgaacccgagaagcagcgcacccctcaagacaaccagcttacctacgtggtcatcgctattctgacagtggttgccgccaccatggctaatgaaatgggctttctggagaaaacaaagaaagacctcggcctggggagcatcgccacgcagcagccggagtctaacattcttgatatcgacctgcggcccgcgtccgcctggaccctctacgctgtggccacaaccttcgtgacacctatgctgagacatagcattgaaaattcctctgtcaacgttagcctgaccgctatcgccaatcaagcgacggtgctcatgggacttggcaaggggtggcccctgtccaaaatggatatcggagtgcctctgctcgccattggctgttattctcaggtcaaccccatcaccctgacagctgcccttctgctcctggtggctcactacgccattatcgggcctggactgcaggctaaggccacccgggaggcgcagaagcgcgccgctgccggcattatgaaaaatccgacagttgacggcatcaccgtgatcgatctcgaccccattccttatgatcccaagtttgaaaaacaacttgggcaggtcatgctgctgatcctctgcgtgacgcaggtcctgatgatgagaacaacctgggctctttgtgaggccctgacactcgccaccggacctattagcaccctgtgggaaggcaaccccgggcggttctggaatacaacgatcgcggtgtccatggctaacatttttcgcggaagctacctggccggcgctgggctccttttctctatcatgaagaataccacaaacaccagacggggaacaggcaacatcggcgagaccctgggggagaaatggaagtcccgcctgaatgccctcggaaaaagcgaatttcaaatttataagaagtctggcatccaggaggttgacagaacgctggccaaagaagggattaagcggggagagacagatcaccatgctgtgtcccgcggcagcgccaaacttagatggttcgtcgagcggaacatggtgaccccggaagggaaggttgtggacctgggatgcggcagaggcgggtggtcttactattgtggaggcctcaaaaatgtccgcgaggtgaaggggctgaccaagggaggccctgggcacgaggaacccatccccatgagcacatacggatggaacctggtgcggctccagtccggcgttgatgtctttttcattcctcccgaaaaatgcgacacccttctgtgtgatatcggcgagtctagccctaatccgacagtggaggcggggagaacgctgcgcgtgctcaacctggtcgaaaattggcttaacaataacacccagttctgcatcaaggttctgaatccctacatgccttccgtgattgagaaaatggaagccctccaacggaagtatggaggcgctctggtgagaaaccccctgagccgcaattccacacatgagatgtactgggtctctaacgccagcgggaatatcgtgtcctctgttaacatgattagccggatgctcatcaacagatttaccatgcgccacaaaaaggctacatatgaacctgacgtggaccttggatccggcacccggaatattgggatcgagtctgagaagcccaacctggatattatcggaaaaagaatcgaaaagattaaacaggagcatgaaacgagctggcactacgaccaggatcacccgtataagacctgggcctaccatggctcctatgagacaaaacagaccggcagcgcgtcttccatggtcaatggggtggttcgcctgctcacaaagccttgggacgtgctgcccaccgtcacacaaatggccatgaccgatacgacacctttcggacagcagcgggtgtttaaggaaaaagtggacaccagaacccaggagcccaaggagggcaccaagaaacttatgaaaatcacggctgaatggctgtggaaggagctcgggaaaaagaagacccctcgcatgtgtacaagagaagagttcacccggaaagtccgcagcaacgccgctctgggagccatttttacagatgagaataagtggaaatctgctagagaagccgttgaggactcccggttctgggaactggtggataaggagagaaacctccacctggaaggcaaatgcgagacctgtgtgtacaatatgatggggaagcgggagaagaaacttggagaatttggcaaggcgaaaggcagccgcgccatctggtacatgtggctgggggctagattcctcgagtttgaagccctgggattccttaacgaggaccattggttttctcgggaaaattccctgagcggcgtcgagggggagggactccacaagctgggctatattctgcgcgatgtgtccaaaaaggaagggggcgctatgtacgccgacgacacagccggatgggataccagaatcacgctcgaggacctgaagaacgaagagatggttaccaatcacatggaaggcgagcataagaaacttgcggaggctatcttcaaactgacatatcaaaacaaagtggtccgggtgcagcgccccaccccgagagggacagttatggatattatcagccggcgcgaccagagaggatctggccaagtggggacctacggactcaatacgtttacaaacatggaagcccagctgattcggcagatggagggcgaaggggtcttcaaaaatatccagcaccttaccgtgacagaggaggttgccgtgcataactggctggctcgcgtcggcagagaacggctcagccgcatggccatttccggagatgactgcgtggtcaagcctctggatgacagattcgctaacgccctgaccgcgctcaatgatatgggcaagatccggaaagacatccaacagtgggagccctctaaggggtggaacgattggacacaggtgcccttttgcagccaccatttccacgaactgattatgaaagacggaagagttcttgtggtcccttgtcgcaatcaggatgagctgatcggccgggccagaatttcccaaggggctggatggtctctccgcgaaaccgcctgcctgggcaagagctatgctcagatgtggtcccttatgtactttcaccggagagacctgcgcctcgccgcgaacgccatctgttctgctgtgccgagccattgggtgcccacatcccggaccacatggagcattcacgccaaacatgagtggatgaccacagaggacatgctgaccgtttggaatagagtgtggatccgcgaaaacccttggatggaggataagacgcccgtcgaatcttgggaggaaattccttatctggggaagcgggaggaccagtggtgcggctccctcatcggactgacaagcagagctacctgggccaaaaatatccaggctgccattaaccaagtgcgctctcttatcggcaatgaggaatacaccgattacatgccctccatgaagcggttcagacgggaggaagaggaagcgggggttctgtggtga

SEQ ID NO: 20145 - RNA, 9876 nt, synthetic construct
  misc_feature 1..9876: note = derived and/or modified CDS sequence (opt5) from DENV-2__EU482464__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccacagagtgccccaataccaacagagcgtggaactctctcgaagtcgaggattacgggtttggagtgttcacaaccaacatttggctgaaacttaaagaaaagcaggacgccttttgtgactccaagctgatgagcgctgccatcaaagataatcgcgctgttcatgccgacatgggctattggatcgagtctgcgctcaacgatacatggaagattgagaaagcctccttcatcgaagtgaagaattgccactggcctaaaagccataccctgtggtctaacggcgtcctggagagcgaaatgattatccccaagaaccttgctgggccggtgtcccaacacaattaccggcctggataccacacgcagattgccggcccctggcatctcgggaagctggagatggacttcgatttttgtgacggaacaaccgtgatcgtcaccgaagattgcggcaacagagggcccagcctgcgcacaaccacggcttctggaaaactcattacagagtggtgctgtcggtcctgcaccctgcctccgcttagatatcggggcgaggacggctgttggtacgggatggaaatccgccccctgaaggagaaagaagagaatctcgttaacagcctggtgacagccggacacggccaggtggataatttctccctgggggtccttggaatggccctctttctggaagagatgctgagaacccgggtgggcacaaagcatgctatcctcctggttgcggtgtctttcgtcacccttattacggggaacatgagctttaaagacctgggaagagtggttgtgatggtcggcaccacaatggccgatgacatcggcatgggggtgacctatctcgctctgctggccgccttcaaggttcgccctacatttgctgccggacttctgctccggaagctgacctccaaagagctcatgatgacgacaattggcatcgtgctgctttctcaaagcaccattcccgaaacagtcctggagctcaccgatgcgctggctctggggatgatggtgcttaagatcgtgagaaatatggaaaaataccagctggccgtcaccatcatggccattctctgcgttcctaacgctgtgatcctgcagaatgcctggaaggtgtcctgtacaattctcgcggtcgtgtctgttagccccctgcttctgacgtccagccagcagaagaccgactggatccctctcgctctgacaattaagggactgaaccccaccgccatcttccttacaaccctgtctcgcacgaataaaaagagatcctggccgctcaacgaggccatcatggctgtgggcatggtcagcattctggcctcttccctcctgaagaatgacatccctatgacagggccccttgtggctggaggcctgctgaccgtttgctatgtgctcaccggccggagcgccgatctggaacttgagcgcgcgacagacgtcaaatgggaggatcaggccgaaatttctgggtccagccctatcctgtccattaccatcagcgaggacggatctatgagcattaagaacgaagaggaggaacagacactcacgatcctgatcagaaccggcctcctggtgatttccgggctttttcccatctctattccgatcacagctgccgcttggtacctgtgggaggtcaaaaagcagcgggccggagtgctgtgggatgttccttctccccctcccatgggcaaagccgaactcgaggacggggcttatcgcattaagcaaaagggaatcctgggctactcccagatcggcgcgggggtgtacaaagaaggaaccttccacacaatgtggcatgtcaccagaggcgccgtgcttatgcacaaggggaaacggattgagccctcctgggctgatgttaagaaagacctgatcagctatggaggcgggtggaagctcgagggagaatggaaggagggcgaagaggtgcaggtcctggccctcgaacctggcaaaaatccgcgcgccgtgcagacgaagcccgggctgtttaaaaccaacacaggaaccattggcgctgtgtcccttgatttctctcctgggacaagcggatcccccatcattgacaagaaaggcaaggttgtcgggctgtacggaaacggcgtggtgaccagaagcggcgcctatgtctctgcgatcgctcaaacagagaagtccatcgaggataatcctgaaattgaggacgatatctttcggaaacgcagactgacgattatggacctccaccccggggccggaaagaccaaacggtacctgcctgccatcgtgagagaagctattaagcgcggccttcggacactgatcctcgccccgaccagagttgtggcggctgagatggaagaggccctgcgcgggctccccattcggtatcagacccctgccatcagagctgagcatacaggacgcgaaatcgtcgacctgatgtgtcacgccacgttcaccatgcggcttctgagccccgtgagagttcctaactacaatctgattatcatggatgaggctcatttcacagaccccgcctctattgcggcccgcggctatatctccacccgggtggaaatgggggaggctgccggcatttttatgacagctaccccgcctggaagcagagatcccttcccccagtccaacgcccctatcatcgacgaggaacgggagattcccgaacgctcttggaatagcggccacgagtgggtcacggattttaaagggaagacagtgtggttcgttccttccatcaaggccggaaacgacattgctgcgtgcctccgcaaaaatggcaagaaagtgatccaactgagccggaagacctttgattctgaatacgtcaaaacccgcacaaacgactgggatttcgtggtgaccacagacatttccgagatgggggccaattttaaggctgagagagtcatcgatccgcggagatgtatgaaacccgttatccttaccgacggagaggaacgcgtgattctggccggccctatgcccgtgacgcatagctctgccgctcagcggagagggcgcatcggccggaaccctaagaatgaaaacgaccagtacatttatatgggagagcccctcgaaaatgatgaggactgcgcccactggaaggaggcgaaaatgctgctggataacatcaatacaccggaaggcattatccctagcatgttcgagcccgaaagagagaaggtcgacgctattgatggggaataccgcctccggggagaggccagaaaaacctttgtggaccttatgcgcagaggcgatctgcctgtttggctggcctataaggtggctgccgaggggatcaactacgcggaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacggagatgggccggcttcccaccttcatgacacaaaagaccagagacgccctggataacctggctgttctccacacagccgaagcgggaggccgcgcctacaatcatgctctgagcgagcttccggagaccctggaaacactcctgctgctcacccttctggccacggtgacagggggaatttttctgttcctcatgtccggccgggggatcggaaagatgaccctgggcatgtgctgcatcattaccgcttctatccttctgtggtatgcccagattcagcctcactggatcgccgctagcattatcctcgagtttttcctgatcgtcctgctcattcccgaacccgagaaacagagaacacctcaagacaaccagcttacctacgtggtcatcgcgattctgacagtggttgccgctacgatggccaatgaaatgggctttctggagaagaccaaaaaggacctcgggctgggatccatcgccacacagcagccggagagcaacattcttgatatcgacctgcgccccgcttctgcctggaccctctacgcggtggccacaaccttcgtgacgcctatgctgcggcattccattgaaaatagctccgtcaacgtttctctgaccgctatcgccaatcaagctacagtgctcatgggccttgggaaaggatggcccctgagcaagatggatatcggcgtgcctctgctcgccattgggtgttattcccaggtcaaccccatcaccctgacagcggcccttctgctcctggtggctcactacgccattatcggacctggcctgcaggctaaggccaccagagaggctcagaaacgggccgcggccggcattatgaagaatccgacggttgacgggatcacagtgatcgatctcgaccccattccttatgatcccaaatttgaaaagcaacttggacaggtcatgctgctgatcctctgcgtgacccaggtcctgatgatgcgcacaacctgggctctttgtgaggccctgaccctcgctacaggccctatttctacgctgtgggaagggaaccccggaagattctggaataccacaatcgccgtgagcatggccaacatttttcggggctcctacctggcgggggctggactccttttcagcatcatgaaaaataccacaaacacccgcagaggcacgggcaacatcggggagacactgggagagaagtggaaatctcggctgaatgccctcggcaagtccgaatttcaaatttataagaaaagcgggatccaggaggttgaccgcaccctggctaaggaaggaattaaaagaggcgagaccgatcaccatgccgtgtctcgggggtccgccaaacttcgctggttcgtcgagagaaacatggtgacaccggaaggaaaagttgtggacctgggctgcggcagagggggatggagctactattgtggcgggctcaagaatgtccgggaggtgaagggactgaccaaaggcgggcctggacacgaagaacccatccccatgtctacatacggctggaacctggtgcgcctccagagcggcgttgatgtctttttcattcctcccgaaaagtgcgacacgcttctgtgtgatatcggggagtcctctcctaatccgaccgtggaggctggacggacactgagagtgctcaacctggtcgaaaattggcttaacaataacacccagttctgcatcaaagttctgaatccctacatgcctagcgtgattgagaagatggaagccctccaacgcaaatatggcggggcgctggtgcggaaccccctgtccagaaatagcacacatgagatgtactgggtctccaacgcctctggaaatatcgtgagctccgttaacatgatttctcgcatgctcatcaaccggtttaccatgagacacaagaaggctacgtatgaacctgacgtggaccttggcagcgggacccgcaatattggaatcgagtccgagattcccaacctggatatcatcggcaaacggattgaaaagatcaaacaggagcatgaaacatcttggcactacgaccaggatcacccgtataagacctgggcctaccatggcagctatgagacaaaacagaccgggtccgctagctctatggtcaatggagtggttagactgctcacaaagccttgggacgtgctgcccaccgtcacgcaaatggccatgacagataccacccctttcggccagcagcgcgtgtttaaggaaaaagtggacacacggacgcaggagcccaaggaggggaccaagaaacttatgaaaattacagcggaatggctgtggaaagagctcggcaagaagaagacccctagaatgtgtacacgcgaagagttcaccagaaaagtccggtccaacgccgctctgggcgccatctttacagatgagaataagtggaaaagcgctcgcgaagccgttgaggactctagattctgggaactggtggataaggagcggaacctccacctggaagggaaatgcgagacctgtgtgtacaatatgatgggaaagagagagaagaaacttggcgaatttggcaaggctaaagggtcccgggccatttggtacatgtggctgggagcgcgcttcctcgagtttgaagccctgggcttccttaacgaggaccattggtttagcagagaaaattctctgtccggggtcgagggagagggcctccacaagctggggtatatcctgcgggatgtgagcaaaaaggaaggcggagctatgtacgccgacgacacggctggctgggatacccgcatcacactcgaggacctgaagaacgaagagatggttaccaatcacatggaaggggagcataagaaacttgccgaggccattttcaaactgacatatcaaaacaaagtggtcagagtgcagcggcccaccccgcgcggaacggttatggatatcatttccagacgggaccagcgcggcagcgggcaagtgggaacatacggcctcaatacctttacaaacatggaagcgcagctgatcagacagatggagggggaaggcgtcttcaaaaatattcagcaccttaccgtgacggaggaggttgctgtgcaaaactggctggcccgggtcggacgcgaaagactctctcggatggccatcagcggcgatgactgcgtggtcaagcctctggatgaccgcttcgctaacgccctggctgccctcaatgatatggggaagatcagaaaagacattcagcagtgggagccctccaagggatggaacgattggacccaggtgcccttttgctctcatcacttccatgaactgatcatgaaagacggccgggttcttgtggtcccttgtagaaatcaagatgagctgattgggcgcgcgcggatcagccagggagccggctggtccctcagagaaacagcttgcctggggaagtcttatgcccagatgtggagccttatgtactttcaccgccgggacctgagactcgctgccaacgcgatttgttccgccgtgccgtctcactgggtgcccaccagccgcacaacctggtccatccatgctaaacacgagtggatgacaaccgaggacatgctgacggtttggaatcgggtgtggattagagaaaacccttggatggaggataagacacccgtcgaaagctgggaggaaatcccttatctgggcaagcgcgaggaccagtggtgcggatctctcatcggcctgacctcccgggccacctgggctaaaaatattcaagccgctatcaaccaggtgagaagccttattgggaatgaggaatacacagattacatgccctctatgaagcgcttccggagagaggaagaggaagccggagttctgtggtga

SEQ ID NO: 20146 - RNA, 9876 nt, synthetic construct
  misc_feature 1..9876: note = derived and/or modified CDS sequence (opt5) from DENV-2__EU482465__SS-prME
  source 1..9876: mol_type = other RNA
agcgccggcatgatcattatgctgatccccaccgtgatggctttccacctgacgacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttatttgcaagcatagcatggtggatcgcggctggggcaatgggtgtggactgttcggcaaagggggaatcgtgacctgcgctatgtttacatgcaagaaaaacatggaaggcaagattgtccagcctgagaatctcgaatacacgatcgttgtgacaccccactctggggaggagcatgccgtgggaaacgacacaggcaaacacggcaaggaaatcaaagtcacccctcagtccagcattacagaggcggaactgaccgggtatggaacggtgaccatggagtgttctcccagaacaggccttgatttcaatgaaatggttctgctccaaatggagaacaaggcctggctggtgcaccggcagtggtttcttgacctgccgctcccttggctgcccggggctgataagcaggagtccaattggatccagaaagaaaccctggtcacattcaagaaccctcatgccaaaaagcaagacgtggttgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgtcatccgggtgcagtatgaaggcgatgggagcccctgcaagatccccttcgagattatggacctcgagaagcggtacgttctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagtcttcaccacaaacatctggctgaaacttaaagaaaagcaggacgctttttgtgactccaagctgatgagcgccgctatcaaagataatcgcgccgtgcatgcggacatgggctattggattgagtctgccctcaacgatacctggaagatcgagaaggctagcttcattgaagttaagaattgccactggcctaaaagccatacactgtggtctaacggcgtgctggagagcgaaatgatcattcccaagaaccttgccgggccggtctcccaacacaattaccggcctggataccacacccagatcgctggcccctggcatctcgggaagctggagatggacttcgatttttgtgacggaacgacagtgattgtgaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaatccgccccctgaaggagaaagaagagaatctcgtcaacagcctggttaccgccggacacggccaggtggataatttctccctgggggtgcttggaatggctctctttctggaagagatgctgagaacacgggtcggcaccaagcatgcgattctcctggtggccgtttctttcgtgacacttatcaccgggaacatgagctttaaagacctgggaagagtcgtggttatggtgggcgctacgatggccgatgacattggcatgggggtcacctatctcgccctgctggctgccttcaaggtgcgccctacatttgcggctggacttctgctccggaagctgacctccaaagagctcatgatgacaaccatcggcattgttctgctttctcaaagcacgatccccgaaacagtgctggagctcaccgatgccctggccctggggatgatggtccttaagatcgtgagaaatatggaaaaataccagctggctgtgacaattatggccatcctctgcgtccctaacgcggttattctgcagaatgcttggaaggtgtcctgtaccatcctcgccgtggtctctgtgagccccctgcttctgacctccagccagcagaagaccgactggattcctctcgccctgacgatcaagggactgaaccccaccgctatcttccttacaaccctgtctcgcacaaataaaaagagatcctggccgctcaacgaggccattatggctgttggcatggtgagcatcctggcctcttccctcctgaagaatgacattcctatgaccgggccccttgtcgcgggaggcctgctgacggtgtgctatgttctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccatcctgattagaacaggcctcctggtcatctccgggctttttcccatttctatcccgattacggctgccgcctggtacctgtgggaggtgaaaaagcagcgggctggagtcctgtgggatgtgccttctccccctcccatgggcaaagcggaactcgaggacggggcctatcgcatcaagcaaaagggaatcctgggctactcccagattggcgctggggtttacaaagaaggaaccttccacacaatgtggcatgtgaccagaggcgccgtccttatgcacaaggggaaacggatcgagccctcctgggccgatgtgaagaaagacctgattagctatggaggcgggtggaagctcgagggagaatggaaggagggcgaagaggttcaggtgctggctctcgaacctggcaaaaatccgcgcgccgtccagacaaagcccgggctgtttaaaaccaacacgggaaccatcggcgcggtgtcccttgatttctctcctgggacaagcggatcccccattatcgacaagaaaggcaaggtggttgggctgtacggaaacggcgtcgtgaccagaagcggcgcttatgtgtctgccatcgcccaaacagagaagtccaccgaggataatcctgaaattgaggacgatatctttcggaaacgcagactgacaattatggacctccaccccggggctggaaagacgaaacggtacctgcctgccatcgtcagagaagcgattaagcgcggccttcggaccctgatcctcgctccgacaagagtggttgccgccgagatggaagaggctctgcgcgggctccccattcggtatcagacccctgccatcagagctgagcataccggacgcgaaatcgtggacctgatgtgtcacgccacattcacgatgcggcttctgagccccgtcagagtgcctaactacaatctgattatcatggatgaggcgcatttcaccgaccccgcctctattgctgcccgcggctatatctccacacgggttgaaatgggggaggctgccggcatttttatgaccgccacaccgcctggaagcagagatcccttcccccagtccaacgctcctatcatcgacgaggaacgggagattcccgaacgctcttggaatagcggccacgagtgggtgaccgattttaaagggaagacggtctggttcgtgccttccatcaaggcgggaaacgacattgccgcttgcctccgcaaaaatggcaagaaagttatccaactgagccggaagacatttgattctgaatacgtgaaaacccgcaccaacgactgggatttcgtcgtgacaaccgacatttccgagatgggggccaattttaaggccgagagagtgatcgatccgcggagatgtatgaaacccgtcatccttacagacggagaggaacgcgttattctggctggccctatgcccgtgacccatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaatacgccggaaggcattatccctagcatgttcgagcccgaaagagagaaggtggacgccattgatggggaataccgcctccggggagaggctagaaaaacatttgtcgaccttatgcgcagaggcgatctgcctgtgtggctggcctataaggttgcggccgaggggatcaactacgctgaccggcgctggtgtttcgatggaatcaaaaacaatcagattctcgaagagaacgtggaagtcgagatctggaccaaggagggcgaaagaaagaaactgaagccccggtggcttgacgcccgcatttattccgatcctctggctctcaaagagtttaaggagttcgccgctgggagaaaatctctgacactgaatctcatcaccgagatgggccggcttcccacgttcatgacccaaaagacaagagacgccctggataacctggcggtgctccacaccgccgaagctggaggccgcgcctacaatcatgctctgagcgagcttccggagacactggaaaccctcctgctgctcacacttctggccaccgttacagggggaatttttctgttcctcatgtccggccgggggatcggaaagatgacactgggcatgtgctgcatcaccaccgcctctattcttctgtggtatgctcagatccagcctcactggattgcggccagcatcattctcgagtttttcctgatcgtgctgctcatccccgaacccgagaaacagagaacacctcaagacaaccagcttacctacgtcgtgattgctatcctgacagtcgtggccgccacgatggctaatgaaatgggctttctggagaagaccaaaaaggacctcgggctgggatccattgccacacagcagccggagagcaacatccttgatattgacctgcgccccgcgtctgcctggaccctctacgctgttgccacaaccttcgtgacgcctatgctgcggcattccatcgaaaatagctccgtgaacgtctctctgaccgctattgccaatcaagcgacagttctcatgggccttgggaaaggatggcccctgagcaagatggatatcggcgtgcctctgctcgccatcgggtgttattcccaggtgaaccccattaccctgacagctgcccttctgctcctggtcgctcactacgccatcattggacctggcctgcaggctaaggccaccagagaggcgcagaaacgggccgctgccggcatcatgaagaatccgacggtggacgggattacagttatcgatctcgaccccatcccttatgatcccaaatttgaaaagcaacttggacaggtgatgctgctgattctctgcgtcacccaggtgctgatgatgcgcacaacctgggctctttgtgaggccctgaccctcgccacaggccctatctctacgctgtgggaagggaaccccggaagattctggaataccacaattgcggtcagcatggctaacatctttcggggctcctacctggccggggctggactccttttcagcattatgaaaaataccacaaacacccgcagaggcacgggcaacatgggggagacactgggagagaagtggaaatctcggctgaatgccctcggcaagtccgaatttcaaatctataagcgcagcgggatccaggaggtggacagaaccctggccaaagaaggaattaagcggggcgagaccgatcaccatgctgtttctcgcgggtccgccaaacttagatggttcgtggagcggaacatggtcacaccggaaggaaaggtggttgacctgggctgcggcagagggggatggagctactattgtggcgggctcaaaaatgtgcgcgaggtcaagggactgaccaagggcgggcctggacacgaagaacccatccccatgtctacatacggctggaacctggtgcggctccagagcggcgtggatgtctttttcattcctcccgaaaaatgcgacacgcttctgtgtgatatcggggagtcctctcctaatccgaccgtcgaggcgggaagaacactgcgcgtgctcaacctggtggaaaattggcttaacaataacacccagttctgcattaaggtcctgaatccctacatgcctagcgttatcgagaaaatggaagccctccaacggaagtatggcggggctctggtgagaaaccccctgtcccgcaatagcacacatgagatgtactgggtgtccaacgcctctggaaatatcgtcagctccgtgaacatgatttctcggatgctcatcaacagatttaccatgcgccacaaaaaggctacgtatgaacctgacgttgaccttggcagcgggacccggaatattggaatcgagtccgagattcccaacctggatatcattggcaagagaatcgagaagatcaagcaggagcatgaaacatcttggcactacgaccaggatcacccgtataaaacctgggcctaccatggcagctatgagacaaagcagaccgggtccgcgagctctatggtgaatggagtcgtgcgcctgctcacaaaaccttgggacgttctgcccaccgtgacgcaaatggccatgacagataccacccctttcggccagcagcgggtctttaaggaaaaggtggacacaagaacgcaggagcccaaagaggggaccaagaaacttatgaagattacagctgaatggctgtggaaagagctcggaaagaaaaagacccctcgcatgtgtacaagagaagagttcacccggaaggtgcgctccaacgccgctctgggcgccatctttacagatgagaataaatggaaaagcgctagagaagccgtcgaggactctcggttctgggaactggttgataaagagagaaacctccacctggaagggaagtgcgagacctgtgtgtacaatatgatgggaaaacgggagaagaaacttggcgaatttggcaaagcgaaggggtcccgcgccatttggtacatgtggctgggagctagattcctcgagtttgaagccctgggcttccttaacgaggaccattggtttagccgggaaaattctctgtccggggtggagggagagggcctccacaaactggggtatatcctgcgcgatgtcagcaagaaagaaggcggagctatgtacgccgacgacacggccggctgggataccagaattacactcgaggacctgaagaacgaagagatggtgaccaatcacatggaaggggagcataagaaacttgcggaggctatcttcaagctgacatatcaaaacaaagttgtgcgggtccagcgccccaccccgagaggaacggtgatggatatcatttcccggcgcgaccagagaggcagcgggcaagttggaacatacggcctcaatacctttacaaacatggaagcccagctgatccggcagatggagggggaaggcgtgttcaagaatattcagcaccttaccgtcacggaggaggtggccgttcaaaactggctggctcgcgtgggaagagaacggctctctcgcatggccatcagcggcgatgactgcgtcgtgaaacctctggatgacagattcgctaacgccctgaccgcgctcaatgatatggggaagattcggaaggacatccagcagtgggagccctccaaaggatggaacgattggacacaggtccccttttgctctcatcacttccatgaactgatcatgaaggacggcagagtgcttgttgtgccttgtcgcaatcaagatgagctgattgggcgggccagaatcagccagggagctggctggtccctccgcgaaaccgcctgcctggggaaatcttatgctcagatgtggagccttatgtactttcaccggagagacctgcgcctcgccgcgaacgccatttgttccgctgtcccgtctcactgggtgcccacaagccggaccacatggtccatccatgccaagcacgagtggatgaccacggaggacatgctgacagtgtggaatagagtttggattcgcgaaaacccttggatggaggataaaacccccgtggaaagctgggaggaaatcccttatctgggcaagcgggaggaccagtggtgcggatctctcattggcctgacctccagagctacatgggccaagaatatccaagctgccatcaaccaggtccgcagccttattgggaatgaggaatacaccgattacatgccctctatgaaacggttcagacgggaggaagaggaagcgggagtgctgtggtga

SEQ ID NO: 20147 - RNA, 9876 nt, synthetic construct
  misc_feature 1..9876: note = derived and/or modified CDS sequence (opt5) from DENV-2__EU482466__SS-prME
  source 1..9876: mol_type = other RNA
agcgccggcatgatcatcatgctgatccccaccgtgatggctttccacctgaccacgcggaatggggagcctcatatgattgtcggaatccaggaaaagggcaagtccctgctttttaagaccgaggacggggttaatatgtgcaccctgatggccatggatctcggagaactgtgtgaggacaccattacctacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcagagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccaacagaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacaacgggctggagtgctgtgggatgttcctagccccctccctatgggcaaggcggaactggaggacggggcctatcgcattaaacagaagggaatccttggctactcccagatcggcgctggggtgtacaaggaaggaaccttccacacaatgtggcatgtcaccagaggcgccgtgctgatgcacaaagggaagcggattgagccctcttgggccgatgttaaaaaggacctcatcagctatggaggcgggtggaaactggagggagaatggaaggagggcgaagaggtgcaggtcctcgctctggaacccggcaagaatcctcgcgccgtgcaaacaaaaccggggctttttaagaccaacacgggaaccattggcgcggtgtccctggatttctctcccgggacaagcggatcccctatcattgacaaaaagggcaaagttgtcgggctgtacggaaacggcgtggtgaccagaagcggcgcttatgtctctgccatcgcccagacagagaagtccatcgaggataatcccgaaattgaggacgatatctttcggaagcgcagactcaccattatggacctgcaccctggggctggaaaaacaaagcggtaccttcccgccatcgtgagagaagcgattaaacgcggcctgcggacgctcatcctggctcctaccagagttgtggccgccgagatggaagaggctctccgcgggctgccgattcggtatcagacacccgccatcagagctgagcataccggacgcgaaatcgtcgaccttatgtgtcacgccaccttcacaatgcggctgctgagccctgtgagagttcccaactacaatctcattatcatggatgaggcgcatttcacggaccctgcctctattgctgcccgcggctatatctccacccgggtggaaatgggggaggctgccggcatttttatgacagccacacccccgggaagcagagatcctttcccccaatccaacgctcccatcatcgacgaggaacgggagattcctgaacgctcttggaatagcggccacgagtgggtcacagattttaaggggaaaaccgtgtggttcgttccctccatcaaggcgggaaacgacattgccgcttgcctgagaaagaatggcaaaaaggtgatccagcttagccggaaaacgtttgattctgaatacgtcaagacacgcaccaacgactgggatttcgtggtgaccacagacatttccgagatgggggccaattttaaagccgagagagtcatcgatcctcggagatgtatgaagccggttatcctgaccgacggagaggaacgcgtgattctcgctggccccatgcctgtgacacatagctctgccgcgcagcggagagggcgcatcggccggaaccccaaaaatgaaaacgaccagtacatttatatgggagagcctctggaaaatgatgaggactgcgctcactggaaggaggccaagatgctgctcgataacatcaatacccccgaaggcattatcccgagcatgttcgagcctgaaagagagaaagtcgacgccattgatggggaataccgccttcggggagaggctagaaagacgtttgtggacctgatgcgcagaggcgatctgcccgtttggctcgcctataaagtggcggccgaggggatcaactacgctgaccggcgctggtgtttcgatggaatcaagaacaatcaaattctggaagagaacgtcgaagtggagatctggacaaaagagggcgaaagaaagaaacttaaacctcggtggctggacgcccgcatttattccgatcccctcgctctgaaggagtttaaagagttcgccgctgggagaaagtctctgaccctcaatcttatcacagagatgggccggctgcctaccttcatgacgcagaaaaccagagacgccctggataacctcgcggttctgcacacagccgaagctggaggccgcgcctacaatcatgctcttagcgagctgcccgagaccctcgaaacactgctgctccttaccctgctggccacagtgaccgggggaatttttctcttcctgatgtccggccgggggatcggaaagatgacgcttggcatgtgctgcatcattacagcctctatcctgctctggtatgctcagattcagccgcactggatcgcggccagcattatcctggagtttttcctgatcgtcctccttattcctgaacccgagaagcaaagaacaccccaggacaaccagctgacctacgtggtcatcgctattctgacagtggttgccgccaccatggctaatgaaatgggctttctcgagaaaacaaagaaagacctggggcttggatccatcgccacgcagcaacctgagagcaacattctggatatcgacctccgcccggcgtctgcctggaccctgtacgctgtggccacaaccttcgtgacacccatgctgcggcattccattgaaaatagctccgtcaacgtttctctcaccgctatcgccaatcaggcgacggtgcttatgggcctggggaagggatggcctctgagcaaaatggatatcggcgtgcccctcctggccattgggtgttattcccaggtcaaccctatcacccttacagctgccctgctcctgctggtggctcactacgccattatcggacccggcctccaggctaaggccaccagagaggcgcaaaagcgggccgctgccggcattatgaaaaatcctacagttgacgggatcaccgtgatcgatcttgacccgattccctatgatcctaagtttgaaaaacagctgggacaggtcatgctgctcatcctgtgcgtgacgcaagtccttatgatgcgcacaacctgggctctgtgtgaggccctcacactggccaccggccccatttctaccctgtgggaagggaaccctggaagattctggaatacaacgatcgcggtgagcatggctaacatttttcggggctcctacctcgccggggctggacttctgttcagcatcatgaagaataccacaaacacccgcagaggcacaggcaacatgggggagaccctgggagagaaatggaagtctcggctcaatgccctgggcaaatccgaatttcagatctataaaaagagcgggattcaggaggttgaccgcacgcttgccaaagaaggaatcaagagaggcgagacagatcaccatgctgtgtctcgggggtccgccaaactgcgctggttcgtcgagagaaacatggtgacccccgaaggaaaggttgtggacctcggctgcggcagagggggatggagctactattgtggcgggctgaaaaatgtccgggaggtgaagggactgaccaagggcgggccgggacacgaagaacctattcccatgtctacatacggctggaacctcgtgcgccttcagagcggcgttgatgtctttttcattccccctgaaaaatgcgacaccctgctgtgtgatattggggagtcctctcccaatcctacagtggaggcgggacggacgctcagagtgctgaaccttgtcgaaaattggctgaacaataacacccaattctgcatcaaggttctcaatccgtacatgcccagcgtgatcgagaaaatggaagccctgcagcgcaagtatggcggggctctggtgcggaaccctctctccagaaatagcacacatgagatgtactgggtctccaacgcctctggaaatattgtgagctccgttaacatgatctctcgcatgcttattaaccggtttaccatgagacacaaaaaggctacatatgaacccgacgtggacctgggcagcgggacccgcaatatcggaattgagtccgagacgcctaacctggatatcattggcaagcggatcgagaagatcaagcaggagcatgaaacctcttggcactacgaccaggatcacccctataaaacatgggcctaccatggcagctatgagaccaagcaaacagggtccgcgagctctatggtcaatggagtggttagactcctgaccaaaccgtgggacgtgcttcctacagtcacccagatggccatgacggatacaacccccttcggccagcagcgcgtgtttaaggaaaaggtggacacccggacacaagagcctaaagaggggacgaagaaactgatgaagattaccgctgaatggctctggaaagagctgggaaagaaaaagacacccagaatgtgtacccgcgaagagttcacaagaaaggtccggtccaacgccgctctgggcgccatctttaccgatgagaataaatggaaaagcgctcgcgaagccgttgaggactctagattctgggaactcgtggataaagagcggaacctgcaccttgaagggaagtgcgagacatgtgtgtacaatatgatgggaaaaagagagaagaagctgggcgaatttggcaaagcgaaggggtcccgggccatttggtacatgtggctcggagctcgcttcctggagtttgaagcccttggcttcctgaacgaggaccattggtttagcagagaaaattctctctccggggtcgagggagagggcctgcacaaactggggtatatcctccgggatgtgagcaagaaagaaggcggagctatgtacgccgacgacaccgccggctgggatacgcgcattaccctggaggaccttaagaacgaagagatggttacaaatcacatggaaggggagcataagaaactggcggaggctatcttcaagctcacctatcagaacaaagtggtcagagtgcagcggcctacaccccgcggaaccgttatggatatcatttccagacgggaccaacgcggcagcgggcaggtcggaacgtacggcctgaatacatttaccaacatggaagcccagcttatcagacagatggagggggaaggcgtcttcaagaatattcaacacctgacagtgaccgaggaggttgccgtgcagaactggctcgctcgggtcggacgcgaaagactgtctcggatggccatcagcggcgatgactgcgtggtcaaaccgctggatgaccgcttcgctaacgccctcacggcgctgaatgatatggggaagattagaaaggacatccagcagtgggagccttccaaaggatggaacgattggacccaagtgcccttttgctctcatcacttccatgaacttatcatgaaggacggccgggttctggtggtcccctgtagaaatcaggatgagctcattgggcgcgcccggatcagccagggagctggctggtccctgagagaaacagcctgccttgggaaatcttatgctcagatgtggagcctgatgtactttcaccgccgggacctcagactggccgcgaacgccatttgttccgctgtgccttctcactgggtgccgaccagccgcacaacctggtccatccatgccaagcacgagtggatgacaaccgaggacatgctgacggtttggaatcgggtgtggattagagaaaacccctggatggaggataaaacacctgtcgaaagctgggaggaaatcccctatctcggcaagcgcgaggaccaatggtgcggatctctgattggccttacctcccgggctacctgggccaagaatatccaggctgccatcaaccaggtgagaagcctgattgggaatgaggaatacacagattacatgccttctatgaaacgcttccggagagaggaagaggaagcgggagttctctggtga

SEQ ID NO: 20148 - RNA, 9876 nt, synthetic construct
  misc_feature 1..9876: note = derived and/or modified CDS sequence (opt5) from DENV-2__EU482467__SS-prME
  source 1..9876: mol_type = other RNA
agcgccggaatgatcattatgctgatccccacagtgatggctttccacctgacaacgagaaatggggagcctcatatgattgttggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacattaaaacacgcaccaacgactgggatttcgtcgtgaccacagacatctccgagatgggggccaattttaaggccgagagagtgatcgatccgcggagatgtatgaaacccgtcattcttaccgacggagaggaacgcgttatcctggctggccctatgcccgtgacacatagctctgccgcgcagcggagagggcgcattggccggaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaataccgcctccggggagaggctagaaaaacgtttgtcgaccttatgcgcagaggcgatctgcctgtgtggctggcctataaggttgcggccgaggggatcaactacgctgaccggcgctggtgtttcgatggaattaaaaacaatcagatcctcgaagagaacgtggaagtcgagatttggacaaaggagggcgaaagaaagaaactgaagccccggtggcttgacgcccgcatctattccgatcctctggctctcaaagagtttaaggagttcgccgctgggagaaaatctctgaccctgaatctcattacagagatgggccggcttcccaccttcatgacgcaaaagaccagagacgccctggataacctggcggtgctccacacagccgaagctggaggccgcgcctacaatcatgctctgagcgagcttccggagaccctggaaacactcctgctgctcacccttctggccacagttaccgggggaatctttctgttcctcatgtccggccgggggatcggaaagatgacgctgggcatgtgctgcattatcacagcctctattcttctgtggtatgctcagatccagcctcactggattgcggccagcatcatcctcgagtttttcctgattgtgctgctcatccccgaacccgagaaacagagaacccctcaagacaaccagcttacctacgtcgtgattgctatcctgacagtcgtggccgccaccatggctaatgaaatgggctttctggagaagaccaagaaggacctcgggctgggatccattgccacgcagcagccggagagcaacatccttgatattgacctgcgccccgcgtctgcctggaccctctacgctgttgccacaaccttcgtgacacctatgctgcggcattccatcgaaaatagctccgtgaacgtctctctgaccgctatcgccaatcaagcgacggttctcatgggccttgggaaaggatggcccctgagcaagatggatattggcgtgcctctgctcgccatcgggtgttattcccaggtgaaccccattaccctgacagctgcccttctgctcctggtcgctcactacgccatcattggacctggcctgcaggctaaggccaccagagaggcgcagaaacgggccgctgccggcatcatgaagaatccgacagtggacgggatcaccgttattgatctcgaccccatcccttatgatcccaaatttgaaaagcaacttggacaggtgatgctgctgattctctgcgtcacacaggtgctgatgatgcgcacaacctgggctctttgtgaggccctgacactcgccaccggccctatctctaccctgtgggaagggaaccccggaagattctggaatacaacgattgcggtcagcatggctaacatctttcggggctcctacctggccggggctggactccttttcagcatcatgaaaaataccacaaacacccgcagaggcacaggcaacatgggggagaccctgggagagaagtggaaatctcggctgaatgccctcggcaagtccgaatttcaaatttataagaaaagcgggatccaggaggtggaccgcacgctggccaaggaaggaattaaaagaggcgagacagatcaccatgctgtttctcgggggtccgccaaacttcgctggttcgtggagagaaacatggtcaccccggaaggaaaagtggttgacctgggctgcggcagagggggatggagctactattgtggcgggctcaagaatgtgcgggaggtcaagggactgaccaaaggcgggcctggacacgaagaacccatccccatgtctacatacggctggaacctggtgcgcctccagagcggcgtggatgtctttttcattcctcccgaaaagtgcgacacccttctgtgtgatatcggggagtcctctcctaatccgacagtcgaggcgggacggacgctgagagtgctcaacctggtggaaaattggcttaacaataacacccagttctgcatcaaagtcctgaatccctacatgcctagcgttattgagaagatggaagccctccaacgcaaatatggcggggctctggtgcggaaccccctgtccagaaatagcacacatgagatgtactgggtgtccaacgcctctggaaatatcgtcagctccgtgaacatgatttctcgcatgctcatcaaccggtttaccatgagacacaagaaggctacatatgaacctgacgttgaccttggcagcgggacccgcaatattggaatcgagtccgagattcccaacctggatatcatcggcaaacggattgaaaagatcaaacaggagcatgaaacgtcttggcactacgaccaggatcacccgtataagacctgggcctaccatggcagctatgagacaaaacagaccgggtccgcgagctctatggtgaatggagtcgtgagactgctcacaaagccttgggacgttctgcccaccgtgacacaaatggccatgaccgatacgacacctttcggccagcagcgcgtctttaaggaaaaagtggacacccggacccaggagcccaaggaggggaccaagaaacttatgaaaattacggctgaatggctgtggaaagagctcggcaaaaagaagacccctagaatgtgtacacgcgaagagttcaccagaaaagtgcggtccaacgccgctctgggcgccatctttacagatgagaataagtggaaaagcgctcgcgaagccgtcgaggactctagattctgggaactggttgataaggagcggaacctccacctggaagggaaatgcgagacctgtgtgtacaatatgatgggaaagagagagaagaaacttggcgaatttggcaaggcgaaagggtcccgggccatttggtacatgtggctgggagctcgcttcctcgagtttgaagccctgggcttccttaacgaggaccattggtttagcagagaaaattctctgtccggggtggagggagagggcctccacaagctggggtatatcctgcgggatgtcagcaaaaaggaaggcggagctatgtacgccgacgacacagccggctgggatacccgcatcacgctcgaggacctgaagaacgaagagatggtgaccaatcacatggaaggggagcatagaaaacttgcggaggctattttcaagctgacatatcaaaacaaagttgtgcgggtccagcgccccaccccgagaggaacagtgatggatatcatttcccggcgcgaccagagaggcagcgggcaagttggaacctacggcctcaatacgtttacaaacatggaagcccagctgatccggcagatggagggggaaggcgtgttcaagaatattcaccatcttaccgtcacagaggaggtggccgttcagaactggctggctcgcgtgggaagagaacggctctctcgcatggccatcagcggcgatgactgcgtcgtgaaacctctggatgacagattcgctaacgccctgaccgcgctcaatgatatggggaagatccggaaggacattcaacagtgggagccctccaaaggatggaacgattggacgcaggtccccttttgctctcaccatttccacgaactgatcatgaaggacggcagagtgcttgttgtgccttgtcgcaatcaggatgagctgattgggcgggccagaatcagccaaggagctggctggtccctccgcgaaaccgcctgcctggggaaatcttatgctcagatgtggagccttatgtactttcaccggagagacctgcgcctcgccgcgaacgccatttgttccgctgtcccgtctcattgggtgcccacaagccggaccacatggtccatccacgccaagcatgagtggatgaccacagaggacatgctgaccgtgtggaatagagtttggattcgcgaaaacccttggatggaggataaaacgcccgtggaaagctgggaggaaatcccttatctgggcaagcgggaggaccagtggtgcggatctctcatcggcctgacatccagagctacctgggccaagaatattcaggctgccatcaaccaagtccgcagccttattgggaatgaggaatacaccgattacatgccctctatgaaacggttcagacgggaggaagaggaagcgggagtgctgtggtga

SEQ ID NO: 20149 - RNA, 9876 nt, synthetic construct
  misc_feature 1..9876: note = derived and/or modified CDS sequence (opt5) from DENV-2__EU482468__SS-prME
  source 1..9876: mol_type = other RNA
agcgccggaatgatcattatgctgatccccaccgtcatggctttccacctcacaacgagaaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattatgcggcatcccgggttcaccatcatggccgctattctggcctacacaatcggaaccacccactttcagcgcgttctcattttcatcctgcttacagctgtggccccttccatgacgatgagatgcattggcatctctaaccgggattttgtcgaaggggtgagcggaggctcctgggttgacatcgtgctggagcacgggagctgtgtcaccacaatggcgaagaataagcccaccctcgatttcgaactgattaaaacagaggccaagcagcctgctacccttcgcaaatattgcatcgaagccaagctgacgaacacaaccaccgagtctagatgtccgacacaaggagagccctccctcaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctggaatacacgattgtggtgacaccccactctggggaggagcatgccgtcggaaacgacacaggcaaacacggcaaggaaatcaaagtgacccctcagtccagcatcacagaggcggaactcaccgggtatggaacggttaccatggagtgttctcccagaacaggcctggatttcaatgaaatggtgcttctgcaaatggagaacaaggcctggctcgtccaccggcagtggtttctggaccttccgctgccttggctccccggggctgataagcaggagtccaattggattcagaaagaaaccctggtgacattcaagaaccctcatgccaaaaagcaagacgttgtggtcctgggaagccaggagggcgctatgcacaccgccctcacgggggccacagaaatccagatgtcctctggcaatctgctttttaccggacatctgaaatgccgcctcagaatggacaagctgcaacttaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctggagaagcggtacgtgctcggacgcctgattacagtcaaccctatcgtgacggagaaggattctccggttaacattgaagcggagcccccttttggcgactcctacatcattatcggggtggagcccggccagctgaagctcaattggttcaaaaagggaagctctattggccaaatgtttgaaaccacaatgagaggggccaaaagaatggctatcctgggagataccgcctgggacttcggcagccttgggggagtctttacatccatcggcaaggccctgcatcaggtgttcggggctatttatggcgccgcgttttctggagtgagctggaccatgaaaatcctcattggcgttatcattacgtggatcgggatgaactcccgcagcacatctctgtccgtcagcctggtgcttgtgggaatcgtcaccctctacctgggcgtgatggttcaggctgattctgggtgtgtggtctcctggaagaataaggagctgaaatgcggaagcggcattttcatcaccgacaacgtgcacacatggaccgaacagtataagtttcaacctgagtccccctctaaactcgccagcgccattcagaaggctcaggaagaggggatctgtggcattcggtccgttacaagactggagaatcttatgtggaaacagatcacgccggaactgaaccacatcctcgccgagaatgaagtgaagctgaccattatgacaggagatatccgcggcattatgcaagctgggaaacggtctctgagacctcagcccaccgagcttaagtacagctggaagacatggggaaaagccaagatgctctccaccgaaagctataaccagacgttcctgatcgacggccctgagaccgcggagtgccccaatacaaaccgcgcctggaactctctggaagtcgaggattacgggtttggagtgttcaccacaaacatttggctcaaactgaaggaaaaacaggacgctttttgtgactccaaacttatgagcgccgctatcaaggataatcgggccgttcatgcggacatgggctattggatggagtctgccctgaacgatacctggaaaatcgagaaggcttccttcattgaagtgaaaaattgccactggcctaagagccatacactctggtctaacggcgtcctggagagcgaaatgatcattcccaaaaacctggccgggccggtgtcccaacacaattacagacctggataccacacccagatcgctggcccctggcatcttgggaagctcgagatggacttcgatttttgtgacggaacgacagtgattgtcaccgaagattgcggcaaccgcgggcccagcctgcggaccacaaccgcctctggaaagctgatcacggagtggtgctgtagatcctgcacactccctccgctgcggtatcgcggcgaggacggctgttggtacgggatggaaattagaccccttaaagagaaggaagagaatctggttaacagcctcgtgaccgccggacacggccaggtggataatttctccctgggggtcctgggaatggctctttttctcgaagagatgctgcggacaagagtgggcaccaaacatgcgatcctgctcgttgccgtgtctttcgtcacactgatcaccgggaacatgagctttaaggaccttggacgcgtggttgtgatggtcggcgctacgatggccgatgacattggcatgggggtgacctatctggccctcctggctgccttcaaagttcggcctacatttgcggctggactgcttctgagaaagctcacctccaaggagctgatgatgacaaccatcggcattgtgctcctgtctcaaagcacgatccccgaaacagtccttgagctgaccgatgccctcgccctggggatgatggtgctgaaaattgtgcgcaatatggaaaagtaccagcttgctgtcacaatcatggccatcctgtgcgttcctaacgcggtgattctccagaatgcttggaaagtgtcctgtaccatcctggccgtcgtgtctgttagccccctcctgcttacctccagccagcaaaagacagactggattcctctggccctcacgatcaaaggactgaaccccaccgctattttcctgacaaccctttctagaacaaataagaaacggtcctggccgctgaacgaggccatcatggctgtgggcatggtcagcatcctcgcctcttccctgctcaagaatgacattcctatgaccgggcccctggtggcgggaggccttctgacggtttgctatgtgctgacaggccgcagcgccgatctcgaactggagagagctaccgacgtcaagtgggaggatcaggccgaaatctctgggtccagccctattctttccatcaccattagcgaggacggatctatgagcatcaaaaacgaagaggaggaacagacactgaccattctcatccggacaggcctgctcgtgatctccgggctgtttcccatttctatcccgattacggctgccgcctggtacctttgggaggtcaagaaacagcgcgctggagtgctgtgggatgttccttctccccctcccatgggcaaggcggaactggaggacggggcctatagaatcaaacaaaagggcattctgggctactcccagatcggcgctggggtgtacaaggaaggaaccttccacacaatgtggcatgtcacccggggcgccgtgctgatgcacaaagggaagcgcatcgagccctcctgggccgatgttaaaaaggaccttattagctatggaggcgggtggaaactggagggagaatggaaggagggcgaagaggtgcaggtcctcgctctggaacctggcaagaatccgagagccgtgcagacaaaacccgggctctttaagaccaacacgggaaccatcggcgcggtgtccctggatttctctcctgggacaagcggatcccccattatcgacaaaaagggcaaagttgtcgggctttacggaaacggcgtggtgacccggagcggcgcttatgtctctgccattgcccaaacagagaagtccatcgaggataatcctgaaatcgaggacgatatttttcgcaagagacggctgaccatcatggacctgcaccccggggctggaaaaacaaagagatacctccctgccattgtgcgcgaagcgatcaaacggggcctgagaacgcttattctggctccgacccgcgttgtggccgccgagatggaagaggctctccgggggctgcccatcagatatcagacccctgccattcgcgctgagcataccggacgggaaatcgtcgacctcatgtgtcacgccaccttcacaatgagactgcttagccccgtgcgcgttcctaactacaatctgatcattatggatgaggcgcatttcacggaccccgcctctatcgctgcccggggctatatttccaccagagtggaaatgggggaggctgccggcatctttatgacagccaccccgcctggaagccgggatcccttcccccagtccaacgctcctattatcgacgaggaacgcgagatccccgaaagatcttggaatagcggccacgagtgggtcacagattttaaggggaaaaccgtgtggttcgttccttccattaaggcgggaaacgacatcgccgcttgcctgcggaagaatggcaaaaaggtgattcaactcagccgcaaaacgtttgattctgaatacgtcaagacaagaaccaacgactgggatttcgtggtgaccacagacatctccgagatgggggccaattttaaagccgagcgggtcattgatccgagacgctgtatgaagcccgttatcctgaccgacggagaagaacgggtgatccttgctggccctatgcccgtgacacatagctctgccgcgcagagacgcgggcggattggcagaaaccctaaaaatgaaaacgaccagtacatctatatgggagagcccctggaaaatgatgaggactgcgctcactggaaggaggccaagatgctcctggataacattaataccccggaaggcatcattcctagcatgttcgagcccgaacgcgagaaagtcgacgccatcgatggggaataccggctgagaggagaggctcgcaagacgtttgtggacctcatgagacggggcgatcttcctgtttggctggcctataaagtggcggccgaggggattaactacgctgaccgcagatggtgtttcgatggaatcaagaacaatcagatcctggaagagaacgtcgaagtggagatttggacaaaagagggcgaacggaagaagctcaaaccccgctggctggacgccagaatctattccgatcctcttgctctgaaggagtttaaagagttcgccgctgggcggaagtctctcaccctgaatctgattacagagatgggcagactccccaccttcatgacgcagaagacccgcgacgcccttgataacctggcggttctgcacacagccgaagctggaggccgggcctacaatcatgctctcagcgagctgccggagacccttgaaacactgctcctgctgaccctccttgccacagtgaccgggggaatctttctgttcctgatgtccggcagagggattggaaagatgacgctcggcatgtgctgcatcatcacagcctctaccctgctttggtatgctcagattcagcctcactggatcgcggccagcattatcctggagtttttcctcattgtcctgctgatccccgaacccgagaagcagcgcacccctcaagacaaccagctcacatacgtggtcatcgctattcttaccgtggttgccgccacaatggctaatgaaatgggctttctggagaaaacgaagaaagacctggggctcggatccatcgccacccagcagccggagagcaacattctggatatcgaccttcggcccgcgtctgcctggacactgtacgctgtggccaccacattcgtgacccctatgctcagacattccattgaaaatagctccgtcaacgtttctctgacggctatcgccaatcaagcgaccgtgctgatgggcctcgggaagggatggccccttagcaaaatggatattggcgtgcctctgctggccatcgggtgttattcccaggtcaaccccatcacactcaccgctgccctgcttctgctcgtggctcactacgccattatcggacctggcctgcaggctaaggccacacgggaggcgcagaagcgcgccgctgccggcattatgaaaaatccgaccgttgacgggatcacggtgattgatctggaccccatcccttatgatcccaagtttgaaaaacaactcggacaggtcatgcttctgatcctgtgcgtgacacaggtcctcatgatgagaaccacatgggctctgtgtgaggcccttaccctggccaccggccctatttctacactctgggaagggaaccccggacggttctggaatacgaccatcgcggtgagcatggctaacatttttcgcggctcctacctggccggggctggactcctcttcagcatcatgaagaatacaaccaacacaagacggggcaccggcaacattggggagacgcttggagagaaatggaagtctcgcctgaatgccctgggcaaatccgaatttcaaatctataaaaagagcgggatccaggaggttgacagaacactcgccaaagaaggaattaagcggggcgagaccgatcaccatgctgtgtctcgcgggtccgccaaactgagatggttcgtcgagcggaacatggtgaccccggaaggaaaggttgtggaccttggctgcggcagagggggatggagctactattgtggcgggctgaaaaatgtccgcgaggtgaagggactcacaaagggcgggcctggacacgaagaacccatccccatgtctacctacggctggaacctggtgcggctgcagagcggcgttgatgtctttttcattcctcccgaaaaatgcgacacactcctttgtgatatcggggagtcctctcctaatccgacggtggaggcgggaagaaccctgcgcgtgctgaacctcgtcgaaaattggctgaacaataacacacagttctgcattaaggttcttaatccctacatgcctagcgtgatcgagaaaatggaagccctgcaacggaagtatggcggggctctcgtgagaaaccccctgtcccgcaatagcacccatgagatgtactgggtctccaacgcctctggaaatatcgtgagctccgttaacatgatttctcggatgctgatcaacagatttacaatgcgccacaaaaaggctacctatgaacctgacgtggacctcggcagcgggacgcggaatattggaatcgagtccgagattcccaaccttgatatcattggcaagagaatcgagaagatcaagcaggagcatgaaacctcttggcactacgaccaggatcacccgtataaaacatgggcctaccatggcagctatgagaccaagcagacagggtccgcgagctctatggtcaatggagtggttcgcctgctgaccaaaccttgggacgtgctccccacagtcacccaaatggccatgacggatacaacccctttcggccagcagcgggtgtttaaggaaaaggtggacaccagaacacaggagcccaaagaggggacgaagaaactgatgaagattaccgctgaatggctttggaaagagctgggaaagaaaaagacacctcgcatgtgtaccagagaagagttcacacggaaggtccgctccaacgccgctctcggcgccatctttaccgatgagaataaatggaaaagcgctagagaagccgttgaggactctcggttctgggaactggtggataaagagagaaacctgcacctcgaagggaagtgcgagacatgtgtgtacaatatgatgggaaaacgggagaagaagctgggcgaatttggcaaagcgaaggggtcccgcgccatttggtacatgtggcttggagctagattcctggagtttgaagccctcggcttcctgaacgaggaccattggtttagccgggaaaattctctttccggggtcgagggagagggcctgcacaaactcgggtatatcctgcgcgatgtgagcaagaaagaaggcggagctatgtacgccgacgacaccgccggctgggatacgagaattaccctggaggacctcaagaacgaagagatggttacaaatcacatggaaggggagcataagaaactggcggaggctatcttcaaacttacctatcaaaacaaagtggtccgggtgcagcgccccacaccgagaggaaccgttatggatatcatttcccggcgcgaccagagaggcagcgggcaagtgggaacgtacggcctgaatacatttaccaacatggaagcccagctcatccggcagatggagggggaaggcgtcttcaagaatattcagcacctgacagtgaccgaggaggttgccgtgcataactggcttgctcgcgtcggaagagaacggctgtctcgcatggccatcagcggcgatgactgcgtggtcaaacctctcgatgacagattcgctaacgccctgacggcgctgaatgatatggggaagattcggaaggacatccaacagtgggagccctccaaaggatggaacgattggacccaggtgcccttttgctctcaccatttccacgaactcatcatgaaggacggcagagttctggtggtcccttgtcgcaatcaggatgagcttattgggcgggccagaatcagccaaggagctggctggtccctgcgcgaaacagcctgcctcgggaaatcttatgctcagatgtggagcctgatgtactttcaccggagagaccttcgcctggccgcgaacgccatttgttccgctgtgccgtctcattgggtgcccaccagccggacaacctggtccatccacgccaagcatgagtggatgacaaccgaggacatgctcacggtttggaatagagtgtggattcgcgaaaacccttggatggaggataaaacacccgtcgaaagctgggaggaaatcccttatctgggcaagcgggaggaccagtggtgcggatctctgattggcctcacctccagagctacctgggccaagaatatccaggctgccatcaaccaagtgcgcagcctgattgggaatgaggaatacacagattacatgccctctatgaaacggttcagacgggaggaagaggaagcgggagttctttggtga

SEQ ID NO: 20150 - RNA, 9876 nt, synthetic construct
  misc_feature 1..9876: note = derived and/or modified CDS sequence (opt5) from DENV-2__EU482469__SS-prME
  source 1..9876: mol_type = other RNA
agcgccggaatgatcattatgctgatccccacagtgatggctttccacctgacaacgcggaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcccacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcatgggagctgtgtcaccacaatggcgaagaataagcccaccctggatttcgaacttattaaaacagaggccaagcagcctgctaccctgcgcaaatactgcatcgaagccaagctcacgaacacaaccaccgagtctagatgtccgacacaaggagagccctccctgaaagaagaacaagacaagcggtttgtgtgcaagcacagcatggtggatcgcggctggggcaatgggtgtggactgttcggcaaagggggaattgtcacatgcgctatgtttacatgcaagaaaaacatggaaggcaagatcgttcagcctgagaatctcgaatatacgattgtggtgacaccccattctggggaggagcacgccgtcggaaacgacacaggcaaacacggcatggaaatcaaggtgacccctcagtccagcatcacagaggcggaactgaccgggtacggaacggttaccatggagtgttctcccagaacaggccttgatttcaatgaaatggtgctgctccaaatggagaacaaagcctggctggtccatcggcagtggtttcttgacctgccgctcccttggctgcccggggctgataagcaggagtccaattggattcagaaggaaaccctggtgacattcaaaaaccctcacgccaagaaacaagacgttgtggtcctcggaagccaggagggcgctatgcataccgccctgacgggggccacagaaatccagatgtcctctggcaatcttctgtttaccggacacctcaagtgccgcctgagaatggacaaacttcaactgaagggcatgagctattccatgtgtacagggaagttcaaagtggtcaaggagattgctgagacccagcatggaaccatcgtgattcgggttcagtacgaaggcgatgggagcccctgcaaaatccccttcgagatcatggacctcgaaaagagatatgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccaccaggtgttcggggctatttacggcgccgcgttttctggagtgagctggaccatgaagatcctgattggcgttatcattacgtggatcgggatgaactcccgcagcacatctctgtccgtcagccttgtgctcgtgggaatcgtcaccctgtatctgggcgtgatggttcaggctgattctgggtgtgtggtctcctggaaaaataaggagctcaagtgcggaagcggcattttcatcaccgacaacgtgcacacatggaccgaacagtacaaatttcaacctgagtccccctctaagctggccagcgccattcagaaagctcaggaagaggggatctgtggcattcggtccgttacaagacttgagaatctgatgtggaagcagatcacgccggaactcaaccatatcctggccgagaatgaagtgaaactgaccattatgacaggagatatccgcggcattatgcaagctgggaagcggtctcttagacctcagcccaccgagctcaaatatagctggaagacatggggaaaggccaaaatgctgtccaccgaaagctacaaccagacgttcctgatcgacggccctgagaccgcggagtgccccaatacaaaccgcgcctggaactctctcgaagtcgaggattatgggtttggagtgttcaccacaaacatttggctgaaacttaaagaaaagcaggacgctttttgtgactccaaactgatgagcgccgctatcaaggataatcgggccgttcacgcggacatgggctactggatcgagtctgccctcaacgatacctggaagattgagaaggctagcttcatcgaagtgaagaattgccattggcctaaaagccacacactgtggtctaacggcgtcctggagagcgaaatgattatccccaagaaccttgccgggccggtgtcccaacacaattatagacctggataccatacccagattgctggcccctggcacctcgggaaactggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtaccgcggcgaggacggctgttggtatgggatggaaatcagacccctgaaggagaaagaagagaatctcgttaacagcctggtgaccgccggacatggccaggtggataatttctccctgggggtccttggaatggctctctttctggaagagatgctgcggacaagagtgggcaccaagcacgcgatcctcctggttgccgtgtctttcgtcacacttattaccgggaacatgagctttaaagacctgggacgcgtggttgtgatggtcggcgctacgatggccgatgacatcggcatgggggtgacctacctcgccctgctggctgccttcaaggttcggcctacatttgcggctggacttctgctcagaaaactgacctccaaggagctcatgatgacaaccattggcatcgtgctgctttctcaaagcacgattcccgaaacagtcctggagctcaccgatgccctggccctggggatgatggtgcttaagatcgtgcgcaatatggaaaaatatcagctggctgtcacaatcatggccattctctgcgttcctaacgcggtgatcctgcagaatgcttggaaggtgtcctgtaccattctcgccgtcgtgtctgttagccccctgcttctgacctccagccagcagaagaccgactggatccctctcgccctgacgattaagggactgaaccccaccgctatcttccttacaaccctgtctagaacaaataaaaagcggtcctggccgctcaacgaggccatcatggctgtgggcatggtcagcattctggcctcttccctcctgaaaaatgacatccctatgaccgggccccttgtggcgggaggcctgctgacggtttgctacgtgctcacaggccgcagcgccgatctggaacttgagagagctaccgacgtcaagtgggaggatcaggccgaaatttctgggtccagccctatcctgtccattaccatcagcgaggacggatctatgagcattaagaacgaagaggaggaacagacactcaccatcctgatccggacaggcctcctggtgatttccgggctttttcccatctctattccgatcacggctgccgcctggtatctgtgggaggtcaaaaagcagcgcgctggagtgctgtgggatgttccttctccccctcccatgggcaaagcggaactcgaggacggggcctacagaattaagcaaaaaggaatcctgggctattcccagatcggcgctggggtgtacaaggaaggaaccttccatacaatgtggcacgtcacccggggcgccgtgcttatgcacaaggggaaacgcattgagccctcctgggccgatgttaagaaagacctgatcagctacggaggcgggtggaagctcgagggagaatggaaagagggcgaagaggtgcaggtcctggctctcgaacctggcaagaatccgagagccgtgcagacaaagcccgggctgtttaaaaccaacacgggaaccattggcgcggtgtcccttgatttctctcctgggacaagcggatcccccatcattgacaagaaaggcaaggttgtcgggctgtatggaaacggcgtggtgacccggagcggcgcttacgtctctgccatcgcccaaacagagaaaaatatcgaggataaccctgaaattgaggacgatatctttcgcaagagacggctgaccattatggacctccatcccggggctggaaagacaaaaagatatctgcctgccatcgtgcgcgaagcgattaagcggggccttagaacgctgatcctcgctccgacccgcgttgtggccgccgagatggaagaggctctgcgggggctccccattagataccagacccctgccatccgcgctgagcacaccggacgggaaatcgtcgacctgatgtgtcatgccaccttcacaatgagacttctgtcccccgtgcgcgttcctaattataacctgattatcatggatgaggcgcacttcacggaccccgccagcattgctgcccggggctacatctctaccagagtggaaatgggggaggctgccggcatttttatgacagccaccccgcctggatcccgggatcccttcccccagagcaatgctcctatcatcgacgaggaacgcgagattcccgaaagatcctggaactctggccatgagtgggtcacagattttaaagggaagaccgtgtggttcgttcctagcatcaaagcgggaaatgacattgccgcttgcctccggaagaacggcaagaaagtgatccaactgtcccgcaagacgtttgatagcgaatatgtcaaaacaagaaccaatgactgggatttcgtggtgaccacagacatttctgagatgggggccaactttaaggccgagcgggtcatcgatccgagacgctgtatgaaacccgttatccttaccgacggagaggaacgggtgattctggctggccctatgcccgtgacacactccagcgccgcgcagagacgcgggcggatcggcagaaatcctaagaacgaaaatgaccagtacatttacatgggagagcccctcgaaaacgatgaggactgcgctcactggaaagaggccaagatgctgctggataatatcaacaccccggaaggcattatcccttctatgttcgagcccgaacgcgagaaggtcgacgccattgatggggaatatcggctcagaggagaggctcgcaaaacgtttgtggaccttatgagacggggcgatctgcctgtttggctggcctacaaggtggcggccgaggggatcaactatgctgaccgcagatggtgtttcgatggaatcaaaaataaccagattctcgaagagaatgtcgaagtggagatctggacaaaggagggcgaacggaaaaagctgaagccccgctggcttgacgccagaatttacagcgatcctctggctctcaaagagtttaaggagttcgccgctgggcggaaatccctgaccctgaacctcatcacagagatgggcagacttcccaccttcatgacgcaaaagacccgcgacgccctggataatctggcggttctccatacagccgaagctggaggccgggcctataaccacgctctgtctgagcttccggagaccctggaaacactcctgctgctcacccttctggccacagtgaccgggggaatttttctgttcctcatgagcggcagagggatcggaaaaatgacgctgggcatgtgctgcatcattacagcctccatccttctgtggtacgctcagattcagcctcattggatcgcggcctctattatcctcgagtttttcctgatcgtcctgctcattcccgaacccgagaagcagcgcacccctcaagacaatcagcttacctatgtggtcatcgctattctgacagtggttgccgccaccatggctaacgaaatgggctttctggagaagaccaagaaggacctcgggctgggaagcatcgccacgcagcagccggagtccaatattcttgatatcgacctgcggcccgcgagcgcctggaccctctacgctgtggccacaaccttcgtgacacctatgctgagacactctattgaaaactccagcgtcaatgtttccctgaccgctatcgccaaccaagcgacggtgctcatgggccttgggaaaggatggcccctgtctaagatggatatcggcgtgcctctgctcgccattgggtgttacagccaggtcaatcccatcaccctgacagctgcccttctgctcctggtggctcactatgccattatcggacctggcctgcaggctaaagccacccgggaggcgcagaagcgcgccgctgccggcattatgaagaacccgacagttgacgggatcaccgtgatcgatctcgaccccattccttacgatcccaaatttgaaaagcaacttggacaggtcatgctgctgatcctctgcgtgacgcaggtcctgatgatgagaacaacctgggctctttgtgaggccctgacactcgccaccggccctatttccaccctgtgggaagggaatcccggacggttctggaacacaacgatcgcggtgtctatggctaatatttttcgcggcagctatctggccggggctggactccttttctccatcatgaaaaacaccacaaacaccagacggggcacaggcaataccggggagacgctgggagagaagtggaaaagccgcctgaacgccctcggcaagtctgaatttcaaatctacaaaaagtccgggattcaggaggttgacagaacactggccaaggaaggaatcaaacggggcgagaccgatcatcacgctgtgagccgcgggtctgccaaacttagatggttcgtcgagcggaatatggtgaccccggaaggaaaagttgtggacctgggctgcggcagagggggatggtcctattactgtggcgggctcaagaacgtccgcgaggtgaaaggactgacaaagggcgggcctggacatgaggaacccattcccatgagcacctatggctggaatctggtgcggctccagtctggcgttgatgtctttttcatccctcccgaaaagtgcgacacacttctgtgtgatattggggagagctcccctaacccgacggtggaggcgggaagaaccctgcgcgtgctcaatctggtcgaaaactggcttaataacaatacacagttctgcatcaaagttctgaacccctacatgccttctgtgatcgagaagatggaagccctccaacggaaatacggcggggctctggtgagaaatcccctgagccgcaactccacccacgagatgtattgggtcagcaatgcctccggaaacattgtgtctagcgttaacatgatctcccggatgctcattaatagatttacaatgcgccataagaaagctacctacgaacctgacgtggaccttggctctgggacgcggaacatcggaattgagagcgagatccccaatctggatattatcggcaagagaatcgaaaagattaaacaggagcacgaaacctcctggcactatgaccaggatcatccgtacaagacatgggcctatcacggctcttacgagaccaaacagacagggagcgcgtccagcatggtcaacggagtggttcgcctgctcaccaagccttgggacgtgctgcccacagtcacccaaatggccatgacggatacaacccctttcggccagcagcgggtgtttaaagaaaaggtggacaccagaacacaggagcccaaggaggggacgaagaaacttatgaaaatcaccgctgaatggctgtggaaagagctcggcaagaagaaaacacctcgcatgtgtaccagagaagagttcacaaagaaggtccggtctaatgccgctctgggcgccatttttaccgatgagaacaaatggaagtccgctcgcgaagccgttgaggacagcagattctgggaactggtggataaagagcggaatctccatctggaagggaagtgcgagacatgtgtgtataacatgatgggaaaaagagagaagaaacttggcgaatttggcaaagcgaaggggtctcgggccatctggtacatgtggctgggagctcgcttcctcgagtttgaagccctgggcttccttaatgaggaccactggttttccagagaaaacagcctgtctggggtcgagggagagggcctccacaaactggggtacattctgcgggatgtgtccaagaaagaaggcggagctatgtatgccgacgacaccgccggctgggatacgcgcatcaccctcgaggacctgaagaatgaagagatggttacaaaccatatggaaggggagcacaagaaacttgcggaggctatcttcaagctgacctaccaaaataaagtggtcagagtgcagcggcccacaccgcgcggaaccgttatggatattatcagcagacgggaccagcgcggctccgggcaagtgggaacgtatggcctcaacacatttaccaatatggaagcccagctgattagacagatggagggggaaggcgtcttcaagaacatccagcatcttacagtgaccgaggaggttgccgtgcacaactggctggctcgggtcggacgcgaaagactcagccggatggccatttctggcgatgactgcgtggtcaaacctctggatgaccgcttcgctaatgccctgacggcgctcaacgatatggggaagatcagaaaggacatccaacagtgggagcccagcaaaggatggaatgattggacccaggtgcccttttgctcccatcacttccacgaactgattatgaaggacggccggatccttgttgtgccttgtagaaaccaggatgagctgattgggcgcgcccggatctctcaaggagctggctggagcctcagagaaacagcctgcctggggaaatcctacgctcagatgtggtctcttatgtattttcatcgccgggacctgagactcgccgcgaatgccatttgtagcgctgtcccgtcccactgggtgcccacctctcgcacaacctggagcatccatgccaagcacgagtggatgacaaccgaggacatgctgacggtgtggaaccgggtttggattagagaaaatccttggatggaggataaaacacccgtggaatcctgggaggaaatcccttacctgggcaagcgcgaggaccagtggtgcggaagcctcatcggcctgacctctcgggctacctgggccaagaacattcaggctgccatcaatcaagtcagatcccttattgggaacgaggaatatacagattacatgcccagcatgaaacgcttccggagagaggaagaggaagcgggagtgctgtggtga

SEQ ID NO: 20151 - RNA, 9876 nt, synthetic construct
  misc_feature 1..9876: note = derived and/or modified CDS sequence (opt5) from DENV-2__EU482470__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagtccctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatgaccattctctgcgttcctaacgccgtgatcctgcagaatgcgtggaaggtgtcctgtaccattctcgctgtcgtgtctgttagccccctgcttctgacatccagccgccagaaaacggactggatccctctcgccctgaccattaagggactgaaccccacagccatcttccttaccacactgtctagaaccaataaaaagcggtcctggccgctcaacgaggctatcatggccgtgggcatggtcagcattctggcttcttccctcctgaagaatgacatccctatgacggggccccttgtggccggaggcctgctgacagtttgctatgtgctcaccggccgcagcgcggatctggaacttgagagagccaccgacgtcaaatgggaggatcaagctgaaatttctgggtccagccctatcctgtccattacaatcagcgaggacggatctatgagcattaagaacgaagaggaggaacagaccctcacaatcctgatccggacgggcctcctggtgatttccgggctttttcccatctctattccgatcaccgccgctgcctggtacctgtgggaggtcaaaaagcagcgcgccggagtgctgtgggatgttccttctccccctcccatgggcaaagctgaactcgaggacggggcgtatagaattaagcagaagggaatcctgggctactcccaaatcggcgccggggtgtacaaagaaggaacattccacaccatgtggcatgtcacacggggcgctgtgcttatgcacaaggggaaacgcattgagccctcctgggccgatgttaagaaagacctgatcagctatggaggcgggtggaagctcgagggagaatggaaggagggcgaagaggtgcaggtcctggccctcgaacctggcaaaaatccgagagctgtgcagaccaagcccgggctgtttaaaacgaacaccggaacaattggcgccgtgtcccttgatttctctcctgggaccagcggatcccccatcattgacaagaaaggcaaggttgtcgggctgtacggaaacggcgtggtgacacggagcggcgcgtatgtctctgctatcgcccagaccgagaagtccatcgaggataatcctgaaattgaggacgatatctttcgcaaaagacggctgacaattatggacctccaccccggggccggaaagacgaaaagatacctgcctgctatcgtgcgcgaagccattaagcggggccttagaaccctgatcctcgcgccgacacgcgttgtggctgccgagatggaagaggccctgcgggggctccccattagatatcaaacccctgctatccgcgccgagcataccggacgggaaatcgtcgacctgatgtgtcacgctacattcacgatgagacttctgagccccgtgcgcgttcctaactacaatctgattatcatggatgaggcccatttcaccgaccccgcgtctattgccgctcggggctatatctccacaagagtggaaatgggggaggccgctggcatttttatgaccgccacaccgcctggaagccgggatcccttcccccagtccaacgcccctatcatcgacgaggaacgcgagattcccgaaagatcttggaatagcggccacgagtgggtcaccgattttaaagggaagacggtgtggttcgttccttccatcaaggctggaaacgacattgcggcctgcctccggaaaaatggcaagaaagtgatccagctgagccgcaagacatttgattctgaatacgtcaaaaccagaaccaacgactgggatttcgtggtgacaaccgacatttccgagatgggggctaattttaaggccgagcgggtcatcgatccgagacgctgtatgaaacccgttatccttacagacggagaggaacgggtgattctggccggccctatgcccgtgacccatagctctgctgcccaaagacgcgggcggatcggcagaaaccctaagaatgaaaacgaccagtacatttatatgggagagcccctcgaaaatgatgaggactgcgcgcactggaaggaggctaaaatgctgctggataacatcaatacgccggaaggcattatccctagcatgttcgagcccgaacgcgagaaggtcgacgccattgatggggaataccggctcagaggagaggcccgcaaaacatttgtggaccttatgagacggggcgatctgcctgtttggctggcttataaggtggccgcggaggggatcaactacgccgaccgcagatggtgtttcgatggaatcaaaaacaatcagattctcgaagagaacgtcgaagtggagatctggaccaaggagggcgaacggaagaaactgaagccccgctggcttgacgctagaatttattccgatcctctggccctcaaagagtttaaggagttcgctgccgggcggaaatctctgacactgaatctcatcaccgagatgggcagacttcccacgttcatgacccagaagacacgcgacgctctggataacctggccgttctccacaccgcggaagccggaggccgggcttacaatcatgccctgagcgagcttccggagacactggaaaccctcctgctgctcacacttctggctaccgtgacagggggaatttttctgttcctcatgtccggcagagggatcggaaagatgacactgggcatgtgctgcatcattaccgcctctatccttctgtggtatgcccaaattcagcctcactggatcgctgcgagcattatcctcgagtttttcctgatcgtcctgctcattcccgaacccgagaaacagcgcacccctcaggacaaccaacttacatacgtggtcatcgccattctgaccgtggttgctgccacaatggccaatgaaatgggctttctggagaagacgaaaaaggacctcgggctgggatccatcgctacccagcagccggagagcaacattcttgatatcgacctgcggcccgcctctgcgtggacactctacgccgtggctaccacattcgtgacccctatgctgagacattccattgaaaatagctccgtcaacgtttctctgacggccatcgctaatcaggccaccgtgctcatgggccttgggaaaggatggcccctgagcaagatggatatcggcgtgcctctgctcgcgattgggtgttattcccaagtcaaccccatcacactgaccgccgcccttctgctcctggtggcccactacgctattatcggacctggcctgcaggccaaggctacacgggaggcccagaaacgcgcggccgctggcattatgaagaatccgaccgttgacgggatcacggtgatcgatctcgaccccattccttatgatcccaaatttgaaaagcagcttggacaagtcatgctgctgatcctctgcgtgacacaggtcctgatgatgagaaccacatgggccctttgtgaggctctgaccctcgccaccggccctatttctacactgtgggaagggaaccccggacggttctggaatacgaccatcgccgtgagcatggcgaacatttttcgcggctcctacctggctggggccggactccttttcagcatcatgaaaaatacaaccaacacaagacggggcaccggcaacatgggggagacgctgggagagaagtggaaatctcgcctgaatgctctcggcaagtccgaatttcagatctataagaaaagcgggattcaagaggttgacagaacactggccaaggaaggaatcaaacggggcgagaccgatcaccatgccgtgtctcgcgggtccgctaaacttagatggttcgtcgagcggaacatggtgaccccggaaggaaaagttgtggacctgggctgcggcagagggggatggagctactattgtggcgggctcaagaatgtccgcgaggtgaagggactgacaaaaggcgggcctggacacgaagaacccattcccatgtctacctacggctggaacctggtgcggctccagagcggcgttgatgtctttttcatccctcccgaaaagtgcgacacacttctgtgtgatattggggagtcctctcctaatccgacggtggaggccggaagaaccctgcgcgtgctcaacctggtcgaaaattggcttaacaataacacacagttctgcatcaaagttctgaatccctacatgcctagcgtgatcgagaagatggaagcgctccagcggaaatatggcggggccctggtgagaaaccccctgtcccgcaatagcacccatgagatgtactgggtctccaacgcttctggaaatattgtgagctccgttaacatgatctctcggatgctcattaacagatttacaatgcgccacaagaaggccacctatgaacctgacgtggaccttggcagcgggacgcggaatatcggaattgagtccgagatccccaacctggatattatcggcaaaagaatcgaaaagattaaacaagagcatgaaacctcttggcactacgaccaggatcacccgtataagacatgggcttaccatggcagctatgagaccaaacagacagggtccgccagctctatggtcaatggagtggttcgcctgctcaccaagccttgggacgtgctgcccacagtcacccagatggcgatgacggatacaacccctttcggccaacagcgggtgtttaaggaaaaagtggacaccagaacacaggagcccaaggaggggacgaagaaacttatgaaaatcaccgccgaatggctgtggaaagagctcggcaagaagaagacacctcgcatgtgtaccagagaagagttcacacggaaagtccgctccaacgctgccctgggcgctatttttaccgatgagaataagtggaaaagcgccagagaagctgttgaggactctgggttctgggaactggtggataaggagcggaacctccacctggaaggaaaatgcgagacatgtgtgtacaatatgatgggcaagagagagaagaaacttggcgaatttgggaaggccaaaggatcccgggcgatctggtacatgtggctgggcgcccgcttcctcgagtttgaagctctggggttccttaacgaggaccattggtttagcagagaaaattctctgtccggagtcgagggcgaggggctccacaagctgggctatattctgcgggatgtgagcaaaaaggaaggaggcgccatgtacgctgacgacaccgccgggtgggatacgcgcatcaccctcgaggacctgaagaacgaagagatggttacaaatcacatggaaggagagcataagaaacttgccgaggcgatcttcaaactgacctatcagaacaaagtggtcagagtgcaacggcccacaccgcgcggcaccgttatggatattatctccagacgggaccagcgcgggagcggacaggtgggcacgtacgggctcaatacatttaccaacatggaagctcaactgattagacagatggagggcgaaggagtcttcaaaaatatccagcaccttacagtgaccgaggaggttgccgtgcagaactggctggcccgggtcggccgcgaaagactctctcggatggctattagcggggatgactgcgtggtcaagcctctggatgaccgcttcgccaacgctctgacggccctcaatgatatgggaaagatcagaaaagacatccaacagtgggagccctccaagggctggaacgattggacccaggtgcccttttgctctcatcacttccatgaactgattatgaaagacgggcgggttcttgtggtcccttgtagaaatcaggatgagctgatcggacgcgcgcggattagccaaggcgccgggtggtccctcagagaaacagcttgcctgggcaagtcttatgcccagatgtggagccttatgtactttcaccgccgggacctgagactcgctgccaacgcgatctgttccgccgtgccgtctcactgggtgcccaccagccgcacaacctggtccattcatgctaaacacgagtggatgacaaccgaggacatgctgacggtttggaatcgggtgtggatcagagaaaacccttggatggaggataagacacccgtcgaaagctgggaggaaattccttatctgggaaagcgcgaggaccagtggtgcggctctctcatcgggctgacctcccgggccacctgggctaaaaatatccaggccgctattaaccaagtgagaagccttatcggaaatgaggaatacacagattacatgccctctatgaagcgcttccggagagaggaagaggaagccggcgttctgtggtga

SEQ ID NO: 20152 - RNA, 9876 nt, synthetic construct
  misc_feature 1..9876: note = derived and/or modified CDS sequence (opt5) from DENV-2__EU482471__SS-prME
  source 1..9876: mol_type = other RNA
agcgctggaatgatcattatgctgatccccacagtgatggctttccacctgacaacgagaaatggggagcctcatatgattgtcggaatccaggaaaagggcaagtccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctacctccacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcattccgtcggaaacgacacaggcaaacacggcatggaaatcaaggtgacccctcagagctctatcacagaggccgaactgaccgggtatggaacggttaccatggagtgttcccccagaacaggccttgatttcaatgaaatggtgctgctccaaatggagaacaaagcgtggctggtccaccggcagtggtttcttgacctgccgctcccttggctgcccggggccgataagcaggagagcaattggattcagaaggaaaccctggtgacattcaaaaaccctcatgctaagaaacaagacgttgtggtcctcggatcccaggagggcgccatgcacaccgctctgacgggggccacagaaatccagatgtctagcggcaatcttctgtttaccggacatctcaagtgccgcctgagaatggacaaacttcaactgaagggcatgtcctacagcatgtgtacagggaagttcaaagtggtcaaggagattgccgagacccagcacggaaccatcgtgattcgggttcagtatgaaggcgatgggtctccctgcaaaatccccttcgagatcatggacctcgaaaagagatacgtgctgggacgcctgattacagtcaaccctatcgtgacggagaaagattccccggttaacattgaagctgagcccccttttggcgacagctacatcattatcggggtggagcccggccagctcaagctgaattggttcaagaaaggatctagcattggccaaatgtttgaaaccacaatgagaggggcgaagagaatggccatccttggagataccgcttgggacttcggctccctcgggggagtctttacatctatcggcaaagccctccatcaggtgttcggggccatttatggcgctgcctttagcggagtgtcctggaccatgaagatcctgattggcgttatcattacgtggatcgggatgaacagccgctctacatccctgagcgtctctcttgtgctcgtgggaatcgtcaccctgtacctgggcgtgatggttcaggcggattccgggtgtgtggtcagctggaaaaataaggagctcaagtgcggatccggcattttcatcaccgacaacgtgcacacatggaccgaacagtataaatttcaacctgagtctcccagcaagctggcttccgccattcagaaagcccaggaagaggggatctgtggcattcggtctgttacaagacttgagaatctgatgtggaagcagatcacgccggaactcaaccacatcctggctgagaatgaagtgaaactgaccattatgacaggagatatccgcggcattatgcaagccgggaagcggagccttagacctcagcccaccgagctcaaatactcctggaagacatggggaaaggctaaaatgctgagcaccgaatcttataaccagacgttcctgatcgacggccctgagaccgccgagtgccccaatacaaaccgcgcgtggaactccctcgaagtcgaggattacgggtttggagtgttcaccacaaacatttggctgaaacttaaagaaaagcaggacgccttttgtgacagcaaactgatgtctgctgccatcaaggataatcgggctgttcatgccgacatgggctattggatcgagtccgcgctcaacgatacctggaagattgagaaagccagcttcatcgaagtgaagaattgccactggcctaaatctcatacactgtggagcaacggcgtcctggagtccgaaatgattatccccaagaaccttgctgggccggtgagccaacacaattacagacctggataccacacccagattgccggcccctggcatctcgggaaactggagatggacttcgatttttgtgacggaacgacagtgatcgtcaccgaagattgcggcaaccgcgggccctctctgcggaccacaaccgcttccggaaagctcattacggagtggtgctgtagaagctgcacactgcctccgcttcggtatcgcggcgaggacggctgttggtacgggatggaaatcagacccctgaaggagaaagaagagaatctcgttaactccctggtgaccgccggacacggccaggtggataatttctctctgggggtccttggaatggccctctttctggaagagatgctgcggacaagagtgggcaccaagcatgctatcctcctggttgcggtgagcttcgtcacacttattaccgggaacatgtcctttaaagacctgggacgcgtggttgtgatggtcggcgccacgatggctgatgacatcggcatgggggtgacctatctcgccctgctggccgctttcaaggttcggcctacatttgccgcgggacttctgctcagaaaactgacctctaaggagctcatgatgacaaccattggcatcgtgctgcttagccaatccacgattcccgaaacagtcctggagctcaccgatgctctggccctggggatgatggtgcttaagatcgtgcgcaatatggaaaaataccagctggccgtcacaatcatggctattctctgcgttcctaacgccgtgatcctgcagaatgcgtggaaggtgtcttgtaccattctcgctgtcgtgagcgttagccccctgcttctgaccagctctcagcagaagacggactggatccctctcgccctgacgattaagggactgaaccccaccgccatcttccttacaaccctgtccagaacaaataaaaagcggagctggccgctcaacgaggctatcatggccgtgggcatggtctctattctggcttccagcctcctgaaaaatgacatccctatgaccgggccccttgtggccggaggcctgctgacggtttgctatgtgctcacaggccgctctgcggatctggaacttgagagagccaccaacgtcaagtgggaggaccaggctgaaatttccgggagctcccctatcctgagcattaccatctctgaggatggaagcatgtccattaagaatgaagaggaggaacagacactcaccatcctgatccggacaggcctcctggtgatttctgggctttttcccatcagcattccgatcacggccgctgcctggtacctgtgggaggtcaaaaagcagcgcgccggagtgctgtgggacgttccttctccccctcccatgggcaaagctgaactcgaggatggggcgtatagaattaagcaaaaaggaatcctgggctacagccagatcggcgccggggtgtacaaggaaggaaccttccacacaatgtggcatgtcacccggggcgctgtgcttatgcacaaggggaaacgcattgagcccagctgggccgacgttaagaaagatctgatctcctatggaggcgggtggaagctcgagggagaatggaaagagggcgaagaggtgcaggtcctggccctcgaacctggcaagaacccgagagctgtgcagacaaagcccgggctgtttaaaaccaacacgggaaccattggcgccgtgtctcttgacttcagccctgggacatccggaagccccatcattgataagaaaggcaaggttgtcgggctgtacggaaatggcgtggtgacccggtctggcgcgtatgtctccgctatcgcccaaacagagaaaagcatcgaggacaaccctgaaattgaggatgacatctttcgcaagagacggctgaccattatggatctccaccccggggccggaaagacaaaaagatacctgcctgctatcgtgcgcgaagccattaagcggggccttagaacgctgatcctcgcgccgacccgcgttgtggctgccgagatggaagaggccctgcgggggctccccattagatatcagacccctgctatccgcgccgagcataccggacgggaaatcgtcgacctgatgtgtcacgctaccttcacaatgagacttctgtctcccgtgcgcgttcctaattacaacctgattatcatggacgaggcccatttcacggatcccgcgtccattgccgctcggggctatatcagcaccagagtggaaatgggggaggccgctggcatttttatgacagccaccccgcctggatcccgggaccccttcccccagtctaatgcccctatcatcgatgaggaacgcgagattcccgaaagaagctggaactccggccacgagtgggtcacagactttaaagggaagaccgtgtggttcgttcctagcatcaaagctggaaatgatattgcggcctgcctccggaagaacggcaagaaagtgatccaactgtctcgcaagacgtttgactccgaatacgtcaaaacaagaaccaatgattgggacttcgtggtgaccacagatattagcgagatgggggctaactttaaggccgagcgggtcatcgacccgagacgctgtatgaaacccgttatccttaccgatggagaggaacgggtgattctggccggccctatgcccgtgacacattctagcgctgcccagagacgcgggcggatcggcagaaatcctaagaacgaaaatgaccagtacatttatatgggagagcccctcgaaaacgacgaggattgcgcgcactggaaagaggctaagatgctgctggacaatatcaacaccccggaaggcattatcccttccatgttcgagcccgaacgcgagaaggtcgatgccattgacggggaataccggctcagaggagaggcccgcaaaacgtttgtggatcttatgagacggggcgacctgcctgtttggctggcttataaggtggccgcggaggggatcaactacgccgatcgcagatggtgtttcgacggaatcaaaaataaccagattctcgaagagaatgtcgaagtggagatctggacaaaggagggcgaacggaaaaagctgaagccccgctggcttgatgctagaatttattctgaccctctggccctcaaagagtttaaggagttcgctgccgggcggaaaagcctgaccctgaacctcatcacagagatgggcagacttcccaccttcatgacgcaaaagacccgcgatgctctggacaatctggccgttctccacacagcggaagccggaggccgggcttacaaccatgccctgtccgagcttccggagaccctggaaacactcctgctgctcacccttctggctacagtgaccgggggaatttttctgttcctcatgtctggcagagggatcggaaaaatgacgctgggcatgtgctgcatcattacagccagcatccttctgtggtatgcccagattcagcctcactggatcgctgcgtccattatcctcgagtttttcctgatcgtcctgctcattcccgaacccgagaagcagcgcacccctcaagataatcagcttacctacgtggtcatcgccattctgacagtggttgctgccaccatggccaacgaaatgggctttctggagaagaccaagaaggacctcgggctgggaagcatcgctacgcagcagccggagtctaatattcttgacatcgatctgcggcccgcctccgcgtggaccctctacgccgtggctacaaccttcgtgacacctatgctgagacatagcattgaaaactcctctgtcaatgttagcctgaccgccatcgctaaccaagccacggtgctcatgggccttgggaaaggatggcccctgtccaagatggacatcggcgtgcctctgctcgcgattgggtgttattctcaggtcaatcccatcaccctgacagccgcccttctgctcctggtggcccactacgctattatcggacctggcctgcaggccaaagctacccgggaggcccagaagcgcgcggccgctggcattatgaagaacccgacagttgatgggatcaccgtgatcgacctcgatcccattccttatgaccccaaatttgaaaagcaacttggacaggtcatgctgctgatcctctgcgtgacgcaggtcctgatgatgagaacaacctgggccctttgtgaggctctgacactcgccaccggccctattagcaccctgtgggaagggaatcccggacggttctggaacacaacgatcgccgtgtccatggcgaatatttttcgcggcagctacctggctggggccggactccttttctctatcatgaaaaacaccacaaacaccagacggggcacaggcaatatcggggagaccctgggagagaagtggaaatcccgcctgaacgctctcggcaagagcgaatttcaaatttataaaaagtctgggatccaggaggttgatagaacgctggccaaggaaggaattaaacggggcgagacagaccaccatgccgtgtcccgcgggagcgctaaacttagatggttcgtcgagcggaatatggtgaccccggaaggaaaagttgtggatctgggctgcggcagagggggatggtcttactattgtggcgggctcaagaacgtccgcgaggtgaaaggactgaccaagggcgggcctggacacgaggaacccatccccatgagcacatacggctggaatctggtgcggctccagtccggcgttgacgtctttttcattcctcccgaaaagtgcgatacccttctgtgtgacatcggggagtctagccctaacccgacagtggaggccggaagaacgctgcgcgtgctcaatctggtcgaaaactggcttaataacaatacccagttctgcatcaaagttctgaacccctacatgccttccgtgattgagaagatggaagcgctccaacggaaatatggcggggccctggtgagaaatcccctgagccgcaactccacacatgagatgtactgggtctctaatgctagcggaaacatcgtgtcctctgttaacatgattagccggatgctcatcaatagatttaccatgcgccacaagaaagccacatatgaacctgatgtggaccttggctccgggacccggaacattggaatcgagtctgagattcccaatctggacatcatcggcaagagaattgaaaagatcaaacaggagcatgaaacgagctggcactacgatcaggaccacccgtataagacctgggcttaccatggctcctatgagacaaaacagaccgggagcgcctcttccatggtcaacggagtggttcgcctgctcacaaagccttgggatgtgctgcccaccgtcacacaaatggcgatgaccgacacgacacctttcggccagcagcgggtgtttaaagaaaaggtggataccagaacccaggagcccaaggaggggaccaagaaacttatgaaaattacggccgaatggctgtggaaggagctcggcaagaagaaaacccctcgcatgtgtacaagagaagagttcacccggaaggtccgcagcaatgctgccctgggcgctatctttacagacgagaacaagtggaaatctgccagagaagctgttgaggattcccggttctgggaactggtggacaaggagagaaatctccacctggaagggaaatgcgagacctgtgtgtacaacatgatgggaaagcgggagaagaaacttggcgaatttggcaaagccaaagggagccgcgcgatttggtacatgtggctgggagccagattcctcgagtttgaagctctgggcttccttaatgaggatcattggttttctcgggaaaactccctgagcggggtcgagggagagggcctccacaagctggggtatatcctgcgcgacgtgtccaaaaaggaaggcggagccatgtacgctgatgacacagccggctgggacaccagaatcacgctcgaggatctgaaaaatgaagagatggttaccaaccacatggaaggggagcataagaaacttgccgaggcgattttcaaactgacatatcaaaataaggtggtccgggtgcagcgccccaccccgagaggaacagttatggacatcattagccggcgcgatcagagaggctctgggcaagtgggaacctacggcctcaacacgtttacaaatatggaagctcagctgatccggcagatggagggggaaggcgtcttcaaaaacattcagcaccttaccgtgacagaggaggttgccgtgcataactggctggcccgcgtcggaagagaacggctcagccgcatggctatctccggcgacgattgcgtggtcaagcctctggacgatagattcgccaatgctctgaccgccctcaacgacatggggaaaatccggaaggatattcaacagtgggagccctctaagggatggaatgactggacacaggtgcccttttgcagccaccatttccacgaactgatcatgaaagatggccggattcttgttgtgccttgtcgcaaccaggacgagctgatcgggcgggcgagaatttcccaaggagccggctggtctctccgcgaaaccgcttgcctggggaagtcctatgcccagatgtggtcccttatgtactttcaccggagagatctgcgcctcgctgccaatgcgatctgttctgccgtcccgagccattgggtgcccacatcccggaccacatggagcattcacgctaaacatgagtggatgaccacagaggacatgctgaccgtgtggaacagagtttggatccgcgaaaatccttggatggaggacaagacgcccgtggaatcttgggaggaaatcccttatctgggcaaacgggaggatcagtggtgcggatccctcattggcctgacaagcagagccacctgggctaagaacatccaggccgctattaatcaagtccgctctcttatcgggaacgaggaatacaccgactacatgccctccatgaagcggttcagacgggaggaagaggaagccggagtgctgtggtga

SEQ ID NO: 20153 - RNA, 9876 nt, synthetic construct
  misc_feature 1..9876: note = derived and/or modified CDS sequence (opt5) from DENV-2__EU482472__SS-prME
  source 1..9876: mol_type = other RNA
agcgccggcatgatcattatgctgatccccaccgtcatggctttccacctgaccacgagaaatggggaacctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatccgcggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatggagtctgccctcaacgatacctggaaaatcgagaaggcttccttcattgaagtgaaaaattgccactggcctaagagccatacactgtggtctaacggcgtcctggagagcgaaatgatcattcccaaaaaccttgccgggccggtgtcccaacacaattacagacctggataccacacccagatcgctggcccctggcatctcgggaagctggagatggacttcgatttttgtgacggaacgacagtgattgtcaccgaagattgcggcaaccgcgggcccagcctgcggaccacaaccgcctctggaaagctcatcacggagtggtgctgtagatcctgcacactgcctccgcttcggtatcgcggcgaggacggctgttggtacgggatggaaattagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttatcaccgggaacatgagctttaaggacctgggacgcgtggttgtgatggtcggcgctacgatggccgatgacattggcatgggggtgacctatctcgccctgctggctgccttcaaagttcggcctacatttgcggctggacttctgctcagaaagctgacctccaaggagctcatgatgacaaccatcggcattgtgctgctttctcaaagcacgatccccgaaacagtcctggagctcaccgatgccctggccctggggatgatggtgcttaaaattgtgcgcaatatggaaaagtaccagctggctgtcacaatcatggccatcctctgcgttcctaacgcggtgattctgcagaatgcttggaaagtgtcctgtaccatcctcgccgtcgtgtctgttagccccctgcttctgacctccagccagcaaaagacagactggattcctctcgccctgacgatcaaaggactgaaccccaccgctattttccttacaaccctgtctagaacaaataagaaacggtcctggccgctcaacgaggccatcatggctgtgggcatggtcagcatcctggcctcttccctcctgaagaatgacattcctatgaccgggccccttgtggcgggaggcctgctgacggtttgctatgtgctcacaggccgcagcgccgatctggaacttgagagagctaccgacgtcaagtgggaggatcaggccgaaatctctgggtccagccctattctgtccatcaccattagcgaggacggatctatgagcatcaaaaacgaagaggaggaacagacactcaccattctgatccggacaggcctcctggtgatctccgggctttttcccatttctatcccgattacggctgccgcctggtacctgtgggaggtcaagaaacagcgcgctggagtgctgtgggatgttccttctccccctcccatgggcaaggcggaactcgaggacggggcctatagaatcaaacaaaagggcattctgggatactcccagatcggcgctggggtgtacaaggaaggaaccttccacacaatgtggcatgtcacccggggcgccgtgcttatgcacaaagggaagcgcatcgagccctcctgggccgatgttaaaaaggacctgattagctatggaggcgggtggaaactcgagggagaatggaaggagggcgaagaggtgcaggtcctggctctcgaacctggcaagaatccgagagccgtgcagacaaaacccgggctgtttaagaccaacacgggaatcattggcgcggtgtcccttgatttctctcctgggaccagcggatcccccatcattgacaaaaagggcaaagttgtcgggctgtacggaaacggcgtggtgacacggagcggcgcttatgtctctgccatcgcccaaaccgagaagtccatcgaggataatcctgaaattgaggacgatatctttcgcaagagacggctgacaattatggacctccaccccggggctggaaaaaccaagagatacctgcctgccatcgtgcgcgaagcgattaaacggggccttagaacactgatcctcgctccgacgcgcgttgtggccgccgagatggaagaggctctgcgggggctccccattagatatcagacccctgccatccgcgctgagcatacaggacgggaaatcgtcgacctgatgtgtcacgccaccttcaccatgagacttctgagccccgtgcgcgttcctaactacaatctgattatcatggatgaggcgcatttcacagaccccgcctctattgctgcccggggctatatctccacgagagtggaaatgggggaggctgccggcatttttatgaccgccacaccgcctggaagccgggatcccttcccccagtccaacgctcctatcatcgacgaggaacgcgagattcccgaaagatcttggaatagcggccacgagtgggtcaccgattttaaggggaaaacagtgtggttcgttccttccatcaaggcgggaaacgacattgccgcttgcctccggaagaatggcaaaaaggtgatccaactgagccgcaaaacctttgattctgaatacgtcaagacgagaacaaacgactgggatttcgtggtgaccaccgacatttccgagatgggggccaattttaaagccgagcgggtcatcgatccgagacgctgtatgaagcccgttatccttacagacggagaggaacgggtgattctggctggccctatgcccgtgacccatagctctgccgcgcagagacgcgggcggatcggcagaaaccctaaaaatgaaaacgaccagtacatttatatgggagagcccctcgaaaatgatgaggactgcgctcactggaaggaggccaagatgctgctggataacatcaatacaccggaaggcattatccctagcatgttcgagcccgaacgcgagaaagtcgacgccattgatggggaataccggctcagaggagaggctcgcaagacctttgtggaccttatgagacggggcgatctgcctgtttggctggcctataaagtggcggccgaggggatcaactacgctgaccgcagatggtgtttcgatggaatcaagaacaatcagattctcgaagagaacgtcgaagtggagatctggacgaaagagggcgaacggaagaagctgaaaccccgctggcttgacgccagaatttattccgatcctctggctctcaaggagtttaaagagttcgccgctgggcggaagtctctgacactgaatctcatcaccgagatgggcagacttcccacattcatgacccagaagacgcgcgacgccctggataacctggcggttctccacaccgccgaagctggaggccgggcctacaatcatgctctgagcgagcttccggagacactggaaaccctcctgctgctcacacttctggccaccgtgacagggggaatttttctgttcctcatgtccggcagagggatcggaaagatgaccctgggcatgtgctgcatcattacggcctctatccttctgtggtatgctcagattcagcctcactggatcgcggccagcattatcctcgagtttttcctgatcgtcctgctcattcccgaacccgagaagcagcgcacacctcaagacaaccagcttacctacgtggtcatcgctattctgaccgtggttgccgccacaatggctaatgaaatgggctttctggagaaaaccaagaaagacctcgggctgggatccatcgccacacagcagccggagagcaacattcttgatatcgacctgcggcccgcgtctgcctggacgctctacgctgtggccaccacattcgtgacccctatgctgagacattccattgaaaatagctccgtcaacgtttctctgacagctatcgccaatcaagcgaccgtgctcatgggccttgggaagggatggcccctgagcaaaatggatatcggcgtgcctctgctcgccattgggtgttattcccaggtcaaccccatcacgctgaccgctgcccttctgctcctggtggctcactacgccattatcggacctggcctgcaggctaaggccacacgggaggcgcagaagcgcgccgctgccggcattatgaaaaatccgaccgttgacgggatcacagtgatcgatctcgaccccattccttatgatcccaagtttgaaaaacaacttggacaggtcatgctgctgatcctctgcgtgacccaggtcctgatgatgagaacgacatgggctctttgtgaggccctgaccctcgccacaggccctatttctaccctgtgggaagggaaccccggacggttctggaataccacaatcgcggtgagcatggctaacatttttcgcggctcctacctggccggggctggactccttttcagcatcatgaagaatacgaccaacacaagacggggcaccggcaacatcggggagacactgggagagaaatggaagtctcgcctgaatgccctcggcaaatccgaatttcaaatttataaaaagagcgggatccaggaggttgacagaaccctggccaaagaaggaattaagcggggcgagacggatcaccatgctgtgtctcgcgggtccgccaaacttagatggttcgtcgagcggaacatggtgacaccggaaggaaaggttgtggacctgggctgcggcagagggggatggagctactattgtggcgggctcaaaaatgtccgcgaggtgaagggactgaccaagggcgggcctggacacgaagaacccatccccatgtctacctacggctggaacctggtgcggctccagagcggcgttgatgtctttttcattcctcccgaaaaatgcgacacacttctgtgtgatatcggggagtcctctcctaatccgaccgtggaggcgggaagaacactgcgcgtgctcaacctggtcgaaaattggcttaacaataacacgcagttctgcatcaaggttctgaatccctacatgcctagcgtgattgagaaaatggaagccctccaacggaagtatggcggggctctggtgagaaaccccctgtcccgcaatagcacccatgagatgtactgggtctccaacgcctctggaaatatcgtgagctccgttaacatgatttctcggatgctcatcaacagatttacaatgcgccacaaaaaggctacctatgaacctgacgtggaccttggcagcgggacacggaatattggaatcgagtccgagattcccaacctggatatcatcggcaagagaattgagaagatcaagcaggagcatgaaacctcttggcactacgaccaggatcacccgtataaaacgtgggcctaccatggcagctatgagaccaagcagacagggtccgcgagctctatggtcaatggagtggttcgcctgctcaccaaaccttgggacgtgctgcccacagtcacccaaatggccatgacagataccacgcctttcggccagcagcgggtgtttaaggaaaaggtggacacaagaacccaggagcccaaagaggggaccaagaaacttatgaagattacagctgaatggctgtggaaagagctcggaaagaaaaagacgcctcgcatgtgtaccagagaagagttcacacggaaggtccgctccaacgccgctctgggcgccatctttaccgatgagaataaatggaaaagcgctagagaagccgttgaggactctcggttctgggaactggtggataaagagagaaacctccacctggaagggaagtgcgagacatgtgtgtacaatatgatgggaaaacgggagaagaaacttggcgaatttggcaaagcgaaggggtcccgcgccatttggtacatgtggctgggagctagattcctcgagtttgaagccctgggcttccttaacgaggaccattggtttagccgggaaaattctctgtccggggtcgagggagagggcctccacaaactggggtatatcctgcgcgatgtgagcaagaaagaaggcggagctatgtacgccgacgacaccgccggctgggatacaagaatcaccctcgaggacctgaagaacgaagagatggttacgaatcacatggaaggggagcataagaaacttgcggaggctattttcaagctgacctatcaaaacaaagtggtccgggtgcagcgccccacaccgagaggaaccgttatggatatcatttcccggcgcgaccagagaggcagcgggcaagtgggaacatacggcctcaatacctttacgaacatggaagcccagctgatccggcagatggagggggaaggcgtcttcaagaatattcagcaccttacagtgaccgaggaggttgccgtgcataactggctggctcgcgtcggaagagaacggctctctcgcatggccatcagcggcgatgactgcgtggtcaaacctctggatgacagattcgctaacgccctgacagcgctcaatgatatggggaagatccggaaggacattcaacagtgggagccctccaaaggatggaacgattggacccaggtgcccttttgctctcaccatttccacgaactgatcatgaaggacggcagagttcttgtggtcccttgtcgcaatcaggatgagctgattgggcgggccagaatcagccaaggagctggctggtccctccgcgaaacggcctgcctggggaaatcttatgctcagatgtggagccttatgtactttcaccggagagacctgcgcctcgccgcgaacgccatttgttccgctgtgccgtctcattgggtgcccaccagccggacaacctggtccatccacgccaagcatgagtggatgacaaccgaggacatgctgacagtttggaatagagtgtggattcgcgaaaacccttggatggaggataaaacccccgtcgaaagctgggaggaaatcccttatctgggcaagcgggaggaccagtggtgcggatctctcatcggcctgacgtccagagctacatgggccaagaatattcaggctgccatcaaccaagtgcgcagccttattgggaatgaggaatacaccgattacatgccctctatgaaacggttcagacgggaggaagaggaagcgggagttctgtggtga

SEQ ID NO: 20154 - RNA, 9876 nt, synthetic construct
  misc_feature 1..9876: note = derived and/or modified CDS sequence (opt5) from DENV-2__EU482473__SS-prME
  source 1..9876: mol_type = other RNA
agcgccggaatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcggcggggtctttacatccatcgggaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcagagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccaacagaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacaacgggctggagtgctgtgggatgttccttctccccctcccatgggcaaggcggaactcgaggacggggcctatcgcattaaacagaagggaatcctgggctactcccagatcggcgctggggtgtacaaggaaggaaccttccacacaatgtggcatgtcaccagaggcgccgtgcttatgcacaaagggaagcggattgagccctcctgggccgatgttaaaaaggacctgatcagctatggaggcgggtggaaactcgagggagaatggaaggagggcgaagaggtgcaggtcctggctctcgaacctggcaagaatccgcgcgccgtgcaaacaaaacccgggctgtttaagaccaacacgggaaccattggcgcggtgtcccttgatttctctcctgggacaagcggatcccccatcattgacagaaaaggcaaggttgtcgggctgtacggaaacggcgtggtgacccggagcggcgcttatgtctctgccatcgcccagacagagaaatccatcgaggataatcctgaaattgaggacgatatctttcgcaagagacggctgaccattatggacctccaccccggggctggaaagacaaaaagatacctgcctgccatcgtgcgcgaagcgattaagcggggccttagaacgctgatcctcgctccgacccgcgttgtggccgccgagatggaagaggctctgcgggggctccccattagatatcagacccctgccatccgcgctgagcataccggacgggaaatcgtcgacctgatgtgtcacgccaccttcacaatgagacttctgagccccgtgcgcgttcctaactacaatctgattatcatggatgaggcgcatttcacggaccccgcctctattgctgcccggggctatatctccaccagagtggaaatgggggaggctgccggcatttttatgacagccaccccgcctggaagccgggatcccttcccccaatccaacgctcctatcatcgacgaggaacgcgagattcccgaaagatcttggaatagcggccacgagtgggtcacagattttaaagggaagaccgtgtggttcgttccttccatcaaagcgggaaacgacattgccgcttgcctccggaagaatggcaagaaagtgatccagctgagccgcaagacgtttgattctgaatacgtcaaaacaagaaccaacgactgggatttcgtggtgaccacagacatttccgagatgggggccaattttaaggccgagcgggtcatcgatccgagacgctgtatgaaacccgttatccttaccgacggagaggaacgggtgattctggctggccctatgcccgtgacacatagctctgccgcgcagagacgcgggcggatcggcagaaaccctaagaatgaaaacgaccagtacatttatatgggagagcccctcgaaaatgatgaggactgcgctcactggaaagaggccaagatgctgctggataacatcaataccccggaaggcattatccctagcatgttcgagcccgaacgcgagaaggtcgacgccattgatggggaataccggctcagaggagaggctcgcaaaacgtttgtggaccttatgagacggggcgatctgcctgtttggctggcctataaggtggcggccgaggggatcaactacgctgaccgcagatggtgtttcgatggaatcaaaaacaatcaaattctcgaagagaacgtcgaagtggagatctggacaaaggagggcgaacggaaaaagctgaagccccgctggcttgacgccagaatttattccgatcctctggctctcaaagagtttaaggagttcgccgctgggcggaaatctctgaccctgaatctcatcacagagatgggcagacttcccaccttcatgacgcagaagacccgcgacgccctggataacctggcggttctccacacagccgaagctggaggccgggcctacaatcatgctctgagcgagcttccggagaccctggaaacactcctgctgctcacccttctggccacagtgaccgggggaatttttctgttcctcatgtccggcagagggatcggaaaaatgacgctgggcatgtgctgcatcattacagcctctatccttctgtggtatgctcagattcagcctcactggatcgcggccagcattatcctcgagtttttcctgatcgtcctgctcattcccgaacccgagaagcaacgcacccctcaggacaaccagcttacctacgtggtcatcgctattctgacagtggttgccgccaccatggctaatgaaatgggctttctggagaagaccaagaaggacctcgggctgggatccatcgccacgcagcaaccggagagcaacattcttgatatcgacctgcggcccgcgtctgcctggaccctctacgctgtggccacaaccttcgtgacacctatgctgagacattccattgaaaatagctccgtcaacgtttctctgaccgctatcgccaatcaggcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaagccacccgggaggcgcaaaagcgcgccgctgccggcattatgaagaatccgacagttgacgggatcaccgtgatcgatctcgaccccattccttatgatcccaaatttgaaaagcagcttggacaggtcatgctgctgatcctctgcgtgacgcaagtcctgatgatgagaacaacctgggctctttgtgaggccctgacactcgccaccggccctatttctaccctgtgggaagggaaccccggacggttctggaatacaacgatcgcggtgagcatggctaacatttttcgcggctcctacctggccggggctggactccttttcagcatcatgaaaaataccacaaacaccagacggggcacaggcaacatgggggagaccctgggagagaagtggaaatctcgcctgaatgccctcggcaagtccgaatttcagatctataaaaagagcgggattcaggaggttgacagaacgctggccaaggaaggaatcaaacggggcgagacagatcaccatgctgtgtctcgcgggtccgccaaacttagatggttcgtcgagcggaacatggtgaccccggaaggaaaagttgtggacctgggctgcggcagagggggatggagctactattgtggcgggctcaagaatgtccgcgaggtgaaaggactgaccaagggcgggcctggacacgaggaacccattcccatgtctacatacggctggaacctggtgcggctccagagcggcgttgatgtctttttcatccctcccgaaaagtgcgacacccttctgtgtgatattggggagtcctctcctaatccgacagtggaggcgggaagaacgctgcgcgtgctcaacctggtcgaaaattggcttaacaataacacccaattctgcatcaaagttctgaatccctacatgcctagcgtgatcgagaagatggaagccctccagcggaaatatggcggggctctggtgagaaaccccctgtcccgcaatagcacacatgagatgtactgggtctccaacgcctctggaaatattgtgagctccgttaacatgatctctcggatgctcattaacagatttaccatgcgccacaagaaagctacatatgaacctgacgtggaccttggcagcgggacccggaatatcggaattgagtccgagacgcccaacctggatatcattggcaagagaatcgaaaagatcaaacaggagcatgaaacctcttggcactacgaccaggatcacccgtataagacatgggcctaccatggcagctatgagaccaaacaaacagggtccgcgagctctatggtcaatggagtggttcgcctgctcaccaagccttgggacgtgctgcccacagtcacccagatggccatgacggatacaacccctttcggccagcagcgggtgtttaaagaaaaggtggacaccagaacacaagagcccaaggaggggacgaagaaacttatgaaaattaccgctgaatggctgtggaaagagctcggcaagaagaaaacacctcgcatgtgtaccagagaagagttcacacggaaggtccgctccaacgccgctctgggcgccatctttaccgatgagaataagtggaaaagcgctagagaagccgttgaggactctcggttctgggaactggtggataaggagagaaacctccacctggaagggaaatgcgagacatgtgtgtacaatatgatgggaaagcgggagaagaaacttggcgaatttggcaaagcgaaagggtcccgcgccatttggtacatgtggctgggagctagattcctcgagtttgaagccctgggcttccttaacgaggaccattggtttagccgggaaaattctctgtccggggtcgagggagagggcctccacaagctggggtatatcctgcgcgatgtgagcaaaaaggaaggcggagctatgtacgccgacgacaccgccggctgggatacgagaattaccctcgaggacctgaaaaacgaagagatggttacaaatcacatggaaggggagcataagaaacttgcggaggctatcttcaaactgacctatcagaacaaggtggtccgggtgcagcgccccacaccgagaggaaccgttatggatatcatttcccggcgcgaccaaagaggcagcggacaggtgggaacgtacggcctcaatacatttaccaacatggaagcccagctgatccggcagatggagggggaaggcgtcttcaaaaatattcaacaccttacagtgaccgaggaggttgccgtgcagaactggctggctcgcgtcggaagagaacggctctctcgcatggccatcagcggcgatgactgcgtggtcaagcctctggatgacagattcgctaacgccctgacggcgctcaatgatatggggaaaattcggaaggacatccagcagtgggagccctccaagggatggaacgattggacccaagtgcccttttgctctcatcacttccatgaactgatcatgaaagacggcagagttcttgtggtcccttgtcgcaatcaggatgagctgattgggcgggccagaatcagccagggagctggctggtccctccgcgaaacagcctgcctggggaagtcttatgctcagatgtggagccttatgtactttcaccggagagacctgcgcctcgccgcgaacgccatttgttccgctgtgccgtctcactgggtgcccaccagccggacaacctggtccatccatgccaaacacgagtggatgacaaccgaggacatgctgacggtttggaatagagtgtggattcgcgaaaacccttggatggaggataagacacccgtcgaaagctgggaggaaatcccttatctgggcaaacgggaggaccaatggtgcggatctctcattggcctgacctccagagctacctgggccaagaatatccaggtggctatcaaccaggttcgcagccttattgggaatgaggaatacacagattacatgccctctatgaagcggttcagacgggaggaagaggaagccggagtgctgtggtga

SEQ ID NO: 20155 - RNA, 9876 nt, synthetic construct
  misc_feature 1..9876: note = derived and/or modified CDS sequence (opt5) from DENV-2__EU482474__SS-prME
  source 1..9876: mol_type = other RNA
agcgccggcatgatcattatgctgatccccaccgtgatggctttccacctgacaacgagaaatggggaacctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccgattaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagccataaccagacgttcctgattgacggccctgagaccgcggagtgccccaatacaaacagagcctggaactctctcgaagtggaggattatgggtttggagtcttcaccacaaacatctggctgcgccttaaggaaaaacaggacgctttttgtgactccaagctgatgagcgccgctatcaaggataatcgggccgtgcacgcggacatgggctactggattgagtctgccctcaacgatacctggaaaatcgagaaggcttccttcattgaagttaaaaattgccattggcctaagagccacacactgtggtctaacggcgtgctggagagcgaaatgatcattcccaaaaaccttgccgggccggtctcccaacacaattatagacctggataccatacccagatcgctggcccctggcacctcgggaagctggagatggacttcgatttttgtgacggaacgacagtgattgtgaccgaagattgcggcaaccgcgggcccagcctgcggaccacaaccgcctctggaaagctcatcacggagtggtgctgtagatcctgcacactgcctccgcttcggtaccgcggcgaggacggctgttggtatgggatggaaatcagacccctgaaagagaaggaagagaatctcgtcaacagcctggttaccgccggacatggccaggtggataatttctccctgggggtgcttggaatggctctctttctggaagagatgctgcggacaagagtcggcaccaaacacgcgattctcctggtggccgtttctttcgtgacacttatcaccgggaacatgagctttaaggacctgggacgcgtcgtggttatggtgggcgctacgatggccgatgacattggcatgggggtcacctacctcgccctgctggctgccttcaaagtgcggcctacatttgcggctggacttctgctcagaaagctgacctccaaggagctcatgatgacaaccatcggcattgttctgctttctcaaagcacgatccccgaaacagtgctggagctcaccgatgccctggccctggggatgatggtccttaaaatcgtgcgcaatatggaaaagtatcagctggctgtgacaattatggccatcctctgcgtccctaacgcggttattctgcagaatgcttggaaagtgtcctgtaccatcctcgccgtggtctctgtgagccccctgcttctgacctccagccagcaaaagacagactggattcctctcgccctgacgatcaaaggactgaaccccaccgctatcttccttacaaccctgtctagaacaaataagaaacggtcctggccgctcaacgaggccattatggctgttggcatggtgagcatcctggcctcttccctcctgaagaatgacattcctatgaccgggccccttgtcgcgggaggcctgctgacggtgtgctacgttctcacaggccgcagcgccgatctggaacttgagagagctaccgacgtgaagtgggaggatcaggccgaaatctctgggtccagccctattctgtccatcaccattagcgaggacggatctatgagcatcaaaaacgaagaggaggaacagacactcaccatcctgattcggacaggcctcctggtcatctccgggctttttcccatttctatcccgattacggctgccgcctggtatctgtgggaggtgaagaaacagcgcgctggagtcctgtgggatgtgccttctccccctcccatgggcaaggcggaactcgaggacggggcctacagaatcaaacaaaagggaatcctgggctattcccagattggcgctggggtttacaaggaaggaaccttccatacaatgtggcacgtgacccggggcgccgtccttatgcacaaagggaagcgcatcgagccctcctgggccgatgtgaaaaaggacctgattagctacggaggcgggtggaaactcgagggagaatggaaggagggcgaagaggttcaggtgctggctctcgaacctggcaagaatccgagagccgtccagacaaaacccgggctgtttaagaccaacacgggaaccatcggcgcggtgtcccttgatttctctcctgggacaagcggatcccccattatcgacaaaaagggcaaagtggttgggctgtatggaaacggcgtcgtgacccggagcggcgcttacgtgtctgccatcgcccaaacagagaagtccattgaggataatcctgaaatcgaggacgatatttttcgcaagagacggctgaccatcatggacctccatcccggggctggaaaaacaaagagatatctgcctgccattgtccgcgaagcgatcaaacggggccttagaacgctgattctcgctccgacccgcgtggttgccgccgagatggaagaggctctgcgggggctccccatcagataccagacccctgccatccgcgctgagcacaccggacgggaaattgtggacctgatgtgtcatgccaccttcacaatgagacttctgagccccgtccgcgtgcctaactataatctgatcattatggatgaggcgcacttcacggaccccgcctctatcgctgcccggggctacatttccaccagagttgaaatgggggaggctgccggcatctttatgacagccaccccgcctggaagccgggatcccttcccccagtccaacgctcctatcattgacgaggaacgcgagatccccgaaagatcttggaatagcggccatgagtgggtgacagattttaaggggaaaaccgtctggttcgtgccttccattaaggcgggaaacgacatcgccgcttgcctccggaagaatggcaaaaaggttattcaactgagccgcaaaacgtttgattctgaatatgtgaagacaagaaccaacgactgggatttcgtcgtgaccacagacatctccgagatgggggccaattttaaagccgagcgggtgatcgatccgagacgctgtatgaagcccgtcattcttaccgacggagaggaacgggttatcctggctggccctatgcccgtgacacacagctctgccgcgcagagacgcgggcggattggcagaaaccctaaaaatgaaaacgaccagtacatctacatgggagagcccctcgaaaatgatgaggactgcgctcactggaaggaggccaagatgctgctggataacattaataccccggaaggcatcattcctagcatgttcgagcccgaacgcgagaaagtggacgccgtcgatggggaatatcggctcagaggagaggctcgcaagacgtttgtggaccttatgagacggggcgatctgcctgtttggctggcctacaaagtggcggccgaggggatcaactatgctgaccgcagatggtgtttcgatggaatcaagaacaatcagattctcgaagagaacgtcgaagtggagatctggacaaaagagggcgaacggaagaagctgaaaccccgctggcttgacgccagaatttactccgatcctctggctctcaaggagtttaaagagttcgccgctgggcggaagtctctgaccctgaatctcatcacagagatgggcagacttcccaccttcatgacgcagaagacccgcgacgccctggataacctggcggttctccatacagccgaagctggaggccgggcctataatcacgctctgagcgagcttccggagaccctggaaacactcctgctgctcacccttctggccacagtgaccgggggaatttttctgttcctcatgtccggcagagggatcggaaagatgacgctgggcatgtgctgcatcgtcacagcctctattcttctgtggtacgctcagatccagcctcattggattgcggccagcatcattctcgagtttttcctgatcgtgctgctcatccccgaacccgagaagcagcgcacccctcaagacaaccagcttacctatgtcgtgattgctatcctgacagttgtggccgccaccatggctaatgaaatgggctttctggagaaaacaaagaaagacctcgggctgggatccattgccacgcagcagccggagagcaacatccttgatattgacctgcggcccgcgtctgcctggaccctctacgctgtggccacaaccttcgtcacacctatgctgagacactccatcgaaaatagctccgttaacgtgtctctgaccgctattgccaatcaagcgacggtgctcatgggccttgggaagggatggcccctgagcaaaatggatatcggcgtccctctgctcgccatcgggtgttactcccaggtgaaccccattaccctgacagctgcccttctgctcctggttgctcactatgccatcattggacctggcctgcaggctaaggccacccgggaggcgcagaagcgcgccgctgccggcatcatgaaaaatccgacagtggacgggattaccgtcatcgatctcgaccccatcccttacgatcccaagtttgaaaaacaacttggacaggtgatgctgctgattctctgcgtcacgcaggtcctgatgatgagaacaacctgggctctttgtgaggccctgacactcgccaccggccctatctctaccctgtgggaagggaaccccggacggttctggaatacaacgattgcggttagcatggctaacatctttcgcggctcctatctggccggggctggactccttttcagcattatgaagaataccacaaacaccagacggggcacaggcaacatgggggagaccctgggagagaaatggaagtctcgcctgaatgccctcggcaaatccgaatttcaaatctacaaaaagagcgggatccaggaggtggacagaacgctggccaaagaaggaattaagcggggcgagacagatcatcacgctgtctctcgcgggtccgccaaacttagatggttcgtggagcggaacatggttaccccggaaggaaaggtggtcgacctgggctgcggcagagggggatggagctattactgtggcgggctcaaaaatgtgcgcgaggtgaagggactgaccaagggcgggcctggacatgaagaacccatccccatgtctacatatggctggaacctggttcggctccagagcggcgtcgatgtgtttttcattcctcccgaaaaatgcgacacccttctgtgtgatatcggggagtcctctcctaatccgacagtggaggcgggaagaacgctgcgcgtcctcaacctggttgaaaattggcttaacaataacacccagttctgcattaaggtgctgaatccctacatgcctagcgtgatcgagaaaatggaagccctccaacggaagtacggcggggctctggtcagaaaccccctgtcccgcaatagcacacacgagatgtattgggtgtccaacgcctctggaaatatcgttagctccgtgaacatgatttctcggatgctcatcaacagatttaccatgcgccataaaaaggctacatacgaacctgacgtcgaccttggcagcgggacccggaatattggaatcgagtccgagattcccaacctggatatcattggcaagagaatcgagaagatcaagcaggagcacgaaacgtcttggcactatgaccaggatcatccgtacaaaacctgggcctatcacggcagctacgagacaaagcagaccgggtccgcgagctctatggtgaatggagttgtgcgcctgctcacaaaaccttgggacgtcctgcccaccgtgacacaaatggccatgaccgatacgacacctttcggccagcagcgggtgtttaaggaaaaggtcgacaccagaacccaggagcccaaagaggggacaaagaaacttatgaagattacggctgaatggctgtggaaagagctcggaaagaaaaagacccctcgcatgtgtacaagagaagagttcacccggaaggttcgctccaacgccgctctgggcgccatctttacagatgagaataaatggaaaagcgctagagaagccgtggaggactctcggttctgggaactggtggataaagagagaaacctccatctggaagggaagtgcgagacctgtgtctataatatgatgggaaaacgggagaagaaacttggcgaatttggcaaagcgaaggggtcccgcgccatttggtacatgtggctgggagctagattcctcgagtttgaagccctgggcttccttaacgaggaccactggtttagccgggaaaattctctgtccggggtggagggagagggcctccacaaactggggtacatcctgcgcgatgttagcaagaaagaaggcggagctatgtatgccgacgacacagccggctgggataccagaattacgctcgaggacctgaagaacgaagagatggtgaccaatcatatggaaggggagcacaagaaacttgcggaggctatcttcaagctgacataccaaaacaaagtcgtgcgggttcagcgccccaccccgagaggaacagtgatggatatcatttcccggcgcgaccagagaggcagcgggcaagtcggaacctatggcctcaatacgtttacaaacatggaagcccagctgatccggcagatggagggggaaggcgtgttcaagaatattcagcatcttaccgttacagaggaggtggccgtccaaaactggctggctcgcgtgggaagagaacggctctctcgcatggccatcagcggcgatgactgcgtcgtgaaacctctggatgacagattcgctaacgccctgaccgcgctcaatgatatggggaagattcggaaggacatccagcagtgggagccctccaaaggatggaacgattggacgcaggttcccttttgctctcaccatttccacgaactgatcatgaaggacggcagagtgcttgtcgtgccttgtcgcaatcaagatgagctgattgggcgggccagaatcagccagggagctggctggtccctccgcgaaaccgcctgcctggggaaatcttacgctcagatgtggagccttatgtattttcaccggagagacctgcgcctcgccgcgaacgccatttgttccgctgtgccgtctcattgggttcccacaagccggaccacatggtccatccacgccaagcatgagtggatgaccacagaggacatgctgaccgtgtggaatagagtctggattcgcgaaaacccttggatggaggataaaacgcccgtggaaagctgggaggaaatcccttacctgggcaagcgggaggaccagtggtgcggatctctcattggcctgacatccagagctacctgggccaagaatatccaagctgccatcaaccaggttcgcagccttattgggaatgaggaatataccgattacatgccctctatgaaacggttcagacgggaggaagaggaagcgggagtgctgtggtga

SEQ ID NO: 20156 - RNA, 9876 nt, synthetic construct
  misc_feature 1..9876: note = derived and/or modified CDS sequence (opt5) from DENV-2__EU482475__SS-prME
  source 1..9876: mol_type = other RNA
agcgccggcatgatcattatgctgatccccacagtgatggctttccacctgacgacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagaccgactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgtcgaccggcgctggtgtttcgatggaatcaaaaacaatcagattctcgaagagaacgtggaagttgagatctggacaaaggagggcgaaagaaagaaactgaagccccggtggcttgacgctcgcatttattccgatcctctggccctcaaagagtttaaggagttcgctgccgggagaaaatctctgaccctgaatctcatcacagagatgggccggcttcccaccttcatgacgcaaaagaccagagacgctctggataacctggccgtgctccacacagcggaagccggaggccgcgcttacaatcatgccctgagcgagcttccggagaccctggaaacactcctgctgctcacccttctggctacagtcaccgggggaatttttctgttcctcatgtccggccgggggatcggaaagatgacgctgggcatgtgctgcatcattacagcctctatccttctgtggtatgcccagattcagcctcactggatcgctgcgagcattatcctcgagtttttcctgatcgtgctgctcattcccgaacccgagaaacagagaacccctcaagacaaccagcttacctacgtcgtgatcgccattctgacagttgtggctgccaccatggccaatgaaatgggctttctggagaagaccaagaaggacctcgggctgggatccatcgctacgcagcagccggagagcaacattcttgatatcgacctgcgccccgcctctgcgtggaccctctacgccgtggctacaaccttcgtcacacctatgctgcggcattccattgaaaatagctccgttaacgtgtctctgaccgccatcgctaatcaagccacggtgctcatgggccttgggaaaggatggcccctgagcaagatggatatcggcgtccctctgctcgcgattgggtgttattcccaggtgaaccccatcaccctgacagccgcccttctgctcctggttgcccactacgctattatcggacctggcctgcaggccaaggctaccagagaggcccagaaacgggcggccgctggcattatgaagaatccgacagtggacgggatcaccgtcatcgatctcgaccccattccttatgatcccaaatttgaaaagcaacttggacaggtgatgctgctgatcctctgcgtcacacaggtgctgatgatgcgcacaacctgggccctttgtgaggctctgacactcgccaccggccctatttctaccctgtgggaagggaaccccggaagattctggaatacaacgatcgccgttagcatggcgaacatttttcggggctcctacctggctggggccggactccttttcagcatcatgaaaaataccacaaacacccgcagaggcacaggcaacatgggggagaccctgggagagaagtggaaatctcggctgaatgctctcggcaagtccgaatttcaaatctataagcgcagcgggattcaggaggtggacagaacgctggccaaagaaggaatcaagcggggcgagacagatcaccatgccgtctctcgcgggtccgctaaacttagatggttcgtggagcggaacatggttaccccggaaggaaaggtggtcgacctgggctgcggcagagggggatggagctactattgtggcgggctcaaaaatgtgcgcgaggtgaagggactgaccaagggcgggcctggacacgaagaacccattcccatgtctacatacggctggaacctggttcggctccagagcggcgtcgatgtgtttttcatccctcccgaaaaatgcgacacccttctgtgtgatattggggagtcctctcctaatccgacagtggaggccggaagaacgctgcgcgtcctcaacctggttgaaaattggcttaacaataacacccagttctgcatcaaggtgctgaatccctacatgcctagcgtgatcgagaaaatggaagcgctccaacggaagtatggcggggccctggtcagaaaccccctgtcccgcaatagcacacatgagatgtactgggtgtccaacgcttctggaaatattgttagctccgtgaacatgatctctcggatgctcattaacagatttaccatgcgccacaaaaaggccacatatgaacctgacgtcgaccttggcagcgggacccggaatatcggaattgagtccgagatccccaacctggatattatcggcaagagaatcgagaagattaagcaggagcatgaaacgtcttggcactacgaccaggatcacccgtataaaacctgggcttaccatggcagctatgagacaaagcagaccgggtccgccagctctatggtgaatggagttgtgcgcctgctcacaaaaccttgggacgtcctgcccaccgtgacacaaatggcgatgaccgatacgacacctttcggccagcagcgggtgtttaaggaaaaggtcgacaccagaacccaggagcccaaagaggggacaaagaaacttatgaagatcacggccgaatggctgtggaaagagctcggaaagaaaaagacccctcgcatgtgtacaagagaagagttcacccggaaggttcgctccaacgctgccctgggcgctatttttacagatgagaataaatggaaaagcgccagagaagctgtggaggactctcggttctgggaactggtggataaagagagaaacctccacctggaagggaagtgcgagacctgtgtctacaatatgatgggaaaacgggagaagaaacttggcgaatttggcaaagccaaggggtcccgcgcgatctggtacatgtggctgggagccagattcctcgagtttgaagctctgggcttccttaacgaggaccattggtttagccgggaaaattctctgtccggggtggagggagagggcctccacaaactggggtatattctgcgcgatgttagcaagaaagaaggcggagccatgtacgctgacgacacagccggctgggataccagaatcacgctcgaggacctgaagaacgaagagatggtgaccaatcacatgaagggggaacataagaaacttgccgaggcgatcttcaaactgacatatcaaaacaaagtcgtgcgggttcagcgccccaccccgagaggaacagtgatggatattatctcccggcgcgaccagagaggcagcgggcaagtcggaacctacggcctcaatacgtttacaaacatggaggctcagctgattcggcagatggaaggggagggcgtgttcaaaaatatccagcaccttaccgttacagaagaggtggccgtccaaaactggctggcccgcgtgggaagagagcggctctctcgcatggctattagcggcgatgactgcgtcgtgaagcctctggatgacagattcgccaacgctctgaccgccctcaatgatatggggaagatccggaaagacatccagcagtgggaaccctccaagggatggaacgattggacgcaggttcccttttgctctcatcacttccatgagctgattatgaaagacggcagagtgcttgtcgtgccttgtcgcaatcaagatgaactgatcgggcgggcgagaattagccagggagccggctggtccctccgcgagaccgcttgcctggggaagtcttatgcccagatgtggagccttatgtactttcaccggagagacctgcgcctcgctgccaacgcgatctgttccgccgtgccgtctcactgggttcccacaagccggaccacatggtccattcatgctaaacacgaatggatgaccacagaggacatgctgaccgtgtggaatagagtctggatccgcgagaacccttggatggaagataagacgcccgtggagagctgggaagagattccttatctgggcaagcgggaagaccagtggtgcggatctctcatcggcctgacatccagagccacctgggctaaaaatatccaagccgctattaaccaggttcgcagccttatcgggaatgaggagtacaccgattacatgccctctatgaagcggttcagacgggaagaggaagaggccggagtgctgtggtga

SEQ ID NO: 20157 - RNA, 9876 nt, synthetic construct
  misc_feature 1..9876: note = derived and/or modified CDS sequence (opt5) from DENV-2__EU482541__SS-prME
  source 1..9876: mol_type = other RNA
agcgccggaatgatcattatgctgatccccaccgtcatggctttccacctgaccacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatccgcggcattatgcaagctgggaagcggtctcttagacctcagcccgccgagctcaaatacagctggaagacctggggaaaggcgaaaatgctgtccacagaaagctataaccagaccttcctgatcgacggccctgagacggccgagtgccccaataccaaccgcgcttggaactctctcgaagtcgaggattacgggtttggagtgttcacaaccaacatttggctgaaacttaaagaaaagcaggacgccttttgtgactccaaactgatgagcgctgccatcaaggataatcgggcggttcatgccgacatgggctattggatcgagtctgctctcaacgatacatggaagattgagaaagcctccttcatcgaagtgaagaattgccactggcctaaaagccataccctgtggtctaacggcgtcctggagagcgaaatgattatccccaagaaccttgctgggccggtgtcccaacacaattacagacctggataccacacacagattgccggcccctggcatctcgggaaactggagatggacttcgatttttgtgacggaaccacggtgatcgtcacagaagattgcggcaaccgcgggcccagcctgcggaccaccacagcctctggaaagctcattaccgagtggtgctgtagatcctgcacgctgcctccgcttcggtatcgcggcgaggacggctgttggtacgggatggaaatcagacccctgaaggagaaagaagagaatctcgttaacagcctggtgacagctggacacggccaggtggataatttctccctgggggtccttggaatggcgctctttctggaagagatgctgcggaccagagtgggcacaaagcatgccatcctcctggttgctgtgtctttcgtcacccttattacagggaacatgagctttaaagacctgggacgcgtggttgtgatggtcggcgccaccatggccgatgacatcggcatgggggtgacgtatctcgctctgctggccgcgttcaaggttcggcctacctttgctgccggacttctgctcagaaaactgacatccaaggagctcatgatgaccacaattggcatcgtgctgctttctcaaagcaccattcccgaaacggtcctggagctcacagatgccctggctctggggatgatggtgcttaagatcgtgcgcaatatggaaaaataccagctggccgtcaccatcatggcgattctctgcgttcctaacgctgtgatcctgcagaatgcctggaaggtgtcctgtacaattctcgccgtcgtgtctgttagccccctgcttctgacctccagccagcagaagaccgactggatccctctcgctctgacaattaagggactgaaccccacggccatcttccttaccacactgtctagaaccaataaaaagcggtcctggccgctcaacgaggctatcatggccgtgggcatggtcagcattctggcgtcttccctcctgaaaaatgacatccctatgacagggccccttgtggccggaggcctgctgaccgtttgctatgtgctcacgggccgcagcgctgatctggaacttgagagagccacagacgtcaagtgggaggatcaggctgaaatttctgggtccagccctatcctgtccattaccatcagcgaggacggatctatgagcattaagaacgaagaggaggaacagaccctcacaatcctgatccggaccggcctcctggtgatttccgggctttttcccatctctattccgatcacagccgccgcttggtacctgtgggaggtcaaaaagcagcgcgcgggagtgctgtgggatgttccttctccccctcccatgggcaaagccgaactcgaggacggggcttatagaattaagcaaaaaggaatcctgggctactcccagatcggcgccggggtgtacaaggaaggaacgttccacaccatgtggcatgtcacacggggcgccgtgcttatgcacaaggggaaacgcattgagccctcctgggctgatgttaagaaagacctgatcagctatggaggcgggtggaagctcgagggagaatggaaagagggcgaagaggtgcaggtcctggccctcgaacctggcaagaatccgagagcggtgcagaccaagcccgggctgtttaaaacaaacaccggaacgattggcgctgtgtcccttgatttctctcctgggaccagcggatcccccatcattgacaagaaaggcaaggttgtcgggctgtacggaaacggcgtggtgacacggagcggcgcctatgtctctgccatcgctcaaaccgagaaatccatcgaggataatcctgaaattgaggacgatatctttcgcaagagacggctgacaattatggacctccaccccggggccggaaagaccaaaagatacctgcctgcgatcgtgcgcgaagctattaagcggggccttagaacactgatcctcgccccgacgcgcgttgtggccgctgagatggaagaggccctgcgggggctccccattagatatcagacccctgctatccgcgccgagcatacaggacgggaaatcgtcgacctgatgtgtcacgcgaccttcaccatgagacttctgagccccgtgcgcgttcctaactacaatctgattatcatggatgaggcccatttcacagaccccgcttctattgccgctcggggctatatctccacgagagtggaaatgggggaggccgccggcatttttatgaccgctacaccgcctggaagccgggatcccttcccccagtccaacgcgcctatcatcgacgaggaacgcgagattcccgaaagatcttggaatagcggccacgagtgggtcaccgattttaaagggaagacagtgtggttcgttccttccatcaaagccggaaacgacattgctgcctgcctccggaagaatggcaagaaagtgatccaactgagccgcaagacctttgattctgaatacgtcaaaacgagaacaaacgactgggatttcgtggtgaccaccgacatttccgagatgggggccaattttaaggctgagcgggtcatcgatccgagacgctgtatgaaacccgttatccttacagacggagaggaacgggtgattctggccggccctatgcccgtgacccatagctctgcggctcagagacgcgggcggatcggcagaaaccctaagaatgaaaacgaccagtacatttatatgggagagcccctcgaaaatgatgaggactgcgcccactggaaagaggccaagatgctgctggataacatcaatacaccggaaggcattatccctagcatgttcgagcccgaacgcgagaaggtcgacgctattgatggggaataccggctcagaggagaggcccgcaaaacctttgtggaccttatgagacggggcgatctgcctgtttggctggcgtataaggtggccgctgaggggatcaactacgccgaccgcagatggtgtttcgatggaatcaaaaacaatcagattctcgaagagaacgtcgaagtggagatctggacgaaggagggcgaacggaaaaagctgaagccccgctggcttgacgctagaatttattccgatcctctggccctcaaagagtttaaggagttcgctgccgggcggaaatctctgacactgaatctcatcaccgagatgggcagacttcccacattcatgacccaaaagacgcgcgacgcgctggataacctggccgttctccacaccgctgaagccggaggccgggcttacaatcatgccctgagcgagcttccggagacactggaaaccctcctgctgctcacacttctggccaccgtgacagggggaatttttctgttcctcatgtccggcagagggatcggaaaaatgaccctgggcatgtgctgcatcattacggcttctatccttctgtggtatgcgcagattcagcctcactggatcgccgctagcattatcctcgagtttttcctgatcgtcctgctcattcccgaacccgagaagcagcgcacacctcaagacaaccagcttacctacgtggtcatcgccattctgaccgtggttgccgctacaatggccaatgaaatgggctttctggagaagaccaaaaaggacctcgggctgggatccatcgcgacacagcagccggagagcaacattcttgatatcgacctgcggcccgcctctgcttggacgctctacgccgtggctaccacattcgtgacccctatgctgagacattccattgaaaatagctccgtcaacgtttctctgacagccatcgcgaatcaagccaccgtgctcatgggccttgggaaaggatggcccctgagcaagatggatatcggcgtgcctctgctcgctattgggtgttattcccaggtcaaccccatcacgctgaccgccgcccttctgctcctggtggcccactacgctattatcggacctggcctgcaggccaaagcgacacgggaggcccagaagcgcgctgccgctggcattatgaagaatccgaccgttgacgggatcacagtgatcgatctcgaccccattccttatgatcccaaatttgaaaagcaacttggacaggtcatgctgctgatcctctgcgtgacccaggtcctgatgatgagaacgacatgggccctttgtgaggccctgaccctcgcgacaggccctatttctaccctgtgggaagggaaccccggacggttctggaataccacaatcgctgtgagcatggccaacatttttcgcggctcctacctggctggggccggactccttttcagcatcatgaaaaatacgaccaacacaagacggggcaccggcaacatcggggagacactgggagagaagtggaaatctcgcctgaatgccctcggcaagtccgaatttcaaatttataaaaagagcgggatccaggaggttgacagaaccctggctaaggaaggaattaaacggggcgagacggatcaccatgccgtgtctcgcgggtccgcgaaacttagatggttcgtcgagcggaacatggtgacaccggaaggaaaagttgtggacctgggctgcggcagagggggatggagctactattgtggcgggctcaagaatgtccgcgaggtgaaaggactgaccaagggcgggcctggacacgaggaacccatccccatgtctacctacggctggaacctggtgcggctccagagcggcgttgatgtctttttcattcctcccgaaaagtgcgacacacttctgtgtgatatcggggagtcctctcctaatccgaccgtggaggccggaagaacactgcgcgtgctcaacctggtcgaaaattggcttaacaataacacgcagttctgcatcaaagttctgaatccctacatgcctagcgtgattgagaagatggaagctctccaacggaaatatggcggggccctggtgagaaaccccctgtcccgcaatagcacccatgagatgtactgggtctccaacgcttctggaaatatcgtgagctccgttaacatgatttctcggatgctcatcaacagatttacaatgcgccacaagaaagccacctatgaacctgacgtggaccttggcagcgggacacggaatattggaatcgagtccgagattcccaacctggatatcatcggcaagagaattgaaaagatcaaacaggagcatgaaacctcttggcactacgaccaggatcacccgtataagacgtgggcgtaccatggcagctatgagaccaaacagacagggtccgccagctctatggtcaatggagtggttcgcctgctcaccaagccttgggacgtgctgcccacagtcacccaaatggctatgacagataccacgcctttcggccagcagcgggtgtttaaagaaaaggtggacacaagaacccaggagcccaaggaggggaccaagaaacttatgaaaattacagccgaatggctgtggaaagagctcggcaagaagaaaacgcctcgcatgtgtaccagagaagagttcacacggaaggtccgctccaacgctgccctgggcgctatctttaccgatgagaataagtggaaaagcgccagagaagcggttgaggactctcggttctgggaactggtggataaggagagaaacctccacctggaagggaaatgcgagacatgtgtgtacaatatgatgggaaagcgggagaagaaacttggcgaatttggcaaagccaaagggtcccgcgctatttggtacatgtggctgggagccagattcctcgagtttgaagctctgggcttccttaacgaggaccattggtttagccgggaaaattctctgtccggggtcgagggagagggcctccacaagctggggtatatcctgcgcgatgtgagcaaaaaggaaggcggagccatgtacgccgacgacaccgcgggctgggatacaagaatcaccctcgaggacctgaaaaacgaagagatggttacgaatcacatggaaggggagcataagaaacttgctgaggccattttcaaactgacctatcaaaacaaggtggtccgggtgcagcgccccacaccgagaggaaccgttatggatatcatttcccggcgcgaccagagaggcagcgggcaagtgggaacatacggcctcaatacctttacgaacatggaagcccagctgatccggcagatggagggggaaggcgtcttcaaaaatattcagcgccttacagtgaccgaggaggttgctgtgcacaactggctggccagagtcggacgggaacgcctctctagaatggctatcagcggcgatgactgcgtggtcaagcctctggatgaccggttcgccaacgcgctgacagccctcaatgatatggggaaaatcagaaaggacattcaacagtgggagccctccaagggatggaacgattggacccaggtgcccttttgctctcatcacttccatgaactgatcatgaaagacggccgcattcttgttgtgccttgtcggaatcaggatgagctgatcgggagagctcgcattagccaaggagccggctggtccctccgggaaacggcttgcctggggaagtcttatgcccagatgtggagccttatgtactttcacagacgcgacctgcggctcgcggccaacgctatctgttccgccgtcccgtctcactgggtgcccaccagcagaacaacctggtccattcatgctaaacacgagtggatgacaaccgaggacatgctgacagtgtggaatcgcgtttggatccgggaaaacccttggatggaggataagacccccgtggaaagctgggaggaaatcccttatctgggcaaaagagaggaccagtggtgcggatctctcattggcctgacgtcccgcgccacatgggctaagaatatccaggccgcgattaaccaagtccggagccttatcgggaatgaggaatacaccgattacatgccctctatgaagagattccggagagaggaagaggaagccggagtgctgtggtga

SEQ ID NO: 20158 - RNA, 9876 nt, synthetic construct
  misc_feature 1..9876: note = derived and/or modified CDS sequence (opt5) from DENV-2__EU482542__SS-prME
  source 1..9876: mol_type = other RNA
agcgccggcatgatcattatgctgatccccaccgtcatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaagtgcccttcgagatcatggacctcgaaaagagatacgtcctgggacgcctgatcacagtgaaccctattgttacggagaaagattctccggtgaacatcgaagcggagcccccttttggcgactcctacattatcattggggtcgagcccggccaactcaagctgaattggttcaagaaaggaagctctatcggccagatgtttgaaaccacaatgagaggggccaagagaatggctattcttggagataccgcctgggacttcggcagcctcgggggagtgtttacatccatcggcaaagccctccatcaggtgttcggggctatctatggcgccgcgttttctggagttagctggaccatgaagattctgatcggcgtcattatcacgtggattgggatgaactcccgcagcacatctctgtccgtgagccttgtgctcgtcggaatcgtgaccctgtacctgggcgttatggtgcaggctgattctgggtgtgtcgtgtcctggaaaaataaggagctcaagtgcggaagcggcatcttcattaccgacaacgttcacacatggaccgaacaatataaatttcagcctgagtccccctctaagctggccagcgccatccagaaagctcaggaagaggggacatgtggcattcggtccgtgacgagacttgagaatctgatgtggaagcaaatcaccccggaactcaaccacattctggccgagaatgaagtcaaactgacaatcatgaccggagatatcaagggcattatgcaggctgggaaacgctctcttcggcctcagcccacagagctcaagtacagctggaagacctggggaaaagccaagatgctgtccacggaaagctataaccagaccttcctgatcgacggccctgagacagcggagtgccccaataccaacagagcctggaactctctcgaagtggaggattacgggtttggagttttcacaaccaacatttggctgaaacttaaggaaaaacaagacgctttttgtgactccaagctgatgagcgccgctatcaaggataatcgcgccgtgcatgcggacatgggctattggattgagtctgccctcaacgatacatggaaaatcgagaaggcttccttcatcgaagtcaaaaattgccactggcctaagagccataccctgtggtctaacggcgtgctggagagcgaaatgattatccccaaaaaccttgccgggccggtgtcccagcacaattaccggcctggataccacacgcagattgctggcccctggcatctcgggaagctggagatggacttcgatttttgtgacggaacaaccgtcatcgttaccgaagattgcggcaacagagggcccagcctgcgcacaaccacggcctctggaaagctcattacagagtggtgctgtcggtcctgcaccctgcctccgcttagatatcggggcgaggacggctgttggtacgggatggaaatccgccccctgaaagagaaggaagagaatctcgtgaacagcctggtgacagccggacacggccaagtcgataatttctccctgggggtgcttggaatggctctctttctggaagagatgctgaaaaccagagttggcacaaagcatgcgattctcctggtggccgtctctttcgtgacccttatcacggggaacatgagctttaaagacctgggacgggttgtggtcatggtgggcgctaccatggccgatgacatcggcatgggggttacatatctcgccctgctggctgccttcaaggtgagacctacctttgcggctggacttctgctccgcaagctgacatccaaagagctcatgatgaccacgattggcatcgtcctgctttctcagagcacaattcccgaaaccgtgctggagctcacagatgccctggccctggggatgatggtgcttaagatcgtccggaatatggaaaaataccagctggctgttaccattatggccatcctctgcgtgcctaacgcggtgatcctgcagaatgcttggaaggtctcctgtaccattctcgccgtggtttctgtgagccccctgcttctgacatccagccaacagaaaacggactggatccctctcgccctgaccattaagggactgaaccccacagctatcttccttaccacactgtctagaaccaataaaaagcgctcctggccgctcaacgaggccattatggctgtcggcatggtgagcatcctggcctcttccctcctgaagaatgacatccctatgacggggccccttgttgcgggaggcctgctgacagtgtgctatgtcctcaccggcagaagcgccgatctggaacttgagcgggctaccgacgtgaaatgggaggatcaggccgaaatttctgggtccagccctatcctgtccattacaatcagcgaggacggatctatgagcattaagaacgaagaggaggaacagaccctcacaatcctgattcgcacgggcctcctggtcatctccgggctttttcccatctctattccgatcaccgctgccgcctggtacctgtgggaggtgaaaaagcaaagagctggagttctgtgggatgtgccttctccccctcccatgggcaaagcggaactcgaggacggggcctatcggattaagcagaagggaatcctgggctactcccagattggcgctggggtctacaaagaaggaacattccacaccatgtggcatgtgacacgcggcgccgttcttatgcacaaggggaaaagaatcgagccctcctgggccgatgtgaagaaagacctgatcagctatggaggcgggtggaagctcgagggagaatggaaggagggcgaagaggtccaggtgctggctctcgaacctggcaaaaatccgcgggccgtgcaaaccaagcccgggctgtttaaaacgaacaccggaacaattggcgcggtttcccttgatttctctcctgggaccagcggatcccccatcattgacaagaaaggcaaggtcgtggggctgtacggaaacggcgtggtcacacgcagcggcgcttatgtgtctgccatcgcccagaccgagaagtccattgaggataatcctgaaatcgaggacgatatctttagaaaacggcgcctgacaattatggacctccaccccggggctggaaagacgaaaagatacctgcctgccatcgttcgggaagcgattaagagaggccttcgcaccctgatcctcgctccgacacgggtggtcgccgccgagatggaagaggctctgagagggctccccattcgctatcagacccctgccatccgggctgagcataccggaagagaaattgtggacctgatgtgtcacgccacattcacgatgcgccttctgagccccgttcgggtgcctaactacaatctgatcatcatggatgaggcgcatttcaccgaccccgcctctattgctgccagaggctatatctccacacgcgtcgaaatgggggaggctgccggcatttttatgaccgccacaccgcctggaagccgggatcccttcccccaatccaacgctcctatcattgacgaggaaagagagatccccgaacggtcttggaatagcggccacgagtgggtgaccgattttaaagggaagacggtttggttcgtgccttccatcaaggcgggaaacgacattgccgcttgcctccgcaaaaatggcaagaaagtcatccagctgagcagaaagacatttgattctgaatacgtgaaaacccggaccaacgactgggatttcgtggtcacaaccgacatttccgagatgggggccaattttaaggccgagcgcgttatcgatccgagacggtgtatgaaacccgtgattcttacagacggagaagagagagtgatcctggctggccctatgcccgtcacccatagctctgccgcgcagcgccgggggagaatcggccgcaaccctaagaatgaaaacgaccagtacatttatatgggagagcccctcgaaaatgatgaggactgcgctcactggaaggaggccaaaatgctgctggataacatcaatacgccggaaggcattatccctagcatgttcgagcccgaacgggagaaggtggacgccattgatggggaatacagactccgcggagaggctcggaaaacatttgttgaccttatgagacgcggcgatctgcctgtgtggctggcctataaggtcgcggccgaggggatcaactacgctgacagacggtggtgtttcgatggaattaaaaacaatcaaatcctcgaagagaacgtggaagttgagatctggaccaaggagggcgaacgcaagaaactgaagcccagatggcttgacgcccggatttattccgatcctctggctctcaaagagtttaaggagttcgccgctgggcgcaaatctctgacactgaatctcatcaccgagatgggcagacttcccacgttcatgacccagaagacacgggacgccctggataacctggcggtgctccacaccgccgaagctggaggcagagcctacaatcatgctctgagcgagcttccggagacactggaaaccctcctgctgctcacacttctggccaccgtcacagggggaatttttctgttcctcatgtccggcaaggggatcggaaaaatgacactgggcatgtgctgcattatcaccgcctctatccttctgtggtatgctcagattcagcctcactggatcgcggccagcattatcctcgagtttttcctgattgtgctgctcatccccgaacccgagaagcaacgcacccctcaggacaaccagcttacatacgtcgtgatcgctattctgaccgttgtggccgccacaatggctaatgaaatgggctttctggagaaaacgaagaaagacctcgggctgggatccatcgccacccagcaaccggagagcaacattcttgatatcgacctgcggcccgcgtctgcctggacactctacgctgtggccaccacattcgtcacccctatgctgagacattccattgaaaatagctccgttaacgtgtctctgacggctatcgccaatcaggcgaccgtgctcatgggccttgggaagggatggcccctgagcaagatggatattggcgtccctctgctcgccatcgggtgttattcccaggtgaaccccatcacactgaccgctgcccttctgctcctggttgctcactacgccattatcggacctggcctgcaggctaaagccacacgcgaggcgcaaaagcgggccgctgccggcattatgaaaaatccgaccgtggacgggatcacggtcattgatctcgaccccatcccttatgatcccaagtttgaaaaacagcttggacaggtgatgctgctgatcctctgcgtcacacaagtgctgatgatgagaaccacatgggctctttgtgaggccctgaccctcgccaccggccctatttctacactgtgggaagggaaccccggacggttctggaatacgaccatcgcggttagcatggctaacatttttcgcggctcctacctggccggggctggactccttttcagcatcatgaagaatacaaccaacacaagacggggcaccggcaacatgggggagacgctgggagagaaatggaagtctcgcctgaatgccctcggcaagtccgaatttcagatttataaaaagagcgggatccaggaggtggacagaacactggccaaagaaggaatcaagcggggcgagaccgatcaccatgctgtctctcgcgggtccgccaaacttagatggttcgtggagcggaacatggttaccccggaaggaaaggtggtcgacctgggctgcggccgcgggggatggagctactattgtggcgggctcaagaatgtgagagaggtgaaaggactgacaaagggcgggcctggacacgaagaacccattcccatgtctacctacggctggaacctggttcggctccagagcggcgtcgatgtgtttttcatccctcccgaaaaatgcgacacacttctgtgtgatattggggagtcctctcctaatccgacggtggaggcgggaagaaccctgcgcgtcctcaacctggttgaaaattggcttaacaataacacacaattctgcatcaaggtgctgaatccctacatgcctagcgtgattgagaaaatggaagccctccagcggaagtatggcggggctctggtcagaaaccccctgtcccgcaatagcacccatgagatgtactgggtgtccaacgcctctggaaatatcgttagctccgtgaacatgatctctcggatgctcattaacagatttacaatgcgccacaagaaagctacctatgaacctgacgtcgaccttggcagcgggacgcggaatatcggaattgagtccgagatccccaacctggatattatcggcaagagaattgagaagatcaagcaggagcatgaaacctcttggcactacgaccaggatcacccgtataaaacatgggcctaccatggcagctatgagaccaagcaaacagggtccgcgagctctatggtgaatggagttgtgcgcctgctcaccaagccttgggacgtcctgcccacagtgacccagatggccatgacggatacaacccctttcggccagcagcgggtgtttaaagaaaaggtcgacaccagaacacaagagcccaaagaggggacgaagaaacttatgaagatcaccgctgaatggctgtggaaagagctcggaaagaagaaaacacctcgcatgtgtacccgggaagagttcacaagaaaggttcgctccaacgccgctctgggcgccatttttaccgatgagaataaatggaaaagcgctagagaagccgtggaggactctcggttctgggaactggtggataaagagcgcaacctccacctggaagggaagtgcgagacatgtgtctacaatatgatgggaaagagagagaagaaacttggcgaatttggcaaagcgaaagggtcccgggccatctggtacatgtggctgggagctagattcctcgagtttgaagccctgggcttccttaacgaggaccattggtttagccgggaaaattctctgtccggggtggagggagagggcctccacaaactggggtatattctgcgcgatgttagcaagaaggaaggcggagctatgtacgccgacgacaccgccggctgggatacgagaatcaccctcgaggacctgaaaaacgaagagatggtgacaaatcacatggaaggggagcataagaaacttgcggaggctattttcaagctgacctatcagaacaaagtcgtgcgggttcagcgccccacaccgagaggaaccgtgatggatatcatctcccggcgcgaccaaagaggcagcgggcaggtcggaacgtacggcctcaatacatttaccaacatggaagcccagctgattcggcagatggagggggaaggcgtgttcaagaatatccaacaccttacagttaccgaggaggtggccgtccagaactggctggctcgcgtgggaagagaacggctctctcgcatggccattagcggcgatgactgcgtcgtgaagcctctggatgacagattcgctaacgccctgacggcgctcaatgatatggggaaaatccggaaggacattcagcagtgggagccctccaaaggatggaacgattggacccaagttcccttttgctctcatcacttccatgaactgatcatgaaggacggccgcatccttgtggtcccttgtagaaatcaggatgagctgattgggcgggccagaatcagccagggagctggctggtccctccgcgaaacagcctgcctggggaaatcttatgctcagatgtggagccttatgtactttcaccggagagacctgcgcctcgccgcgaacgccatttgttccgctgtgccgtctcactgggtgcccaccagccggacaacctggtccatccatgccaagcacgagtggatgacaaccgaggacatgctgacggtttggaatagagtgtggattcgcgaaaacccttggatggaggataagacacccgtcgaaagctgggaggaaatcccttatctgggcaaacgggaggaccaatggtgcggatctctcattggcctgacctccagagctacctgggccaagaatatccaggctgccatcaaccaggtgcgcagccttattgggaatgaggaatacacagattacatgccctctatgaaacggttcagacgcgaggaagaggaagcgggagttctgtggtga

SEQ ID NO: 20159 - RNA, 9876 nt, synthetic construct
  misc_feature 1..9876: note = derived and/or modified CDS sequence (opt5) from DENV-2__JX966380__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacaaaagacggcaccaatatgtgcacactgatggccatggatctcggggagctgtgtgaagacaccatcacatacaagtgcccgttccttaaacaaaacgagcccgaagatattgactgttggtgcaattctaccagcacgtgggttacctatggaacatgtaccacaaccggcgagcaccgcagagagaagcggtccgtggcgctggtgcctcatgtcgggatgggactcgaaacgcgcacagagacctggatgtctagcgaaggcgcttggaagcacgcccagagaatcgagacatggatcctgcggcatcccggctttaccattatggccgctatcctggcctacaccattgggacaacgcacttccagcgcgtgctcatctttattctgcttaccgctatcgccccttccatgacaatgagatgcattggaatctctaaccgggatttcgttgagggcgtgagcgggggatcctgggtcgacatcgtgctggaacacggcagctgtgttaccacaatggcgaaaaataagcccaccctcgattttgagctgattaaaacggaagccaagcagcctgctacacttcgcaaatattgcatcgaggccaagctgaccaacaccacaaccgactctagatgtccgacacaaggggaacccacgctcaatgaggagcaggataagcggttcgtgtgcaaacattccatggtcgaccgcggatggggcaacggctgtgggctgtttggaaagggcgggattgtgacctgcgctatgttcacatgcaaaaagaatatggaaggaaaaatcgtgcagcctgagaacctggaatacaccgtcgttattacaccccacagcggcgaggaacatgccgtggggaatgataccggaaagcacggcaaagaggtgaagatcacgcctcagtcttccatcaccgaggcggaactcacaggctatgggaccgtcacaatggagtgtagccccagaaccggactggactttaacgaaatggtgcttctgcaaatgaaggataaagcctggctcgttcaccggcagtggttcctggaccttccgctgccttggctccccggcgctgacacgcaggggtctaattggattcagaaggagacactggtgacctttaaaaaccctcatgccaagaaacaagatgtcgtggttctgggatcccaggaaggcgctatgcacacagccctcaccggggccaccgagatccagatgagctccggcaatctgcttttcacaggacatctgaagtgccgcctcagaatggacaagctgcaacttaaaggcatgtcttacagcatgtgtacggggaagttcaaaattgtgaaggagatcgctgaaacccagcacggaacaattgtcatccgggtgcagtatgagggcgatgggtccccctgcaaaatcccctttgaaattatggacctggagaagagacatgtcctcggacgcctgatcaccgtgaaccctattgttacagagaaggatagcccggtgaacatcgaagcggagccccctttcggcgactcttacattatcattggggtcgaacccggccagctgaaactcgattggtttaagaaaggatccagcatcggccaaatgttcgagaccacgatgcggggggccaagagaatggctatcctgggagacacagcctgggattttggctctcttgggggagtgttcaccagcattggcaaagccctgcaccaggtttttggggctatctacggcgccgcgttctccggagtgtcttggaccatgaagattctcatcggcgtcattatcacatggatcgggatgaatagccgctccaccagcctgtctgtgtccctggtgcttgttggaattgtcacactctatctgggcgtgatggtgcaggctgacagcgggtgtgtcgtgtcttggaagaacaaagaactgaagtgcggatccggcatctttgttacggataatgtgcacacctggacagagcagtacaaattccaacctgagagcccctccaagctcgcctctgccattcagaaagctcatgaagaggggatctgtggcattcggagcgtcaccagactggaaaaccttatgtggaagcagatcacatccgagctgaatcacatcctctctgaaaacgaggtgaaactgaccattatgacgggagacatcaagggcattatgcaggttgggaagcgcagcctgcggccgcaacctaccgagcttagatattcctggaaaacatggggaaaggccaaaaccctcagcacagaactgcataatcagacctttctgatcgacggccccgagacagctgaatgccctaacaccaatcgcgcctggaactctctcgaggtggaagattacgggttcggagtctttacgacaaatatttggctgcggcttagagagaagcaggacgtgttctgtgattccaaactgatgagcgcggccatcaaggacaaccgcgctgttcacgccgatatgggctattggatcgagtctgctctcaatgacacctggaagattgaaaaagcctccttcatcgaggtgaagagctgccactggcccaaatctcataccctgtggagcaacggcgtcctggaatccgagatggtgattcctaagaattttgcggggcccgtgagccagcacaacaaccggccgggataccatacacaaaccgccggcccttggcaccttgggaaactcgagatggatttcgacttttgtgaaggaacgacagtcgttgtgaccgaggattgcggcaatagagggccctctctgcggacaaccacagcttccggaaagctgatcaccgaatggtgctgtcgcagctgcacgctcccccctctgagatatcggggcgaggacggctgttggtacgggatggaaattagaccgcttaaggagaaagaggaaaacctggtgtcctctctcgtcaccgccggacatggccagatcgataatttcagcctggggattctgggaatggctctttttctcgaggaaatgctgcgcacacgggtgggcaccaagcacgccatcctgctcgttgccgtgtccttcgtcacactgatcaccgggaacatgtcttttagagaccttggacgcgtgatggttatggtgggcgctacgatgacagatgacattggcatgggggtcacctacctggcgctcctggccgctttcaaagtgagacccacatttaccgccggactgcttctgcggaagctcaccagcaaagagctgatgatgacaacgatcggcattgttctcctgtcccagtctagcatccctgaaaccattcttgagctgacagacgccctcgctctggggatgatggtgctgaagatggtccgcaatatggagaagtatcaacttgccgtgaccatcatggcgatcctgtgcgtgcccaacgctgtcattctccagaatgcctggaaagtttcctgtacaatcctggccgtggtgagcgtctctcctctcctgcttacctccagccagcagaaggctgattggattcccctggccctcacgatcaaaggactgaaccctacagcgattttcctgaccaccctttctagaacatccaagaaacggagctggcccctgaatgaagctatcatggccgtgggcatggtttctatcctcgcctccagcctgctcaagaacgacattccgatgaccgggcctctggtggctggaggccttctgacagtctgctacgtgctgacgggccgctccgccgatctcgagctggaaagagctaccgacgttaaatgggatgaccaagccgagatcagcgggtctagccccattctttccatcacaatttctgaagatggaagcatgtccatcaagaatgaggaggaagagcagaccctgacaattctcatccggaccggcctgctcgtgatctctgggctgtttcctgtcagcattcccatcacggcggccgcttggtatctttgggaagtgaagaaacagcgcgccggagtcctgtgggacgtgccgtcccctccccctgttggcaaggctgagctggaggatggggcctacagaattaaacagaagggaatcctcggctattctcaaattggcgccggggtgtacaaagaaggaaccttccacacaatgtggcatgtcacccggggcgctgtgctgatgcacaaggggaagcgcatcgagcccagctgggcggacgttaaaaaggatcttatctcctatggaggcgggtggaaactggaaggagagtggaaggaaggcgaggaggtgcaggtcctcgccctggaacccggcaaaaaccctagagctgtgcagacaaagccggggctctttcggaccaatacaggaacgattggcgccgtgagcctggacttctctcccgggacctccggaagccctatcgttgataagaaaggcaaggtcgtggggctttacggaaacggcgtggtcacaagatctggcgcctacgtgtccgctattgcccagaccgagaaaagcatcgaagacaatcccgagattgaagacgatatcttccgcaagcggagactgaccatcatggacctgcatcctggggcgggaaaaacaaagcgctatctccccgctattgttcgggaggccatcaagagaggcctgcgcacgcttattctggcccctacccgggtggtcgctgccgagatggaagaggcgctcagagggctgccgatccgctaccaaacacccgctattcgggccgaacacaccggaagagagatcgtggatctcatgtgtcatgccacatttaccatgcggctgctttcccctattcgcgttcccaactataacctgatcatcatggacgaagctcacttcacggatcctgcctctattgctgccagaggctacatcagcacacgggtggagatgggggaggcggccggcatttttatgaccgctacccccccgggatcccgcgaccctttcccccagagcaatgcccccatcatggatgaagagagagaaattcctgagcggtcttggaactccggccacgagtgggtcacagactttaaagggaagaccgtgtggttcgttcccagcatcaaaacaggaaatgatatcgctgcctgcctgagaaagaacggcaaacgcgtgattcagctctctcggaagacctttgacagcgaatatgtcaagacgagaacaaatgattgggacttcgtggtgaccacagacatctccgagatgggggccaactttaaagctgaacgcgtcattgatcctcggagatgtatgaagccggttatcctgaccgacggagaggaacgcgtgattcttgcgggccccatgcctgtgacgcattctagcgccgctcaacggagagggcgcatcggcagaaatccccggaacgagaatgatcagtacatctatatgggagagcctctggaaaacgacgaggattgcgcccactggaaagaagccaagatgctcctggacaatattaacacccccgagggcatcattccgtccatgttcgaacctgagcgcgagaaagtcgatgctatcgacggggaatacagactgcggggagaggcccgcaagacatttgtggatctcatgagacggggcgaccttcccgtttggctggcgtacaaagtggctgccgaagggattaattatgccgatagacgctggtgtttcgacggaacccggaacaatcagatcctggaggaaaacgtcgaggtggagatttggacaaaggaaggcgagagaaagaaactcaagcctcgctggctggatgctcggatctactctgacccccttgccctgaaagaattcaaggagtttgcggccgggagaaaaagcctcaccctgaacctgatcacagagatgggccggctccctaccttcatgacgcagaaggctcgcgacgcccttgataatctggctgttctgcatacagccgaagctggaggcaaggcctataaccacgcgctctccgagctgcccgaaacccttgagaccctgctcctgctgacactccttgccaccgtgacagggggaatttttctgttcctgatgagcggcagagggatcggaaaaatgacgctcggcatgtgctgcattatcaccgcttctattctgctttggtacgcccaaatccagccgcactggatcgctgcctccattatcctggaatttttcctcattgtcctgctgatccctgagcccgagaagcagcggacaccccaggacaatcaactcacctatgtgattatcgccatccttacagtcgtggctgcgaccatggccaacgaaatgggctttctggagaaaacgaagaaagatctggggctcggaaatattgctacccagcagcctgaaagcaacatcctggacattgatcttcgcccggcctccgcctggacactgtacgctgttgccaccacattcatcacccccatgctcagacattctattgagaatagctccgtgaacgtgtctctgacggcgatcgccaatcaggctacagtcctgatgggcctcgggaagggatggcctcttagcaagatggacattggcgttcccctgctggccatcgggtgttattcccaagtgaaccctatcaccctcacagctgccctgcttctgctcgtggcgcactacgccattatcggacccggcctgcaggctaaagccacccgggaagctcagaagcgcgccgctgccggcattatgaaaaatcctaccgtcgatgggatcacagtgattgacctggatccgatcccctacgaccctaagtttgagaaacagctcggacaagttatgcttctggtgctgtgcgtcacgcaggtgctcatgatgagaaccacatgggcgctgtgtgaggcccttaccctggctacaggccccgtcagcaccctctgggaagggaaccctggacggttctggaatacgacaatcgccgtgtctatggctaacatttttcgcggctcctatctggccggggccggactgctcttcagcatcatgaagaataccacctctacaagacggggcaccggcaacattggggagacacttggagaaaagtggaaatccagactgaatgcgctgggcaagagcgagtttcagatctacaaaaagtctgggattcaagaagttgatcgcacgctcgctaaagagggaatcaagcggggcgagaccgaccatcacgccgtgagcagagggtccgctaaactgcgctggttcgtcgaacggaaccttgtgacacccgagggaaaggttgtggatctgggctgcggcagagggggatggtcttattactgtggcgggctcaagaacgtccgcgaagtgaaaggactgaccaagggcgggccgggacatgaggagcctatccccatgagcacatatggctggaatctggtgcggctccagtccggcgttgacgtcttctttgtgccccctgaaaaatgcgacacccttctgtgtgatattggggagagctcccccaaccctacggtggaagccggaagaaccctgcgcgtcctcaatctggttgagaactggcttaataacaatacacagttctgcgtgaaggtgctgaacccgtacatgccctctgtcatcgaacggatggagaccctccagagaaaatatggcggggccctggtgcgcaatcctctgagccggaactccacacacgagatgtactgggtttctaatgctagcggaaacattgtgtcctctgtcaatatgatcagcagaatgctcattaaccgctttaccatgagacacaagaaggccacatacgaacccgacgtggatcttggctccgggacccggaatatcggaatcgagagcgaaacgcctaacctggacattatcggcaaacgcattgagaagatcaaacaagaacatgagacatcttggcactatgatcaggaccatccctacaagacctgggcgtatcacggctcctacgagaccaaacagacagggagcgcctcttccatggttaacggagtggtcagactgctcacgaagccgtgggatgtggtgcctatggtcacccagatggctatgacagacaccacacccttcggccaacagcgggtttttaaggaaaaagtggataccagaacacaggagcctaaggaagggaccaaaaagctgatgaaaattacggccgagtggctttggaaggaactgggaaagaaaaagaccccccggatgtgtacacgcgaggagttcaccaaaaaggtgagaagcaatgctgccctcggcgcgatctttacagacgaaaacaaatggaagtctgcccgggaggctgtcgaagattcccgcttctgggagctggtggacaaagagagaaatctgcacctcgaagggaagtgcgagacctgtgtttataacatgatgggaaagcgggaaaaaaagctgggcgagtttggcaaagccaaggggagccgcgctatttggtacatgtggcttggagccagattcctggaatttgaggctctcggcttcctgaatgaggaccattggttttcccgggaaaacagcctttctggggtggagggagaaggcctgcacaaactcgggtatatcctgcgcgaggtcagcaagaaggaaggcggagccatgtacgcggatgacacggccggctgggatacaagaatcaccattgaggacctgaaaaatgaggaaatgatcacaaaccatatggctggggagcacaagaaactcgccgaagctattttcaagctgacctaccagaataaagtggttcgggtgcaacgccctacgcccagaggaaccgtcatggatatcatttcccggcgcgaccagagaggctctgggcaggtgggaacatatggccttaacaccttcacaaatatggaggcccaactgatccggcagatggaaggggagggcatctttaagaacattcagcatctcaccgccagcgaggaaatcgcggttcaggattggctggtgagagtcggacgcgagcggctttccagaatggctatttctggcgacgattgcgtggtcaagccgctggacgatcgcttcgcccgggccctcacagctctgaatgacatggggaaagtgagaaaggatatccaacagtgggaacctagccgcggatggaacgactggacccaggttcccttttgctcccaccacttccatgagctgattatgaaagacggccggacgctcgtggtcccctgtagaaatcaggatgagctgatcgggcgcgcccggatctctcaaggagctggctggagccttagagaaacagcctgcctggggaagtcctacgcgcagatgtggagcctcatgtattttcaccgccgggacctgagacttgccgctaacgccatttgttctgctgtgccttcccattgggtgccgaccagccggaccacatggtctatccacgcctcccacgagtggatgaccacagaagatatgctgacggtttggaacaaagtgtggattctcgagaatccctggatggaagacaagacccctgtcgagagctgggaggaaatcccctacctgggcaagagagaggatcagtggtgcggatccctgattggcctcacatctcgcgcgacctgggccaaaaacatccagacagctattaatcaagtgcggagcctgatcgggaacgaagagtataccgactacatgccttccatgaagagattccgcagagaagaggaggaagccggagttctttggtga

SEQ ID NO: 20160 - RNA, 9876 nt, synthetic construct
  misc_feature 1..9876: note = derived and/or modified CDS sequence (opt5) from DENV-2__JX966379__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacaaaagacggcaccaatatgtgcacactgatggccatggatctcggggagctgtgtgaagacaccatcacatacaagtgcccgttccttaaacaaaacgagcccgaagatattgactgttggtgcaattctaccagcacgtgggttacctatggaacatgtaccacaaccggcgagcaccgcagagggaagcggtccgtggcgctggtgcctcatgtcggaatgggcctcgagacgcgcacagaaacctggatgtctagcgagggcgcttggaagcacgcccagagaatcgaaacatggatcctgcggcatcccgggtttaccattatggccgctatcctggcctacaccattggaacaacgcacttccagcgcgtgctcatctttattctgcttaccgctatcgccccttccatgacaatgagatgcattggcatctctaaccgggatttcgttgagggggtgagcggaggctcctgggtcgacatcgtgctggagcacgggagctgtgttaccacaatggcgaaaaataagcccaccctcgattttgaactgattaaaacggaggccaagcagcctgcttctcttcgcaaatattgcatcgaagccaagctgacaaacaccaccacagactccagatgtccgacccaaggagagcccacactcaatgaagagcaggataagcggttcgtgtgcaaacatagcatggtcgaccgcggctggggcaacgggtgtggactgtttggcaaggggggaattgtgacgtgcgctatgttcacctgcaaaaagaatatggagggcaaaatcgtgcagcctgaaaacctggagtacacagtcgttattaccccccactctggggaagagcatgccgtgggaaatgatacaggcaagcacggcaaagaagtgaagatcacccctcagtccagcatcacggaggcggagctcaccgggtatggaacagtcaccatggaatgttctcccagaacaggcctggactttaacgagatggtgcttctgcaaatggaagataaggcctggctcgttcaccggcagtggttcctggaccttccgctgccttggctccccggggctgacacccagggatccaattggattcagaaagagacgctggtgacatttaagaaccctcatgccaaaaagcaagatgtcgtggttctgggcagccaggaaggggctatgcacaccgccctcacaggcgccaccgagatccagatgtcctctggaaatctgcttttcaccggccatctgaaatgccgcctcagaatggacaagctgcaacttaaggggatgagctactccatgtgtacaggaaaattcaagattgtgaaagagatcgctgaaacgcagcacggcaccattgtcatccgggtgcagtatgagggggatggaagcccctgcaagatcccctttgaaattatggacctggagaaaagacatgtcctcggccgcctgatcacagtgaaccctattgttaccgagaaggattctccggtgaacatcgaagcggagccccctttcggggactcctacattatcattggcgtcgaacccggacagctgaagctcgattggtttaaaaagggcagctctatcgggcaaatgttcgagacaaccatgcggggagccaaaagaatggctatcctgggcgacacggcctgggattttgggagccttggaggcgtgttcacatccattgggaaggccctgcaccaggtttttggcgctatctacggagccgcgttctctggcgtgagctggaccatgaaaattctcatcggggtcattatcacctggatcggaatgaattcccgcagcacatctctgtccgtgagcctggtgcttgttggcattgtcaccctctatctgggggtgatggtgcaggctgactctggatgtgtcgtgtcctggaagaacaaggaactgaaatgcggcagcgggatctttgttacagataatgtgcacacgtggaccgagcagtacaagttccaacctgagtccccctctaaactcgccagcgccattcagaaggctcatgaagagggcatctgtggaattcggtccgtcacaagactggaaaaccttatgtggaaacagatcaccccggagctgaatcacatcctctctgaaaacgaggtgaagctgacaattatgaccggcgacatcaaagggattatgcaggttggaaagcgcagcctgcggcctcaacccacggagcttagatattcctggaagacctggggcaaagccaagatgctcagcacagaactgcataatcagacctttctgatcgacgggcctgagacagctgaatgccccaacaccaatcgcgcctggaactctctcgaggtggaagattacggattcggcgtctttacaaccaatatttggctgcggcttagagagaaacaggacgtgttctgtgattccaagctgatgagcgcggccatcaaagacaaccgcgctgttcacgccgatatgggctattggatcgagtctgctctcaatgacacgtggaagattgaaaaggcctccttcatcgaggtgaaaagctgccactggcctaagtctcatacactgtggagcaacggggtcctggaatccgagatggtgattcccaaaaattacgcgggaccggtgagccagcacaacaaccggcctggctatcatacccaaaccgccgggccctggcaccttggaaagctcgagatggattttgacttctgtgaaggcacaaccgtcgttgtgacggaggaatgcgggaatagaggaccctctctgcggacaaccacagcttccggcaaactgatcaccgagtggtgctgtcgcagctgcacactccctccgctgagataccggggcgaagatgggtgttggtacggaatggagattagaccccttaaggagaaggaagagaacctggtgtcctctctcgtcaccgccggccatgggcagatcgacaattttagcctgggaattctgggcatggctcttttcctcgaagagatgctgcgctcccgggtggggacgaaacacgccatcctgctcgttgccgtgtcttttgtcaccctgatcacaggaaacatgagcttcagagatcttggccgcgtgatggttatggtgggcgctaccatgacagacgatattgggatgggagtcacctatctggcgctcctggccgcttacaaggtgagacctacgtttgccgccggcctgcttctgcggaaactcacatccaaggaactgatgatgaccacaatcgggattgttctcctgtctcagagctccatccccgagaccattcttgagctgaccgacgctctcgccctgggaatgatggtgctgaaaatggtccgcaatatggaaaagtatcaacttgcggtgacaatcatggctatcctgtgcgtgcctaacgccgtcattctccagaatgcctggaaggttagctgtacgaccctggctgtggtgtctgtctcccccctcctgcttacaagctctcagcagaaagccgactggatccctctggcgctcaccattaagggcctgaaccccacagctatcttcctgaccacgctttccagaacaagcaaaaagcggtcttggccgctgaatgaggccattatggccgtggggatggtttccatcctcgctagctccctgctcaaaaacgatatccctatgaccggacccctggtggccggcggccttctgaccgtctgctacgtgctgacagggcgcagcgctgacctcgaactggagagagccaccgatgttaagtgggacgatcaagcggaaatttctggaagctcccctatcctttctattacaatcagcgaggacggctccatgtctattaaaaatgaggaagaggaacagacgctgaccatcctcattcggacagggctgctcgtgatcagcggactgtttcccgtctccaccccgatcacagccgctgcctggtatctttgggaggtgaagaagcagcgcgctggcgtcctgtgggatgtgccttctccccctcccgttgggaaagccgagctggaagacggagcctacagaattaagcagaaaggcatcctcggctatagccaaattggggctggagtgtacaaggagggcaccttccacacgatgtggcatgtcacccggggggcggtgctgatgcacaaaggaaagcgcatcgaaccctcctgggccgatgttaagaaagaccttattagctacggcgggggatggaagctggagggcgaatggaaagagggcgaggaagtgcaggtcctcgctctggagcctgggaagaacccgagagccgtgcagacaaaacccggactctttcggaccaatacaggcaccatcggggccgtgtctctggatttctcccctggaacaagcggctctcccatcgttgacaagaaggggaaagtcgtgggactttatggcaacggcgtggtcacgagatccggggcttacgtgagcgccattgcgcagaccgaaaagtccatcgaggataatcctgaaattgaggacgacatctttcgcaaacggagactgacaattatggatctgcatcccggagctggcaagaccaaacgctatctccctgccatcgttcgggaggccatcaagagagggctgcgcacccttattctggctccgacacgggtggtcgccgcggaaatggaggaagctctcagaggactgcccatccgctaccaaacgcctgccattcgggccgagcacaccggcagagaaatcgtggacctcatgtgtcatgctacattcaccatgcggctgctttctcccattcgcgttcctaactataacctgatcattatggatgaggcccacttcacagaccccgctagcatcgccgcgagagggtacatctccacccgggtggagatgggcgaagccgctggaatttttatgacggccacaccgcctggcagccgcgatcccttcccccagtctaatgctcctatcatggacgaggaaagagagattcccgagcggtcctggaacagcgggcacgaatgggtcaccgattttaagggaaaaaccgtgtggttcgttccttctatcaaggccggcaatgacattgccacatgcctgagaaaaaacgggaagcgcgtgatccagctcagccggaaaacctttgattccgagtatgtcaagacaagaaccaatgactgggatttcgtggtgacgacagacatctctgaaatgggagctaactttaaggcggagcgcgtcattgacccgcggagatgtatgaaacccgttatcctgaccgatggcgaagagcgcgtgattcttgccgggcctatgcccgtgacacatagctccgctgcccaacggagaggccgcatcggaagaaatcctcggaacgagaatgaccagtacatttacatgggcgaacccctggagaacgatgaagactgcgcccactggaaggaggctaaaatgctcctggataatatcaacaccccggaagggatcattccttctatgttcgagcccgagcgcgaaaaggtcgacgccatcgatggagagtatagactgcggggcgaagcgcgcaaaacgtttgtggacctcatgagacggggggatcttcctgtttggctggcttacaaggtggccagcgagggaattaattatgccgacagacgctggtgtttcgatggcacccggaacaatcagatcctggaagagaacgtcgaggtggaaatttggacaaaagagggggaaagaaagaagctcaaaccccgctggctggacgctcggatctactccgatcctcttgccctgaaggagtttaaagagttcgcggccggcagaaagagcctcaccctgaacctgattacagaaatgggacggctccccaccttcatgacacagaaagctcgcgacgcccttgacaatctggctgttctgcataccgccgaggctggcgggaaggcctataaccacgcgctctctgaactgccggagacgcttgaaacactgctcctgctgaccctccttgccaccgtgacaggaggcatctttctgttcctgatgtccgggagaggaatcggcaagatgaccctcggcatgtgctgcattatcacagctagcattctgctttggtacgcccaaatccagcctcactggattgctgcctccatcatcctggagtttttcctcattgtcctgctgatccccgagcccgaaaaacagcggacgcctcaggataatcaactcacctatgtgattatcgccattcttacagtcgtggctgcgaccatggccaacgagatggggtttctggaaaagacaaaaaaggacctgggactcggccatatcgctacccagcagccggagtctaatatcctggatattgaccttcgccccgccagcgcctggacgctgtacgctgttgccaccacattcatcacccctatgctcagacactccattgaaaactctagcgtgaatgtgtccctgacagcgatcgccaaccaggctaccgtcctgatggggctcggaaaaggctggccccttagcaagatggatattggggttcctctgctggccatcggatgttactctcaagtgaatcccattacgctcacagctgccctgcttctgctcgtggcgcattatgccatcatcggccctggcctgcaggctaaggccacccgggaggctcagaaacgcgccgctgccgggattatgaagaacccgacagtcgacggaatcaccgtgattgatctggaccccatcccttacgatcccaaatttgagaagcagctcggccaagttatgcttctggtgctgtgcgtcacccaggtgctcatgatgagaacaacgtgggcgctgtgtgaagcccttaccctggctacagggcctgtctccaccctctgggagggaaatcccggccggttctggaacacaaccattgccgtgagcatggctaatatctttcgcgggtcttatctggccggagccggcctgctcttctccatcatgaaaaacacgacaagcaccagacggggcaccgggaatattggagaaacacttggcgagaagtggaagtctagactgaacgcgctggggaaaagcgaatttcagatctacaagaaatccggaattcaagaggttgaccgcaccctcgctaaggagggcatcaaacggggggaaacagatcaccatgccgtgtctagaggaagcgctaagctgcgctggttcgtcgagcggaatcttgtgacgccggaaggcaaagttgtggacctgggctgcgggagaggaggctggtcctattactgtgggggactcaagaacgtccgcgaggtgaagggcctgaccaaagggggacctggccacgaggaacccattcccatgagcacatatggctggaacctggtgcggctccagtccggggttgatgtctttttcgtgcctcccgagaagtgcgacacccttctgtgtgacatcggagaatctagccctaatccgacagtggaggccggcagaaccctgcgcgtcctcaacctggttgaaaattggcttaacgataatacgcagttctgcgtgaaagtgctgaacccctacatgccttccgtcatcgagcggatggagaccctccagagaaagtacgggggagccctggtgcgcaatcccctgtctcggaacagcacacacgaaatgtattgggtttccaatgcttctggcaacgtggtcagctccgtgaatatgattagcagaatgctcatcaaccgctttaccatgagacataaaaaggccacatacgagcctgacgttgatcttgggtctggaacccggaatattggcatcgaatccgagacacccaacctggacattatcggcaagcgcatcgaaaaaattaagcaagagcacgaggcgagctggcattatgatcaggaccacccgtacaaaacctgggcctatcacgggtcttacgaaacgaagcagacaggatccgctagctctatggtgaatggcgtcgtgagactgctcaccaaaccttgggatgtggtccccatggttacccagatggccatgacagacacgacccctttcgggcaacagcgggtgtttaaggagaaggtggatacaagaacccaggaacccaaagagggaacaaagaaactgatgaagatcaccgctgaatggctttggaaagagctgggcaagaagaaaacacctcggatgtgtacccgcgaggaattcacgaagaaagtcagatccaacgccgcgctcggggccatttttaccgacgagaacaagtggaaaagcgctcgggaagccgtggaggataatcgcttctgggagctggttgacaaggaaagaaacctgcatctcgagggaaaatgcgaaacatgtgtgtataatatgatgggcaagcgggagaagaaactgggcgaatttgggaaggctcgcggatccagagccatctggtacatgtggcttggcgctcggttcctggagtttgaggccctcgggttcctgaacgaagaccactggtttagccgcgagaattctcttagcggagtcgaaggcgaggggctgcataaactcggctacattctgagagaagtgtccaagaaagagggaggcgcgatgtatgccgatgacaccgctgggtgggatacacggatcaccattgaggacctgaagaacgaagagatgatcacgaatcacatggccggagaacataagaaactcgctgaggccatcttcaagctgacataccagaacaaagttgtgcgcgtccaaagacccaccccgcggggcacagtgatggatattatctctcgcagagaccagcgggggagcggacaggttgtgacctatggccttaatacgtttaccaacatggaagcccaactgattagacagatggagggggagggcatcttcaagtccattcagcacctcacagcgtctgaagagatcgctgtccaggattggctggcccgcgtgggacgggaaagacttagccgcatggccatctccggcgacgattgcgtcgtgaaacctctggacgatcggttcgctagagccctcaccgctctgaatgacatggggaaggttcgcaaggatattcaacagtgggagccctctcggggatggaacgactggacacaggtgcccttttgcagccaccatttccacgagctgatcatgaaagacggcagaaccctcgtcgtgccttgtcgcaatcaggatgaactgattgggcgggccagaatctcccaaggagcgggctggagccttcgcgagacagcctgcctggggaagtcttacgctcagatgtggtccctcatgtattttcatcggagagacctgcggcttgccgctaacgccatttgtagcgcggtgccgtctcactgggttcccacctccagaacgacatggagcatccacgcctcccatgaatggatgaccaccgaggatatgctgacagtgtggaatcgcgtctggatcctcgaaaacccttggatggaggacaaaacccccgtggagtcttgggaagagattccttacctgggcaagcgggaagatcagtggtgcggaagcctgatcggcctcacatccagagctacgtgggccaaaaacattcagaccgctatcaatcaagttcgcagcctgattgggaacgaggaatatacagactacatgccctctatgaagagattccggcgcgaggaggaagaggccggagtgctttggtga

SEQ ID NO: 20161 - RNA, 9876 nt, synthetic construct
  misc_feature 1..9876: note = derived and/or modified CDS sequence (opt5) from DENV-2__KP012546__SS-prME
  source 1..9876: mol_type = other RNA
accgccggaatcattatcatgatgattcccacagtgatggctttccacctgacgaccagaaacggggagcctcatatgatcgtcagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaaacctggggaaaggcgaagatgctctctacggaactgcacaatcataccttcctgatcgatggccctgagacagccgaatgccccaacaccaatcgcgcttggaactccctcgaggttgaggactatgggtttggagtgttcacaaccaatatttggctgaaacttaaggaacggcaagatgtcttttgtgacagcaaactgatgtctgccgctatcaaggacaacagagccgtgcacgcggatatgggctactggattgagtccgccctcaacgacacatggaaaatcgaaaaggctagcttcatcgaggtgaagtcttgccactggcctaaaagccataccctgtggtccaatggcgtcctggagagcgaaatgattatccccaagaacttcgccgggccggtttctcagcacaattatcgccctggataccatacgcagacagctggcccctggcaccttgggcggctcgagatggattttgacttctgtgaaggaaccaccgtggtggtcacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtgaactctctcgttaccgccggacatggccagattgataattttagcctgggggtgctgggaatggctcttttcctcgaggaaatgctgcgcacacgggtcggcaccaagcacgcgatcctgctcgtggccgtttcctttgtgacgctgattaccgggaacatgtctttcagagaccttggacgcgtcatggtgatggttggcgctgccatgacagatgacatcggcatgggggtgacctacctggccctcctggctgcctttaaggtcagacctacattcgcggctggactgcttctgcggaaactcaccagcaaggagctgatgatgacgacaatcggcattgtgctcctgtcccaatctaccatgcccgagacaatccttgaactgaccgatgccctcgccctggggatgatggtgctgaaaattgtccgcaatatggagaagtatcagcttgctgttaccatcatggccattctgtgcgtgcctaacgcggtgatcctccagaatgcttggaaagtcagctgtacaacgctggccgtggtttccgtgagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtcggcatggtgagcatcctcgcgtcttccctgctcaaaaacgatattcctatgacagggcccctggttgccggaggccttctgaccgtgtgctacgtcctgaccggccgcagcgctgacctcgagctggaaagagccgctgacgtgcggtgggaggagcaggccgaaatctccgggagctctcctatccttagcattacaatctccgaggatggatctatgagcattaagaatgaagaggaggaacagaccctgacaatcctcattcgcacgggcctgctcgtcatctccgggctgttccccgtgtctattccgatcaccgccgctgcgtggtatctttgggaggttaaaaagcaaagagccggagtgctgtgggacgtcccttctccccctcccgtgggcaaagctgaactggaggatggggcctaccggatcaagcagaagggcattctcggctattcccagatcggcgccggggtttacaaagaaggaacatttcacaccatgtggcatgtgacacgcggcgctgtcctgatgcacaaggggaaaagaattgagccctcctgggccgacgtgaagaaagatcttatcagctacggaggcgggtggaagctggagggagaatggaaggagggcgaagaggtgcaggttctcgcgctggaacctggcaaaaacccgcgggctgtccaaaccaagcccggactcttcaaaacgaacaccggaacaattggcgccgtgtccctggactttagccctgggacctctggatcccccatcgtggataagaaaggcaaggtcgtggggctttatggaaatggcgttgtgacaagaagcggcacctacgtctctgccatcgctcagacagagaagtccattgaggacaaccctgaaatcgaggatgacattttccgcaaaaagcggctgacgatcatggatctgcatcccggggccggaaaaaccaagagatatctccctgcgattgtgcgcgaagctatcaaacggggcctgagaacacttatcctggccccgacccgcgttgtggccgctgagatggaagaggccctccgggggctgcccattagataccagacccctgctatccgcgccgagcacacaggacgggaaattgtcgacctcatgtgtcatgcgacgttcaccatgagactgcttagccccatccgggtgcctaattataacctgattatcatggatgaggcccactttacagaccccgcttccattgccgctcgcggctacatctctaccagagttgaaatgggggaggccgccggcatcttcatgacagctaccccgcctggaagccgggacccctttccccagtccaatgcgcctattatggatgaggaacgcgagatccccgaaagaagctggaactctggccacgagtgggtgacggacttcaaggggaagacagtctggtttgtgccttccattaaagccggaaatgatatcgctgcctgcctgcggaagaacggcaaaaaggtgattcaactcagcagaaaaaccttcgactctgaatatatcaagacccgcacaaatgattgggactttgtcgttaccacagatatcagcgagatgggggccaacttcaaggctgagcgggtgattgacccgagacgctgtatgaaacccgtgatcctgaccgatggagaagaacgggtcattcttgccggccctatgcccgtgacgcattcctctgcggctcagagacgcgggcgggttggcagaaatcctaagaacgaaaatgaccagtacatctacatgggagagcccctggaaaacgatgaggactgcgcccactggaaagaggccaagatgctcctggacaatattagcacaccggaaggcatcatcccttccatgtttgagcccgaacgcgagaaagtggatgctattgacggggaatatagactgcggggagaggcccgcaagaccttcgtcgatctcatgagacggggcgaccttcctgtgtggctggcgtaccgcgttgccgctgaggggatcaactatgccgatagacggtggtgttttgacggagtgaaaaacaatcaaattctggaagagaacgtcgaagtggagatctggacaaaggagggcgaaagaaagaaactcaagccccgctggctggatgctcggatttactctgaccctcttgccctgaaagagttcaaggagttcgctgccgggagaaaaagcctcaccctgaatctgatcacggagatgggccgcctccccacctttatgacacagaaggcgcggaacgcccttgataatctggctgtcctgcataccgccgaagctggaggcagagcctataaccacgccctctccgagctgccggagacacttgaaaccctgctcctgctgacactccttgctgcggtgaccgggggaattttcctgtttctgatgagcggcaaggggatcggaaaaatgacgctcggcatgtgctgcatcattacagcctctatcctgctttggtacgctcagattcagcctcactggatcgccgcctccattatcctggagttctttctcatcgttctgctgattcccgaacccgagaagcaacggacccctcaggacaatcagctcacctatgtggtgatcgctattcttacagtcgttgccgcgaccatggccaacgaaatgggcttcctggagaaaacaaagaaagattttgggctgggaagcacgaccacacagcaaccggagtccaatatcctcgacattgatctgcgccccgcttctgcctggaccctttacgctgtggccacaaccttcatcacgcctatgctgagacatagcatcgaaaactcctctgtgaatgtcagcctcaccgcgattgccaaccaggctacagtgctgatgggcctggggaagggatggcccctctccaagatggacatcggcgttcctcttctggccattgggtgttacagccaggtgaatcccatcaccctgacagctgccctcctgcttctggtcgctcactatgccattatcggacctggcctccaggcgaaagccacccgggaggctcaaaagcgcgccgctgccggcattatgaaaaacccgacggtggacgggatcacagtcatcgatctggaccccattccttacgatcccaagtttgaaaaacagctgggacaggtgatgctccttgttctgtgcgtgacccaggtcctgatgatgagaacaacctgggccctctgtgaggcgctgacccttgctacaggccctatctctacgctgtgggaagggaatcccggacggttctggaacaccacaattgccgtgtccatggctaatatctttcgcggcagctatctcgccggggccggactgctgttctctattatgaagaacaccgctaacacaagacggggcaccggcaatacgggggagacactcggagagaagtggaaaaaccgccttaatgccctgggcaagtccgaatttcaaatctacaaaaagagcgggatccaggaggttgacagaaccctggcgaaagaaggaattaagcggggcgagaccgatcatcacgccgtgtctagagggagcgctaaactccgctggttcgtcgagcggaacctggtgacaccggaaggaaaggtggttgaccttggctgcggcagagggggatggtcctattactgtggcgggctgaagaatgtcaaagaggtgaagggactcaccaaaggcgggcctggacatgaggaacccatccccatgtctacatatggctggaacctggtgcgcctgcagagcggcgtcgatgttttctttacgcctcccgaaaagtgcgacaccctcctttgtgatattggggagtccagccctaatccgacagtggaggccggacggaccctgagagtgctgaacctcgtcgaaaattggctgaacaataacacacaattctgcatcaaagtgcttaatccctacatgccttccgttattgagaagatggaagctctgcagcgcaagtacggcggggccctcgtgcggaaccccctgtctagaaatagcacccacgagatgtattgggtctccaacgcgtctggaaacatcgtgagctccgttaatatgatctctcgcatgctgattaaccggtttacgatgagacacaaaaaggccacctacgaacctgacgtggatctcggcagcgggacacgcaatatcggaattgagtccgagacccccaaccttgacatcattggcaaacggatcgaaaagatcaaacaggagcatgaaacaagctggcactatgatcaggaccatccgtacaagacctgggcttatcacggctcttacgagacaaagcaaaccgggtccgccagctctatggtcaatggagtggtgagactgctgacgaaaccttgggacgtcattcccatggttacacagatggctatgaccgataccacacctttcggccagcagcgcgtgtttaaggaaaaagtggacacgagaacccaagagcccaaggaggggaccaaaaagctcatgaagatcaccgccgaatggctgtggaaagagcttggaaagaaaaagacacctcggatgtgtacccgcgaagagttcacaagaaaagtccggtccaacgctgccctgggcgcgatttttaccgatgagaataagtggaaaagcgccagagaagctgtggaggactctgggttctgggaactcgttgataaggagcggaacctgcacctggaaggaaagtgcgagacgtgtgtgtataatatgatgggcaaacgcgagaagaaactcggcgaatttgggaaggccaaaggatccagagctatctggtacatgtggctgggcgcccggttccttgagtttgaagccctggggttcctcaacgaggaccattggtttagccgcgaaaattccctgagcggagtcgagggcgaggggcttcacaagctgggctacattctcagagatgtgtctaagaaagaaggaggcgcgatgtatgctgacgataccgccgggtgggacacacggatcaccctggaggatctgaagaacgaagagatggttacaaatcatatggaaggagagcacaaaaagctcgccgaggctattttcaaactgacctaccagaacaaggtggtccgcgtgcagagacccacgccgcggggcacagttatggacatcatcagccgcagagaccagcgggggtccggacaagtggtcacctatggccttaatacattcaccaacatggaagcccagctgattcgccagatggagggggaaggcgtgtttaagtctatccaacagctcacggtcaccgaggagattgctgtgaaaaactggctggttagagtgggacgggaacgccttagcagaatggccatctccggcgatgactgcgtcgtgaagcctctggatgaccggttcgcgtctgccctcacagctctgaatgatatggggaaagtgagaaaggacattcagcagtgggagcccagccgcggatggaacgattggacccaagttcccttttgctcccatcacttccacgaactgatcatgaaagacggccgggtgctcgtcgtgccttgtagaaatcaggatgagctgatcgggcgcgcccggatttctcagggagctggctggagccttagagaaacagcctgcctggggaagtcctacgcgcagatgtggaacctcatgtattttcatcgccgggacctgagacttgccgctaatgccatctgtagcgctgttccgtctcactgggtgcccacctcccgcacaacctggagcattcatgccacgcacgagtggatgacaaccgaggatatgctgaccgtctggaaccgggtgtggatccaagaaaatccttggatggaggacaagacacccgtcgaatcttgggaggaaattccttacctcggcaaaagagaggatcagtggtgcggatccctgatcggcctgaccagccgcgctacatgggccaagaacatccagacggcgattaatcaggtgcggtccctcatcgggaacgaggaatataccgactacatgccctctatgaaaagattccggagagaggaagaggaagccggagttctgtggtga

SEQ ID NO: 20162 - RNA, 9876 nt, synthetic construct
  misc_feature 1..9876: note = derived and/or modified CDS sequence (opt5) from DENV-2__KP723478__SS-prME
  source 1..9876: mol_type = other RNA
accgccggcatcattatcatgatgattcccacggtgatggctttccacctgacgaccagaaacggggagcctcatatgatcgtgagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaaacctggggaaaggcgaagatgctctctacggaactgcacaatcataccttcctgatcgatggccctgagacagccgaatgccccaacaccaatcgcgcttggaactccctcgaggttgaggactatgggtttggagtgttcacaaccaatatttggctgaaacttaaggaacggcaagatgtcttttgtgacagcaaactgatgtctgccgctatcaaggacaacagagccgtgcacgcggatatgggctactggattgagtccgccctcaacgacacatggaaaatcgaaaaggctagcttcatcgaggtgaagtcttgccactggcctaaaagccataccctgtggtccaatggcgtcctggagagcgaaatgattatccccaagaacttcgccgggccgatgtctcagcacaattatcgccctggataccatacgcagacagctggcccctggcaccttgggcggctcgagatggattttgacttctgtgaaggaaccaccgttgtggtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtcaactctctcgtgaccgccggacatggccagattgataattttagcctgggggttctgggaatggctcttttcctcgaggaaatgctgcgcacacgggtgggcaccaagcacgcgatcctgctcgtcgccgtgtcctttgttacgctgattaccgggaacatgtctttcagagaccttggacgcgtgatggtcatggtgggcgctgccatgacagatgacatcggcatgggggttacctacctggccctcctggctgcctttaaggtgagacctacattcgcggctggactgcttctgcggaaactcaccagcaaggagctgatgatgacgacaatcggcattgtcctcctgtcccaatctaccatgcccgagacaatccttgaactgaccgatgccctcgccctggggatgatggtgctgaaaattgtgcgcaatatggagaagtatcagcttgctgtcaccatcatggccattctgtgcgttcctaacgcggtgatcctccagaatgcttggaaagtgagctgtacaacgctggccgtcgtgtccgttagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggtcagcatcctcgcgtcttccctgctcaaaaacgatattcctatgacagggcccctggtggccggaggccttctgaccgtttgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtctctaccccgattacagccgctgcgtggtatctttgggaggtgaaaaagcaaagagccggagttctgtgggacgtgccttctccccctcccgtcggcaaagctgaactggaggatggggcctaccggatcaagcagaagggaatcctcggctattcccagattggcgccggggtgtacaaagaaggaacctttcacacaatgtggcatgttacccgcggcgctgtgctgatgcacaaggggaaaagaatcgagccctcctgggccgacgtcaagaaagatcttattagctacggaggcgggtggaagctggagggagaatggaaggagggcgaagaggtccaggtgctcgcgctggaacctggcaaaaacccgcgggctgttcaaacgaagcccggactcttcaaaaccaacacaggaaccatcggcgccgtctccctggactttagccctgggacatctggatcccccattgtggataagaaaggcaaggtggtcgggctttatggaaatggcgtggttaccagaagcggcacatacgtgtctgccatcgctcagacggagaagtccatcgaggacaaccctgaaattgaggatgacatcttccgcaaaaagcggctgaccattatggatctgcatcccggggccggaaaaacaaagagatatctccctgcgatcgtccgcgaagctattaaacggggcctgagaacccttatcctggccccgacccgcgtggttgccgctgagatggaagaggccctccgggggctgcccatcagataccagacccctgctattcgcgccgagcacacgggacgggaaatcgtggacctcatgtgtcatgcgaccttcacaatgagactgcttagccccattcgggtccctaattataacctgatcattatggatgaggcccactttaccgaccccgcttccatcgccgctcgcggctacatttctacaagagtggaaatgggggaggccgccggcatcttcatgaccgctacgccgcctggaagccgggacccctttccccagtccaatgcgcctatcatggatgaggaacgcgagattcccgaaagaagctggaactctggccacgagtgggttacagacttcaaggggaagaccgtgtggtttgtcccttccatcaaagccggaaatgatattgctgcctgcctgcggaagaacggcaaaaaggtgatccaactcagcagaaaaaccttcgactctgaatatattaagacacgcaccaatgattgggactttgtggtcacaaccgatatcagcgagatgggggccaacttcaaggctgagcgggttatcgacccgagacgctgtatgaaacccgtgattctgacggatggagaagaacgggtgatccttgccggccctatgcccgtcacacattcctctgcggctcagagacgcgggcgggtgggcagaaatcctaagaacgaaaatgaccagtacatttacatgggagagcccctggaaaacgatgaggactgcgcccactggaaagaggccaagatgctcctggacaatatcagcaccccggaaggcattatcccttccatgtttgagcccgaacgcgagaaagttgatgctatcgacggggaatatagactgcggggagaggcccgcaagacattcgtggatctcatgagacggggcgaccttcctgtctggctggcgtaccgcgtggccgctgaggggattaactatgccgatagacggtggtgttttgacggagttaaaaacaatcaaatcctggaagagaacgtggaagtcgagatttggaccaaggagggcgaaagaaagaaactcaagccccgctggctggatgctcggatctactctgaccctcttgccctgaaagagttcaaggagttcgctgccgggagaaaaagcctcacgctgaatctgattaccgagatgggccgcctccccacatttatgacccagaaggcgcggaacgcccttgataatctggctgtgctgcatacagccgaagctggaggcagagcctataaccacgccctctccgagctgccggagacccttgaaacactgctcctgctgaccctccttgctgcggtcacaggcgggatcttcctgtttctgatgagcgggaaggggattggaaaaatgacactcggcatgtgctgcatcatcaccgcctctattctgctttggtacgctcagatccagcctcactggattgccgcctccatcattctggagttctttctcatcgtgctgctgatccccgaacccgagaagcaacggacccctcaggacaatcagctcacatatgttgtgattgctatccttaccgtggtcgccgcgacaatggccaacgaaatgggcttcctggagaaaacgaagaaagattttgggctgggaagcaccacaacccagcaaccggagtccaatattctcgacatcgatctgcgccccgcttctgcctggacactttacgctgttgccaccacgttcattacccctatgctgagacatagcatcgaaaactcctctgtgaatgtgagcctcacagcgatcgccaaccaggctaccgtcctgatgggcctggggaagggatggcccctctccaagatggacattggcgtgcctcttctggccatcgggtgttacagccaggttaatcccattacactgaccgctgccctcctgcttctggtggctcactatgccatcattggacctggcctccaggcgaaagccacgcgggaggctcaaaagcgcgccgctgccggcatcatgaaaaacccgacagtcgacgggattaccgtgatcgatctggaccccatcccttacgatcccaagtttgaaaaacagctgggacaggtcatgctccttgtgctgtgcgttacacaggtgctgatgatgagaaccacctgggccctctgtgaggcgctgacacttgctacgggccctatttctaccctgtgggaagggaatcccggacggttctggaacacaaccatcgccgtctccatggctaatatttttcgcggcagctatctcgccggggccggactgctgttctctatcatgaagaacacagctaacaccagacggggcacgggcaatacaggggagaccctcggagagaagtggaaaaaccgccttaatgccctgggcaagtccgaatttcaaatttacaaaaagagcgggatccaggaggtggacagaaccctggcgaaagaaggaatcaagcggggcgagacagatcatcacgccgtttctagagggagcgctaaactccgctggttcgtggagcggaacctggtcaccccggaaggaaaggtggtggaccttggctgcggcagagggggatggtcctattactgtggcgggctgaagaatgttaaagaggtcaagggactcacaaaaggcgggcctggacatgaggaacccattcccatgtctacgtatggctggaacctggtgcgcctgcagagcggcgtggatgtcttctttacccctcccgaaaagtgcgacacactcctttgtgatatcggggagtccagccctaatccgaccgttgaggccggacggacactgagagtgctgaacctcgtggaaaattggctgaacaataacacccaattctgcattaaagtccttaatccctacatgccttccgtgatcgagaagatggaagctctgcagcgcaagtacggcggggccctcgttcggaaccccctgtctagaaatagcacgcacgagatgtattgggtgtccaacgcgtctggaaacattgtcagctccgtgaatatgatctctcgcatgctgatcaaccggtttaccatgagacacaaaaaggccacatacgaacctgacgttgatctcggcagcgggacccgcaatattggaatcgagtccgagacacccaaccttgacattatcggcaaacggattgaaaagatcaaacaggagcatgaaaccagctggcactatgatcaggaccatccgtacaagacatgggcttatcacggctcttacgagaccaagcaaacggggtccgccagctctatggtgaatggagtcgtgagactgctgacaaaaccttgggacgtgatccccatggtcacccagatggctatgaccgatacaacgcctttcggccagcagcgcgtttttaaggaaaaagtggacaccagaacacaagagcccaaggaggggaccaaaaagctcatgaagattacagccgaatggctgtggaaagagcttggaaagaaaaagacccctcggatgtgtacacgcgaagagttcaccagaaaagtgcggtccaacgctgccctgggcgcgatctttacggatgagaataagtggaaaagcgccagagaagctgtcgaggactctgggttctgggaactcgtggataaggagcggaacctgcacctggaaggaaagtgcgagacctgtgtttataatatgatgggcaaacgcgagaagaaactcggcgaatttgggaaggccaaaggatccagagctatttggtacatgtggctgggcgcccggttccttgagtttgaagccctggggttcctcaacgaggaccattggtttagccgcgaaaattccctgagcggagtggagggcgaggggcttcacaagctgggctacatcctcagagatgtctctaagaaagaaggaggcgcgatgtatgctgacgatacagccgggtgggacacccggattacactggaggatctgaagaacgaagagatggtgaccaatcatatggaaggagagcacaaaaagctcgccgaggctatcttcaaactgacgtaccagaacaaggttgtgcgcgtccagagacccacaccgcggggcaccgtgatggacattatcagccgcagagaccagcgggggtccggacaagttgtgacatatggccttaataccttcacgaacatggaagcccagctgatccgccagatggagggggaaggcgtctttaagtctattcaacagctcaccgtgacagaggagatcgctgtcaaaaactggctggtgagagttggacgggaacgccttagcagaatggccatttccggcgatgactgcgtggtcaagcctctggatgaccggttcgcgtctgccctcaccgctctgaatgatatggggaaagtgagaaaggacatccagcagtgggagcccagccgcggatggaacgattggacacaagtgcccttttgctcccatcacttccacgaactgattatgaaagacggccgggttctcgtggtcccttgtagaaatcaggatgagctgatcgggcgcgcccggatctctcagggagctggctggagccttagagaaaccgcctgcctggggaagtcctacgcgcagatgtggaacctcatgtattttcatcgccgggacctgagacttgccgctaatgccatttgtagcgctgtgccgtctcactgggttcccacatcccgcaccacgtggagcatccatgccacacacgagtggatgaccaccgaggatatgctgacagtgtggaaccgggtctggattcaagaaaatccttggatggaggacaagacccccgtggaatcttgggaggaaatcccttacctcggcaaaagagaggatcagtggtgcggatccctgattggcctgacaagccgcgctacgtgggccaagaacatccagaccgcgatcaatcaggtccggtccctcattgggaacgaggaatatacagactacatgccctctatgaaaagattccggagagaggaagaggaagccggagtgctgtggtga

SEQ ID NO: 20163 - RNA, 9876 nt, synthetic construct
  misc_feature 1..9876: note = derived and/or modified CDS sequence (opt5) from DENV-2__KP723479__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattaccccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaagcgtggggaaaggccaagatgctctctaccgaactgcacaatcatacgttcctgatcgatggccctgagaccgctgaatgccccaacacaaatcgcgcctggaactccctcgaggttgaggactatgggtttggagtgttcaccacaaatatttggctgaaaatgaaggaacggcaagatgtcttttgtgacagcaaacttatgtctgctgccatcaaggactccagagcggtgcacgccgatatgggctactggattgagagcgctctgaacgacacctggaaaatcgaaaaggcctctttcatcgaggtgaagagctgccactggcctaaatcccatacactctggagcaacggcgtcctggagtctgaaatgattatccccaagaatttcgctgggccggtttcccagcacaactatcgccctggataccatacccagacggccggcccctggcacctggggcggcttgagatggattttgacttctgtgaaggaacaaccgtggtggtcaccgaggattgcggcaatagagggcccagcctccggacaaccacggcctccggaaaactgattacagaatggtgctgtcgctcttgcaccctgcctccgctcagataccggggcgaggacggctgttggtatgggatggagatcagacccctgaaggaaaaagaggaaaaccttgtgaatagcctggttacagctggacatggccagattgataacttttccctcggggtgctgggaatggcgctgttccttgaggaaatgctccgcacccgggtcggcacaaagcacgccatcctgctggtggctgtttcttttgtgaccctcattacggggaatatgagcttcagagacctgggacgcgtcatggtgatggttggcgccaccatgacagatgacatcggcatgggggtgacctaccttgccctgctcgctgcctttaaggtcagacctacattcgcggctggactgctgcttcggaaactgacctccaaggagctcatgatgacgacaatcggcattgtgctgctctctcaagccaccatccccgagacaattctggaacttaccgatgccctggctctcgggatgatggtgctgaaaatcgtccgcaacatggagaagtatcagctggccgttaccattatggcgatcctttgcgtgcctaatgctgtgatcctgcagaacgcctggaaagtcagctgtacaacgctcgccgtggtttccgtgagccccctgctcctgacctcttcccaacagaaggctgactggattcctcttgccctgacaatcaagggactcaatcccaccgctatttttctgacaaccctgagcagaacgaacaaaaagcggtcttggccgcttaatgaagccatcatggcggtcggcatggtgtccattctggccagctctctcctgaaaaacgatatccctatgacagggcccctcgttgctggaggcctgcttaccgtgtgctacgtcctgaccggccgctccgccgacctggagctcgaaagagctgccgacgtgcggtgggaggagcaggccgaaatcagcgggtccagccctattctgtctatcacaattagcgaggatggatccatgtctatcaagaatgaagaggaggaacagacccttacaattctgatccgcacgggcctcctggtcgtgagcgggctcttccccgtttccaccccgattacagctgcggcctggtatctgtgggaggtgaaaaagcaaagagctggagtcctttgggacgtgccttctccccctcccgttggcaaagccgaactggaggatggggcctaccggatcaagcagaagggaatcctgggctatagccagattggcgctggggtgtacaaagaaggaacctttcacacaatgtggcatgtcacccgcggcgccgtgctcatgcacaaggggaaaagaatcgagccctcctgggcggacgtgaagaaagatctgatttcttacggaggcgggtggaagcttgagggagaatggaaggagggcgaagaggttcaggtcctggctctcgaacctggcaaaaacccgcgggccgtgcaaacgaagcccgggctgttcaaaaccaacacaggaaccatcggcgccgtgagcctcgacttttcccctgggacaagcggatctcccattgtcgataagaaaggcaaggtggttgggctgtatggaaatggcgtggtcaccagatccggcacatacgtgagcgctatcgcccagacggagaagtctatcgaggacaaccctgaaattgaggatgacatcttccgcaaaaagcggcttaccattatggatctgcatcccggggcgggaaaaacaaagagatatctgcctgctatcgttcgcgaagccattaaacggggcctcagaaccctgatccttgccccgacccgcgtggtcgctgccgagatggaagaggctctgcgggggctccccatcagataccagacacctgccattcgcgcggagcacacgggacgggaaatcgtggacctgatgtgtcatgccaccttcacaatgagactcctgtcccccattcgggttcctaattataaccttatcattatggatgaggctcactttaccgaccccgccagcatcgctgcccgcggctacatttccacaagagtggaaatgggggaggccgctggcatcttcatgaccgcgacgccgcctggatctcgggacccctttccccagagcaatgcccctatcatggatgaggaacgcgagattcccgaaagatcctggaacagcggccacgagtgggtcacagacttcaaggggaagaccgtgtggtttgtgccttctatcaaagctggaaatgatattgccgcctgcctgcggaagaacggcaaaaaggtcatccaactgtccagaaaaaccttcgacagcgaatatattaagacacgcaccaatgattgggactttgttgtgacaaccgatatctctgagatgggggctaacttcaaggccgagcgggtgatcgacccgagacgctgtatgaaacccgtcattctcacggatggagaagagcgggtgatcctggcgggccctatgcccgttacacatagctccgctgcccagagacgcgggcgggtgggcagaaatcctaagaacgaaaatgaccagtacatttacatgggagagccccttgaaaacgatgaggactgcgcccactggaaagaggctaagatgctgctcgacaatatcaacaccccggaaggcattatcccttctatgtttgagcccgaacgcgagaaagtcgatgccatcgacggggaatatagactgcggggagaggcgcgcaagacattcgtggatctgatgagacggggcgacctccctgtttggcttgcctaccgcgtggctgccgaggggattaactatgctgatagacggtggtgttttgacggagtcaaaaataaccaaatcctggaagagaatgtggaagtcgagatttggaccaaggagggcgaaagaaagaaactgaagccccgctggctcgatgcccggatctacagcgaccctctggctcttaaagagttcaaggaattcgccgcggggagaaaatccctgacgctcaacctgattaccgagatgggccgcctgcccacatttatgacccagaaggcccggaatgctctcgataaccttgccgtgctgcatacagctgaagccggaggcagagcctataatcacgctctgtctgagctcccggagaccctggaaacacttctgctcctgaccctgctcgcgacggttacagggggaatcttcctttttctgatgagcggcaaggggattggaaaaatgaccctgggcatgtgctgcatcatcaccgcctccattctcctgtggtacgctcagatccagcctcactggattgccgccagcatcattcttgagttctttctgatcgtgctcctgatccccgaacccgagaagcaacggacacctcaggacaaccagctgacctatgtggtcattgctatcctcacagttgtggccgcgacgatggccaatgaaatgggcttccttgagaaaaccaagaaagattttgggctgggatctattacaacccagcaaccggagaacaatatcctggacattgatctccgccccgcttccgcctggacactgtacgctgtggccaccacgttcatcacccctatgcttagacatagcatcgaaaactcctctgtcaatgtgagcctgacagcgattgccaaccaggctaccgttctcatgggcctggggaagggatggcccctgtccaagatggacatcggcgtgcctctccttgccattgggtgttactctcaggtcaatcccatcacactgaccgctgccctgctcctgcttgtggctcactatgccattatcggacctggcctgcaggcgaaagccacgcgggaggctcaaaagcgcgccgctgccggcattatgaaaaacccgacagtcgacgggatcaccgtgatcgatctcgaccccattccttacgatcccaagtttgaaaaacagctgggacaggttatgctgctcgtgctttgcgtcacacaggtgctgatgatgagaaccacctgggccctgtgtgaggcgctcacactggctacgggccctatcagcaccctttgggaagggaatcccggacggttctggaacacaaccattgccgtttccatggctaacatctttcgcggcagctatctggccggggccggactcctgttctctattatgaagaatacagctaacaccagacggggcacgggcaatacaggggagaccctgggagagaagtggaaaaaccgcctcaatgcccttggcaagtccgaatttcaaatctacaaaaagagcgggatccaggaggtggacagaaccctggcgaaagaaggaattaagcggggcgagacagatcatcacgccgtctctagagggtccgctaaactgcgctggttcgtggagcggaacctcgtgaccccggaaggaaaggttgtcgacctgggctgcggcagagggggatggagctattactgtggcgggcttaagaatgtgaaagaggtgaagggactgacaaaaggcgggcctggacatgaagagcccatccccatgtctacgtatggctggaacctcgtccgcctgcagagcggcgttgatgtgttctttacccctcccgaaaagtgcgacacactgctctgtgatattggggagtcctctcctaatccgaccgtggaggccggacggacacttagagtcctgaacctggtggaaaattggctcaacaataacacccaattctgcatcaaagttctgaatccctacatgcctagcgtgattgagaagatggaagctcttcagcgcaagtacggcggggccctggtccggaaccccctctccagaaacagcacgcacgagatgtattgggtgtccaatgcgtctggaaacatcgttagctccgtgaatatgatctctcgcatgctgattaaccggtttaccatgagacacaaaaaggccacatacgaacctgacgtcgatctgggcagcgggacccgcaatatcggaattgagtccgagacacccaacctcgacatcattggcaaacggatcgaaaagatcaaacaggagcatgaaacctcttggcactatgatcaggaccatccgtacaagacatgggcttatcacggcagctacgagaccaagcaaacggggtccgccagctctatggtgaatggagtggtcagacttctgacaaaaccttgggacgttattcccatggtgacccagatggctatgaccgatacaacgcctttcggccagcagcgcgtgtttaaggaaaaagtcgacaccagaacacaagagcccaaggaggggaccaaaaagctgatgaagatcacagccgaatggctctggaaagagctgggaaagaaaaagacccctcggatgtgtacacgcgaagagttcaccagaaaagtgcggtccaacgctgcccttggcgcgatttttacggatgagaataagtggaaaagcgccagagaagctgttgaggactctgggttctgggaactggtggataaggagcggaacctccacctggaaggaaagtgcgagacctgtgtctataatatgatgggcaaacgcgagaagaaactgggcgaatttgggaaggccaaaggatccagagctatctggtacatgtggctcggcgcccggttcctggagtttgaagcccttgggttcctgaacgaggaccattggtttagccgcgaaaattctctctccggagtggagggcgaggggctgcacaagcttggctacattctgagagatgttagcaagaaagaaggaggcgcgatgtatgctgacgatacagccgggtgggacacccggatcacactcgaggatctgaagaacgaagagatggtgaccaatcatatggaaggagagcacaaaaagctggccgaggctattttcaaactcacgtaccagaacaaggtcgtgcgcgttcagagacccacaccgcggggcaccgtgatggacatcatctcccgcagagaccagcgggggagcggacaagtcgtgacatatggcctgaacaccttcacgaatatggaagcccagcttattcgccagatggagggggaaggcgtctttaagtctatccaacagctgaccgtgacagaggagattgctgttaaaaactggctcgtgagagtcggacgggaacgcctgagcagaatggccatctccggcgatgactgcgtggtgaagcctcttgatgaccggttcgcgtctgccctgaccgctctcaatgatatggggaaagttagaaaggacattcagcagtgggagcccagccgcggatggaacgattggacacaagtgcccttttgctcccatcacttccacgaactgatcatgaaagacggccgggtcctggtggttccttgtagaaatcaggatgagctcatcgggcgcgcccggatttctcagggagctggctggagcctgagagaaaccgcctgccttgggaagtcctacgcgcagatgtggtctctgatgtattttcatcgccgggacctcagactggccgctaacgccatctgtagcgctgtgccgtcccactgggtccccacaagccgcaccacgtggtctattcatgccacacacgagtggatgaccaccgaggatatgcttacagtgtggaatcgggtctggatccaagaaaacccttggatggaggacaagacccccgtggaatcctgggaggaaattccttacctgggcaaaagagaggatcagtggtgcggaagcctcatcggcctgacatctcgcgctacgtgggccaagaatatccagaccgcgattaaccaggttcggtccctgatcgggaatgaggaatatacagactacatgcccagcatgaaaagattccggagagaggaagaggaagccggagtgctctggtga

SEQ ID NO: 20164 - RNA, 9876 nt, synthetic construct
  misc_feature 1..9876: note = derived and/or modified CDS sequence (opt5) from DENV-2__KT187554__SS-prME
  source 1..9876: mol_type = other RNA
accgctggaatcattatcatgatgattcccacagtgatggctttccacctgacgaccagaaacggggagcctcatatgatcgtcagccggcaggaaaagggaaagagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaaacctggggaaaggcgaagatgctctctacggaactgcacaatcataccttcctgatcgatggccctgagacagccgaatgccccaacaccaatcgcgcttggaactccctcgaggttgaggactatgggtttggagtgttcacaaccaatatttggctgaaacttaaggaacggcaagatgtcttttgtgacagcaaactgatgtctgccgctatcaaggacaacagagccgtgcacgcggatatgggctactggattgagtccgccctcaacgacacatggaaaatcgaaaaggctagcttcatcgaggtgaagtcttgccactggcctaaaagccataccctgtggtccaatggcgtcctggagagcgaaatgattatccccaagaacttcgccgggccggtttctcagcacaattatcgccctggataccatacgcagacagctggcccctggcaccttgggcggctcgagatggattttgacttctgtgaaggaaccaccgtggtggtcacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtgaactctctcgttaccgccggacatggccagattgataattttagcctgggggtgctgggaatggctcttttcctcgaggaaatgctgcgcacacgggtcggcaccaagcacgcgatcctgctcgtggccgtttcctttgtgacgctgattaccgggaacatgtctttcagagaccttggacgcgtcatggtgatggttggcgctgccatgacagatgacatcggcatgggggtgacctacctggccctcctggctgcctttaaggtcagacctacattcgcggctggactgcttctgcggaaactcaccagcaaggagctgatgatgacgacaatcggcattgtgctcctgtcccaatctaccatgcccgagacaatccttgaactgaccgatgccctcgccctggggatgatggtgctgaaaattgtccgcaatatggagaagtatcagcttgctgttaccatcatggccattctgtgcgtgcctaacgcggtgatcctccagaatgcttggaaagtcagctgtacaacgctggccgtggtttccgtgagccccctctttctgacctcttcccaacagaaggccgactggatccctcttgctctgacaattaagggactcaaccccaccgccatcttcctgacaaccctgagcagaacgtctaaaaagcggtcctggccgcttaatgaagctattatggccgtcggcatggtgagcatcctggcgtcttccctcctgaaaaacgatattcctatgacagggcccctcgttgccggaggcctgcttaccgtgtgctacgtcctgaccggccgcagcgctgacctggagctcgaaagagccgctgacgtgcggtgggaggagcaggccgaaatctccgggagctctcctatcctgagcattacaatctccgaggatggatctatgagcattaagaatgaagaggaggaacagacccttacaatcctgattcgcacgggcctcctggtcatctccgggctctttcccgtgtctattccgatcaccgccgctgcgtggtatctgtgggaggttaaaaagcaaagagccggagtgctttgggacgtcccttctccccctcccgtgggcaaagctgaactggaggatggggcctaccggatcaagcagaagggcattctgggctattcccagatcggcgccggggtttacaaagaaggaacattccacaccatgtggcatgtgacacgcggcgctgtcctcatgcacaaggggaaaagaattgagccctcctgggccgacgtgaagaaagatctgatcagctacggaggcgggtggaaacttgagggagaatggaaggagggcgaagaggtgcaggttctggcgctcgaacctggcaaaaacccgcgggctgtccaaaccaagcccgggctgtttaaaacgaacaccggaacaattggcgccgtgtccctcgacttcagccctgggacctctggatcccccatcgtggataagaaaggcaaggtcgtggggctgtatggaaatggcgttgtgacaagaagcggcacctacgtctctgccatcgctcagacagagaagtccattgaggacaaccctgaaatcgaggatgacattttccgcaaaaagcggcttacgatcatggatctgcatcccggggccggaaaaaccaagagatatctgcctgcgattgtgcgcgaagctatcaaacggggcctcagaacactgatccttgccccgacccgcgttgtggccgctgagatggaagaggccctgcgggggctccccattagataccagacccctgctatccgcgccgagcacacaggacgggaaattgtcgacctgatgtgtcatgcgacgtttaccatgagactcctgagccccatccgggtgcctaattataaccttattatcatggatgaggcccacttcacagaccccgcttccattgccgctcgcggctacatctctaccagagttgaaatgggggaggccgccggcatctttatgacagctaccccgcctggaagccgggaccccttcccccagtccaatgcgcctattatggatgaggaacgcgagatccccgaaagaagctggaactctggccacgagtgggtgacggactttaaggggaagacagtctggttcgtgccttccattaaagccggaaatgatatcgctgcctgcctgcggaagaacggcaaaaaggtgattcaactgagcagaaaaacctttgactctgaatatatcaagacccgcacaaatgattgggacttcgtcgttaccacagatatcagcgagatgggggccaactttaaggctgagcgggtgattgacccgagacgctgtatgaaacccgtgatcctcaccgatggagaagaacgggtcattctggccggccctatgcccgtgacgcattcctctgcggctcagagacgcgggcgggttggcagaaatcctaagaacgaaaatgaccagtacatctacatgggagagccccttgaaaacgatgaggactgcgcccactggaaagaggccaagatgctgctcgacaatattagcacaccggaaggcatcatcccttccatgttcgagcccgaacgcgagaaagtggatgctattgacggggaatatagactgcggggagaggcccgcaagacctttgtcgatctgatgagacggggcgacctccctgtgtggcttgcgtaccgcgttgccgctgaggggatcaactatgccgatagacggtggtgtttcgacggagtgaaaaacaatcaaattctggaagagaacgtcgaagtggagatctggacaaaggagggcgaaagaaagaaactgaagccccgctggctcgatgctcggatttactctgaccctctggcccttaaagagttcaaggaatttgctgccgggagaaaaagcctgaccctcaatctgatcacggagatgggccgcctgcccaccttcatgacacagaaggcgcggaacgccctcgataatcttgctgtcctgcataccgccgaagctggaggcagagcctataaccacgccctgtccgagctcccggagacactggaaacccttctgctcctgacactgctcgctgcggtgaccgggggaatttttcttttcctgatgagcggcaaggggatcggaaaaatgacgctgggcatgtgctgcatcattacagcctctatcctcctgtggtacgctcagattcagcctcactggatcgccgcctccattatccttgagtttttcctgatcgttctcctgattcccgaacccgagaagcaacggacccctcaggacaatcagctgacctatgtggtgatcgctattctcacagtcgttgccgcgaccatggccaacgaaatgggctttcttgagaaaacaaagaaagatttcgggctgggaagcacgaccacacagcaaccggagtccaatatcctggacattgatctccgccccgcttctgcctggaccctgtacgctgtggccacaacctttatcacgcctatgcttagacatagcatcgaaaactcctctgtgaatgtcagcctgaccgcgattgccaaccaggctacagtgctcatgggcctggggaagggatggcccctgtccaagatggacatcggcgttcctctccttgccattgggtgttacagccaggtgaatcccatcaccctgacagctgccctgctcctgcttgtcgctcactatgccattatcggacctggcctgcaggcgaaagccacccgggaggctcaaaagcgcgccgctgccggcattatgaaaaacccgacggtggacgggatcacagtcatcgatctcgaccccattccttacgatcccaagttcgaaaaacagctgggacaggtgatgctgctcgttctttgcgtgacccaggtcctgatgatgagaacaacctgggccctgtgtgaggcgctcaccctggctacaggccctatctctacgctttgggaagggaatcccggacggttttggaacaccacaattgccgtgtccatggctaatatcttccgcggcagctatctggccggggccggactcctgttttctattatgaagaacaccgctaacacaagacggggcaccggcaatacgggggagacactgggagagaagtggaaaaaccgcctcaatgcccttggcaagtccgagttccaaatctacaaaaagagcgggatccaggaggttgacagaaccctggcgaaagaaggaattaagcggggcgagaccgatcatcacgccgtgtctagagggagcgctaaactgcgctggttcgtcgagcggaacctcgtgacaccggaaggaaaggtggttgacctgggctgcggcagagggggatggtcctattactgtggcgggcttaagaatgtcaaagaggtgaagggactgaccaaaggcgggcctggacatgaagaacccatccccatgtctacatatggctggaacctcgtgcgcctgcagagcggcgtcgatgtctttttcacgcctcccgaaaagtgcgacaccctgctctgtgatattggggagtccagccctaatccgacagtggaggccggacggacccttagagtgctgaacctggtcgaaaattggctcaacaataacacacaattttgcatcaaagtgctgaatccctacatgccttccgttattgagaagatggaagcccttcagcgcaagtacggcggggccctggtgcggaaccccctctctagaaatagcacccacgagatgtattgggtctccaacgcgtctggaaacatcgtgagctccgttaatatgatctctcgcatgctgattaaccggttcacgatgagacacaaaaaggccacctacgaacctgacgtggatctgggcagcgggacacgcaatatcggaattgagtccgagacccccaacctcgacatcattggcaaacggatcgaaaagatcaaacaggagcatgaaacaagctggcactatgatcaggaccatccgtacaagacctgggcttatcacggctcttacgagacaaagcaaaccgggtccgccagctctatggtcaatggagtggtgagacttctgacgaaaccttgggacgtcattcccatggttacacagatggctatgaccgataccacaccttttggccagcagcgcgtgttcaaggaaaaagtggacacgagaacccaagagcccaaggaggggaccaagaagctgatgaagatcaccgccgaatggctctggaaagagctgggaaagaaaaagacacctcggatgtgtacccgcgaagagtttacaagaaaagtccggtccaacgctgcccttggcgcgattttcaccgatgagaataagtggaaaagcgccagagaagctgtggaggactctgggttttgggaactggttgataaggagcggaacctccacctggaaggaaagtgcgagacgtgtgtgtataatatgatgggcaaacgcgagaagaaactgggcgagttcgggaaggccaaaggatccagagctatctggtacatgtggctcggcgcccggtttctggagttcgaagcccttgggtttctgaacgaggaccattggttcagccgcgaaaattccctcagcggagtcgagggcgaggggctgcacaaacttggctacattctgagagatgtgtctaagcgggaaggaggcgcgatgtatgctgacgataccgccgggtgggacacacgcatcaccctcgaggatctgaaaaacgaagagatggttacaaatcatatggaaggagagcacaagaaactggccgaggctattttcaagctcacctaccagaacaaagtggtcagagtgcagcggcccacgccgcgcggcacagttatggacatcatcagcagacgggaccagcgcgggtccggacaagtggtcacctatggcctgaatacatttaccaacatggaagcccagcttattagacagatggagggggaaggcgtgttcaagtctatccaacagctgacggtcaccgaggagattgctgtgaagaactggctcgttcgggtgggacgcgaaagactgagccggatggccatctccggcgatgactgcgtcgtgaaacctcttgatgacagatttgcgtctgccctgacagctctcaatgatatggggaaggtgcgcaaagacattcagcagtgggagcccagccggggatggaacgattggacccaagttcccttctgctcccatcactttcacgaactgatcatgaaggacggcagagtgctggtcgtgccttgtcgcaatcaggatgagctcatcgggcgggccagaatttctcagggagctggctggagcctgcgcgaaacagcctgccttgggaaatcctacgcgcagatgtggaacctgatgtatttccatcggagagacctccgcctggccgctaatgccatctgtagcgctgttccgtctcactgggtgcccacctcccggacaacctggagcattcatgccacgcacgagtggatgacaaccgaggatatgcttaccgtctggaacagagtgtggatccaagaaaatccttggatggaggacaagacacccgtcgaatcttgggaggaaattccttacctgggcaagcgcgaggatcagtggtgcggatccctcatcggcctgaccagccgggctacatgggccaaaaacatccagacggcgattaatcaggtgagatccctgatcgggaacgaggaatataccgactacatgccctctatgaagcggtttagacgcgaggaagaggaagccggagttctctggtga

SEQ ID NO: 20165 - RNA, 9876 nt, synthetic construct
  misc_feature 1..9876: note = derived and/or modified CDS sequence (opt5) from DENV-2__KT187557__SS-prME
  source 1..9876: mol_type = other RNA
accgccggaatcattatcatgatgattcccacagtgatggctttccacctgacgaccagaaacggggagcctcatatgatcgtgagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaaacctggggaaaggcgaagatgctctctacggaactgcacaatcataccttcctgatcgatggccctgagacagccgaatgccccaacaccaatcgcgcttggaactccctcgaggttgaggactatgggtttggagtgttcacaaccaatatttggctgaaacttaaggaacggcaagatgtcttttgtgacagcaaactgatgtctgccgctatcaaggacaacagagccgtgcacgcggatatgggctactggattgagtccgccctcaacgacacatggaaaatcgaaaaggctagcttcatcgaggtgaagtcttgccactggcctaaaagccataccctgtggtccaatggcgtcctggagagcgaaatgattatccccaagaacttcgccgggccgatgtctcagcacaattatcgccctggataccatacgcagacagctggcccctggcaccttgggcggctcgagatggattttgacttctgtgaaggaaccaccgttgtggtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtcaactctctcgtgaccgccggacatggccagattgataattttagcctgggggttctgggaatggctcttttcctcgaggaaatgctgcgcacacgggtgggcaccaagcacgcgatcctgctcgtcgccgtgtcctttgttacgctgattaccgggaacatgtctttcagagaccttggacgcgtgatggtcatggtgggcgctgccatgacagatgacatcggcatgggggttacctacctggccctcctggctgcctttaaggtgagacctacattcgcggctggactgcttctgcggaaactcaccagcaaggagctgatgatgacgacaatcggcattgtcctcctgtcccaatctaccatgcccgagacaatccttgaactgaccgatgccctcgccctggggatgatggtgctgaaaattgtgcgcaatatggagaagtatcagcttgctgtcaccatcatggccattctgtgcgttcctaacgcggtgatcctccagaatgcttggaaagtgagctgtacaacgctggccgtcgtgtccgttagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggtcagcatcctcgcgtcttccctgctcaaaaacgatattcctatgacagggcccctggtggccggaggccttctgaccgtttgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtctctattccgatcaccgccgctgcgtggtatctttgggaggtgaaaaagcaaagagccggagttctgtgggacgtgccttctccccctcccgtcggcaaagctgaactggaggatggggcctaccggatcaagcagaagggcattctcggctattcccagatcggcgccggggtgtacaaagaaggaacatttcacaccatgtggcatgttacacgcggcgctgtgctgatgcacaaggggaaaagaattgagccctcctgggccgacgtcaagaaagatcttatcagctacggaggcgggtggaagctggagggagaatggaaggagggcgaagaggtccaggtgctcgcgctggaacctggcaaaaacccgcgggctgttcaaaccaagcccggactcttcaaaacgaacaccggaacaattggcgccgtctccctggactttagccctgggacctctggatcccccatcgtggataagaaaggcaaggtggtcgggctttatggaaatggcgtggttacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgattgtccgcgaagctatcaaacggggcctgagaacacttatcctggccccgacccgcgtggttgccgctgagatggaagaggccctccgggggctgcccattagataccagacccctgctatccgcgccgagcacacaggacgggaaattgtggacctcatgtgtcatgcgacgttcaccatgagactgcttagccccatccgggtccctaattataacctgattatcatggatgaggcccactttacagaccccgcttccattgccgctcgcggctacatctctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggttacggacttcaaggggaagacagtgtggtttgtcccttccattaaagccggaaatgatatcgctgcctgcctgcggaagaacggcaaaaaggtgattcaactcagcagaaaaaccttcgactctgaatatatcaagacccgcacaaatgattgggactttgtggtcaccacagatatcagcgagatgggggccaacttcaaggctgagcgggttattgacccgagacgctgtatgaaacccgtgatcctgaccgatggagaagaacgggtgattcttgccggccctatgcccgtcacgcattcctctgcggctcagagacgcgggcgggtgggcagaaatcctaagaacgaaaatgaccagtacatctacatgggagagcccctggaaaacgatgaggactgcgcccactggaaagaggccaagatgctcctggacaatattagcacaccggaaggcatcatcccttccatgtttgagcccgaacgcgagaaagttgatgctattgacggggaatatagactgcggggagaggcccgcaagaccttcgtggatctcatgagacggggcgaccttcctgtctggctggcgtaccgcgtggccgctgaggggatcaactatgccgatagacggtggtgttttgacggagttaaaaacaatcaaattctggaagagaacgtggaagtcgagatctggacaaaggagggcgaaagaaagaaactcaagccccgctggctggatgctcggatttactctgaccctcttgccctgaaagagttcaaggagttcgctgccgggagaaaaagcctcaccctgaatctgatcacggagatgggccgcctccccacctttatgacacagaaggcgcggaacgcccttgataatctggctgtgctgcataccgccgaagctggaggcagagcctataaccacgccctctccgagctgccggagacacttgaaaccctgctcctgctgacactccttgctgcggtcaccgggggaattttcctgtttctgatgagcggcaaggggatcggaaaaatgacgctcggcatgtgctgcatcattacagcctctatcctgctttggtacgctcagattcagcctcactggatcgccgcctccattatcctggagttctttctcatcgtgctgctgattcccgaacccgagaagcaacggacccctcaggacaatcagctcacctatgttgtgatcgctattcttacagtggtcgccgcgaccatggccaacgaaatgggcttcctggagaaaacaaagaaagattttgggctgggaagcacgaccacacagcaaccggagtccaatatcctcgacattgatctgcgccccgcttctgcctggaccctttacgctgttgccacaaccttcatcacgcctatgctgagacatagcatcgaaaactcctctgtgaatgtgagcctcaccgcgattgccaaccaggctacagtcctgatgggcctggggaagggatggcccctctccaagatggacatcggcgtgcctcttctggccattgggtgttacagccaggttaatcccatcaccctgacagctgccctcctgcttctggtggctcactatgccattatcggacctggcctccaggcgaaagccacccgggaggctcaaaagcgcgccgctgccggcattatgaaaaacccgacggtcgacgggatcacagtgatcgatctggaccccattccttacgatcccaagtttgaaaaacagctgggacaggtcatgctccttgtgctgtgcgttacccaggtgctgatgatgagaacaacctgggccctctgtgaggcgctgacccttgctacaggccctatctctacgctgtgggaagggaatcccggacggttctggaacaccacaattgccgtctccatggctaatatctttcgcggcagctatctcgccggggccggactgctgttctctattatgaagaacaccgctaacacaagacggggcaccggcaatacgggggagacactcggagagaagtggaaaaaccgccttaatgccctgggcaagtccgaatttcaaatctacaaaaagagcgggatccaggaggtggacagaaccctggcgaaagaaggaattaagcggggcgagaccgatcatcacgccgtttctagagggagcgctaaactccgctggttcgtggagcggaacctggtcacaccggaaggaaaggtggtggaccttggctgcggcagagggggatggtcctattactgtggcgggctgaagaatgttaaagaggtcaagggactcaccaaaggcgggcctggacatgaggaacccatccccatgtctacatatggctggaacctggtgcgcctgcagagcggcgtggatgtcttctttacgcctcccgaaaagtgcgacaccctcctttgtgatattggggagtccagccctaatccgacagttgaggccggacggaccctgagagtgctgaacctcgtggaaaattggctgaacaataacacacaattctgcatcaaagtccttaatccctacatgccttccgtgattgagaagatggaagctctgcagcgcaagtacggcggggccctcgttcggaaccccctgtctagaaatagcacccacgagatgtattgggtgtccaacgcgtctggaaacatcgtcagctccgtgaatatgatctctcgcatgctgattaaccggtttacgatgagacacaaaaaggccacctacgaacctgacgttgatctcggcagcgggacacgcaatatcggaattgagtccgagacccccaaccttgacatcattggcaaacggatcgaaaagatcaaacaggagcatgaaacaagctggcactatgatcaggaccatccgtacaagacctgggcttatcacggctcttacgagacaaagcaaaccgggtccgccagctctatggtgaatggagtcgtgagactgctgacgaaaccttgggacgtgattcccatggtcacacagatggctatgaccgataccacacctttcggccagcagcgcgtttttaaggaaaaagtggacacgagaacccaagagcccaaggaggggaccaaaaagctcatgaagatcaccgccgaatggctgtggaaagagcttggaaagaaaaagacacctcggatgtgtacccgcgaagagttcacaagaaaagtgcggtccaacgctgccctgggcgcgatttttaccgatgagaataagtggaaaagcgccagagaagctgtcgaggactctgggttctgggaactcgtggataaggagcggaacctgcacctggaaggaaagtgcgagacgtgtgtttataatatgatgggcaaacgcgagaagaaactcggcgaatttgggaaggccaaaggatccagagctatctggtacatgtggctgggcgcccggttccttgagtttgaagccctggggttcctcaacgaggaccattggtttagccgcgaaaattccctgagcggagtggagggcgaggggcttcacaagctgggctacattctcagagatgtctctaagaaagaaggaggcgcgatgtatgctgacgataccgccgggtgggacacacggatcaccctggaggatctgaagaacgaagagatggtgacaaatcatatggaaggagagcacaaaaagctcgccgaggctattttcaaactgacctaccagaacaaggttgtgcgcgtccagagacccacgccgcggggcacagtgatggacatcatcagccgcagagaccagcgggggtccggacaagttgtgacctatggccttaatacattcaccaacatggaagcccagctgattcgccagatggagggggaaggcgtctttaagtctatccaacagctcacggtgaccgaggagattgctgtcaaaaactggctggtgagagttggacgggaacgccttagcagaatggccatctccggcgatgactgcgtggtcaagcctctggatgaccggttcgcgtctgccctcacagctctgaatgatatggggaaagtgagaaaggacattcagcagtgggagcccagccgcggatggaacgattggacccaagtgcccttttgctcccatcacttccacgaactgatcatgaaagacggccgggttctcgtggtcccttgtagaaatcaggatgagctgatcgggcgcgcccggatttctcagggagctggctggagccttagagaaacagcctgcctggggaagtcctacgcgcagatgtggaacctcatgtattttcatcgccgggacctgagacttgccgctaatgccatctgtagcgctgtgccgtctcactgggttcccacctcccgcacaacctggagcattcatgccacgcacgagtggatgacaaccgaggatatgctgaccgtgtggaaccgggtctggatccaagaaaatccttggatggaggacaagacacccgtggaatcttgggaggaaattccttacctcggcaaaagagaggatcagtggtgcggatccctgatcggcctgaccagccgcgctacatgggccaagaacatccagacggcgattaatcaggtccggtccctcatcgggaacgaggaatataccgactacatgccctctatgaaaagattccggagagaggaagaggaagccggagtgctgtggtga

SEQ ID NO: 20166 - RNA, 9876 nt, synthetic construct
  misc_feature 1..9876: note = derived and/or modified CDS sequence (opt5) from DENV-2__JQ045670__SS-prME
  source 1..9876: mol_type = other RNA
agcgccggaatgatcattatgctgatccccaccgtgatggctttccacctgaccacgagaaatggggaacctcatatgattgtcggaatccaggaaaagggcaaatccctgctttttaagaccgaagacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctgccatggccgatgacatcggcatgggggtgacgtatctcgctctgctggccgcgttcaaggttcgccctacctttgctgccggacttctgctccggaagctgacatccaaagagctcatgatgaccacaattggcatcgtgctgctttctcaaagcaccattcccgaaacggtcctggagctcacagatgccctggctctggggatgatggtgcttaagatcgtgagaaatatggaaaaataccagctggccgtcaccatcatggcgattctctgcgttcctaacgctgtgatcctgcagaatgcctggaaggtgtcctgtacaattctcgccgtcgtgtctgttagccccctgcttctgacctccagccagcagaagaccgactggatccctctcgctctgacaattaagggactgaaccccacggccatcttccttaccacactgtctcgcaccaataaaaagagatcctggccgctcaacgaggctatcatggccgtgggcatggtcagcattctggcgtcttccctcctgaagaatgacatccctatgacagggccccttgtggccggaggcctgctgaccgtttgctatgtgctcacgggccggagcgctgatctggaacttgagcgcgccacagacgtcaaatgggaggatcaggctgaaatttctgggtccagccctatcctgtccattaccatcagcgaggacggatctatgagcattaagaacgaagaggaggaacagaccctcacaatcctgatcagaaccggcctcctggtgatttccgggctttttcccatctctattccgatcacagccgccgcttggtacctgtgggaggtcaaaaagcagcgggcgggagtgctgtgggatgttccttctccccctcccatgggcaaagccgaactcgaggacggggcttatcgcattaagcaaaagggaatcctgggctactcccagatcggcgccggggtgtacaaagaaggaacgttccacaccatgtggcatgtcacaagaggcgccgtgcttatgcacaaggggaaacggattgagccctcctgggctgatgttaagaaagacctgatcagctatggaggcgggtggaagctcgagggagaatggaaggagggcgaagaggtgcaggtcctggccctcgaacctggcaaaaatccgcgcgcggtgcagaccaagcccgggctgtttaaaacaaacaccggaacgattggcgctgtgtcccttgatttctctcctgggaccagcggatcccccatcattgacaagaaaggcaaggttgtcgggctgtacggaaacggcgtggtgacaagaagcggcgcctatgtctctgccatcgctcaaaccgagaagtccatcgaggataatcctgaaattgaggacgatatctttcggaaacgcagactgacaattatggacctccaccccggggccggaaagaccaaacggtacctgcctgcgatcgtgagagaagctattaagcgcggccttcggacactgatcctcgccccgacgagagttgtggccgctgagatggaagaggccctgcgcgggctccccattcggtatcagacccctgctatcagagccgagcatacaggacgcgaaatcgtcgacctgatgtgtcacgcgaccttcaccatgcggcttctgagccccgtgagagttcctaactacaatctgattatcatggatgaggcccatttcacagaccccgcttctattgccgctcgcggctatatctccacgcgggtggaaatgggggaggccgccggcatttttatgaccgctacaccgcctggaagcagagatcccttcccccagtccaacgcgcctatcatggacgaggaacgggagatccccgaacgctcttggaatagcggccacgagtgggtcaccgattttaaagggaagacagtgtggttcgttccttccattaaggccggaaacgacatcgctgcctgcctccgcaaaaatggcaagaaagtgattcaactgagccggaagacctttgattctgaatacgtcaaaacgcgcacaaacgactgggatttcgtggtgaccaccgacatctccgagatgggggccaattttaaggctgagagagtcattgatccgcggagatgtatgaaacccgttatccttacagacggagaggaacgcgtgatcctggccggccctatgcccgtgacccatagctctgcggctcagcggagagggcgcattggccggaaccctaagaatgaaaacgaccagtacatctatatgggagagcccctcgaaaatgatgaggactgcgcccactggaaggaggccaaaatgctgctggataacattaatacaccggaaggcatcattcctagcatgttcgagcccgaaagagagaaggtcgacgctatcgatggggaataccgcctccggggagaggccagaaaaacctttgtggaccttatgcgcagaggcgatctgcctgtttggctggcgtataaggtggccgctgaggggattaactacgccgaccggcgctggtgtttcgatggaatcaaaaacaatcagatcctcgaagagaacgtcgaagtggagatttggacgaaggagggcgaaagaaagaaactgaagccccggtggcttgacgctcgcatctattccgatcctctggccctcaaagagtttaaggagttcgctgccgggagaaaatctctgacactgaatctcattaccgagatgggccggcttcccacattcatgacccaaaagacgagagacgcgctggataacctggccgttctccacaccgctgaagccggaggccgcgcttacaatcatgccctgagcgagcttccggagacactggaaaccctcctgctgctcacacttctggccaccgtgacagggggaatctttctgttcctcatgtccggccgggggattggaaagatgaccctgggcatgtgctgcatcatcacggcttctattcttctgtggtatgcgcagatccagcctcactggattgccgctagcatcattctcgagtttttcctgatcgtcctgctcatccccgaacccgagaaacagagaacacctcaagacaaccagcttacctacgtggtcattgccatcctgaccgtggttgccgctacaatggccaatgaaatgggctttctggagaagaccaaaaaggacttcgggctcggatccattgcgacacagcagccggagagcaacatcctggatattgaccttcgccccgcctctgcttggacgctgtacgccgtggctaccacatttgtgacccctatgctccggcattccatcgaaaatagctccgtcaacgtttctctgacagccattgcgaatcaagccaccgtgctgatgggcctcgggaaaggatggccccttagcaagatggatatcggcgtgcctctgctggctatcgggtgttattcccaggtcaaccccattacgctcaccgccgctctgcttctgctcgtggcccactacgctatcattggacctggcctgcaggccaaggcgacaagagaggcccagaaacgggctgccgctggcatcatgaagaatccgaccgttgacgggattacagtgatcgatctggaccccatcccttatgatcccaaattcgaaaagcaactcggacaggtcatgcttctgattctgtgcgtgacccaggtcctcatgatgcgcacgacatgggccctgtgtgaggcccttaccctggcgacaggccctatctctaccctctgggaagggaaccccggaagattttggaataccacaattgctgtgagcatggccaacatcttccggggctcctacctggctggggccggactgctctttagcattatgaaaaatacgaccaacacacgcagaggcaccggcaacatcggggagacacttggagagaagtggaaatctcggctgaatgccctgggcaagtccgagttccaaacctataagaaaagcgggatccaggaggttgaccgcacgctcgctaaggaaggaattaaaagaggcgagacagatcaccatgccgtgtctcgggggtccgcgaagctgcgctggtttgtcgagagaaaccttgtgaccccggaaggaaaagttgtggacctgggctgcggcagagggggatggagctactattgtggcgggctcaagaatgtccgggaggtgaagggactgaccaaaggcgggcctggacacgaagaacccatccccatgtctacatacggctggaacctggtgcgcctccagagcggcgttgatgtcttcttcattcctcccgaaaagtgcgacacccttctgtgtgatatcggggagtcctctcctaatccgacagtggaggccggacggacgctgagagtgctcaacctggtcgaaaattggcttaacaataacacccagttttgcattaaagttctgaatccctacatgcctagcgtgatcgagaagatggaagctctccaacgcaaatatggcggggccctggtgcggaacgacctgtccagaaatagcacacatgagatgtactgggtctccaacgcttctggaaatatcgtgagctccgttaacatgatttctcgcatgctcatcaaccggttcaccatgagacacaagaaggccacatatgaacccgacgtggatcttggcagcgggacccgcaatattggaatcgagtccgagattcctaacctggacatcattggcaaacggatcgaaaagatcaaacaggagcatgaaacgtcttggcactacgatcaggaccacccctataagacctgggcgtaccatggcagctatgagacaaaacagaccgggtccgccagctctatggtcaatggagtggttagactgctcacaaagccgtgggatgtgctgcctaccgtcacacaaatggctatgaccgacacgacaccctttggccagcagcgcgtgttcaaggaaaaagtggatacccggacccaggagcctaaggaggggaccaagaaacttatgaaaattacggccgaatggctgtggaaggagctcggcaaaaagaagacccccagaatgtgtacacgcgaagagtttaccagaaaagtccggtccaacgctgccctgggcgctatcttcacagacgagaataagtggaaaagcgcccgcgaagcggttgaggattctagattttgggaactggtggacaaggagcggaacctccacctggaagggaaatgcgagacctgtgtgtacaatatgatgggaaagagagagaagaaacttggcgagttcggcaaggccaaagggtcccgggctatttggtacatgtggctgggagcccgctttctcgagttcgaagctctgggctttcttaacgaggatcattggttcagcagagaaaattctctgtccggggtcgagggagagggcctccacaagctggggtatatcctgcgggacgtgagcaaaaaggaaggcggagccatgtacgccgacgatacagcgggctgggacacccgcattacgctcgaggatctgaagaacgaagagatggttaccaatcacatggaaggggagcataagaaacttgctgaggccatctttaaactgacatatcaaaacaaagtggtcagagtgcagcggcctacccccagaggaacagttatggacatcatttccagacgggatcagcgcggcagcgggcaagtgggaacctacggcctcaatacgttcacaaacatggaagcccagctgatcagacagatggagggggaaggcgtcttcaaaaatattcagcaccttaccgtgacagaggaggttgctgtgcaaaactggctggcccgggtcggacgcgaaagactctctcggatggctatcagcggcgacgattgcgtggtcaagccgctggacgatcgctttgccaacgcgctgaccgccctcaatgacatggggaagattagaaaagatatccagcagtgggagccttccaagggatggaacgactggacacaggtgcccttctgctctcatcactttcatgaactgatcatgaaagatggccgggttcttgtggtcccctgtagaaatcaagacgagctgattgggcgcgctcggatcagccagggagccggctggtccctcagagaaaccgcttgcctggggaagtcttatgcccagatgtggagccttatgtacttccaccgccgggacctgagactcgcggccaacgctatttgttccgccgtgccttctcactgggtgccgacaagccgcaccacatggtccatccatgctaaacacgagtggatgaccacagaggatatgctgaccgtttggaatcgggtgtggattagagaaaacccctggatggaggacaagacgcctgtcgaaagctgggaggaaatcccctatctgggcaagcgcgaggatcagtggtgcggatctctcattggcctgacatcccgggccacctgggctaaaaatatccaagccgcgatcaaccaggtgagaagccttattgggaatgaggaatacaccgactacatgccttctatgaagcgctttcggagagaggaagaggaagccggagttctgtggtga

SEQ ID NO: 20167 - RNA, 9876 nt, synthetic construct
  misc_feature 1..9876: note = derived and/or modified CDS sequence (opt5) from DENV-2__JQ045686__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgttattctcgcttacacaatcggaaccacccactttcagcgcgtgctgattttcatccttctgacagccgtcgctccttccatgacgatgagatgcattggcatctctaaccgggattttgtggaaggggttagcggaggctcctgggtggacatcgtcctcgagcacgggagctgtgtgaccacaatggccaagaataagcccaccctggatttcgaacttattaaaacagaggcgaagcagcctgccaccctgcgcaaatattgcatcgaagctaagctcacgaacacaaccaccgagtctagatgtccgacacaaggagagccctccctgaaagaagaacaggacaagcggtttgtgtgcaagcatagcatggtcgatcgcggctggggcaatgggtgtggactgttcggcaaagggggaattgttacctgcgccatgtttacatgcaagaaaaacatggaaggcaagatcgtgcagcctgagaatctcgaatacacgattgtggtcacaccccactctggggaggagcatgctgtgggaaacgacacaggcaaacacggccaggaaatcaaggttacccctcaatccagcatcacagaggccgaactgaccgggtatggaacggtgaccatggagtgttctcccagaacaggccttgatttcaatgaaatggtcctgctccagatggagaacaaagcgtggctggtgcaccggcagtggtttcttgacctgccgctcccttggctgcccggggccgataagcaggagtccaattggattcaaaaggaaaccctggttacattcaaaaaccctcatgctaagaaacaggacgtggtcgtgctcggaagccaggagggcgccatgcacaccgctctgacgggggccacagaaatccaaatgtcctctggcaatcttctgtttaccggacatctcaagtgccgcctgagaatggacaaacttcagctgaagggcatgagctactccatgtgtacagggaagttcaaagtcgtgaaggagattgccgagacccagcacggaaccatcgttattcgggtgcagtatgaaggcgatgggagcccctgcaaaatccccttcgagatcatggacctcgaaaagagatacgtcctgggacgcctgattacagtgaaccctatcgttacggagaaagattctccggtgaacattgaagctgagcccccttttggcgactcctacatcattatcggggtcgagcccggccaactcaagctgaattggttcaagaaaggaagctctattggccagatgtttgaaaccacaatgagaggggcgaagagaatggccatccttggagataccgcttgggacttcggcagcctcgggggagtgtttacatccatcggcaaagccctccatcaggtgttcggggccatttatggcgctgccttttctggagttagctggaccatgaagatcctgattggcgtcatcattacgtggatcgggatgaactcccgcagcacatctctgtccgtgagccttgtgctcgtcggaatcgtgaccctgtacctgggcgttatggtgcaggcggattctgggtgtgtcgtgtcctggaaaaataaggagctcaagtgcggaagcggcattttcatcaccgacaacgttcacacatggaccgaacaatataaatttcagcctgagtccccctctaagctggctagcgccattcagaaagcccaggaagaggggatctgtggcattcggtccgtgacaagacttgagaatctgatgtggaagcaaatcacgccggaactcaaccacatcctggctgagaatgaagtcaaactgaccattatcacaggagatattaagggcatcatgcaggccgggaaacgctctcttcggcctcagcccaccgagctcaagtacagctggaagacatggggaaaagctaagatgctgtccaccgaaagctataaccagacgttcctgattgacggccctgagaccgccgagtgccccaatacaaacagagcgtggaactctctcgaagtggaggattacgggtttggagttttcaccacaaacatctggctgaaacttaaggaaaaacaagacgccttttgtgactccaagctgatgagcgctgccatcaaggataatcgcgctgtgcatgccgacatgggctattggattgagtctgcgctcaacgatacctggaaaatcgagaaggcctccttcattgaagtcaaaaattgccactggcctaagagccatacactgtggtctaacggcgtgctggagagcgaaatgatcattcccaaaaaccttgctgggccggtgtcccagcacaattaccggcctggataccacacccagatcgccggcccctggcatctcgggaagctggagatggacttcaacttttgtgatggaacgacagtcattgttaccgaagactgcggcaatagagggcccagcctgcgcaccacaaccgcttctggaaagctcatcacggagtggtgctgtcggtcctgcacactgcctccgcttagatatcggggcgaggatggctgttggtacgggatggaaatccgccccctgaaagagaaggaagagaacctcgtgaatagcctggtgaccgccggacacggccaagtcgacaacttctccctgggggtgcttggaatggccctctttctggaagagatgctgagaacacgggttggcaccaaacatgctattctcctggtggcggtctctttcgtgacacttatcaccgggaatatgagctttaaggatctgggaagagttgtggtcatggtgggcgccacgatgaccgacgatattggcatgggggttacatatctcgctctgctggccgccttcaaagtgcgccctacctttgctgccggacttctgctccggaagctgacatccaaggagctcatgatgaccacgatcggcattgtcctgctttctcagagcacaatccccgaaaccgtgctggagctcacagacgcgctggctctggggatgatggtgcttaaaatcgtcagaaacatggaaaagtaccagctggccgttaccattatggccatcctctgcgtgcctaatgctgtgattctgcagaacgcctggaaagtctcctgtaccatcctcgcggtggtttctgtgagccccctgcttctgacatccagccaacagaagacggattggattcctctcgctctgaccatcaaaggactgaatcccacagccatcttccttaccacactgtctcgcaccaacaagaaaagatcctggccgctcaatgaggccattatggctgtcggcatggtgagcatcctggcctcttccctcctgaagaacgacattcctatgacggggccccttgttgctggaggcctgctgacagtgtgctatgtcctcaccggccggagcgccgacctggaacttgagcgcgcgaccgatgtgaagtgggaggaccaggccgaaatctctgggtccagccctattctgtccatcacaattagcgaggatggatctatgagcatcaaaaatgaagaggaggaacagaccctcacaatcctgattagaacgggcctcctggtcatctccgggctttttcccatttctatcccgattaccgctgccgcttggtacctgtgggaggtgaagaaacaacgggccggagttctgtgggacgtgccttctccccctcccatgggcaaggccgaactcgaggatggggcttatcgcatcaaacagaagggaatcctgggctactcccagattggcgcgggggtctacaaggaaggaacattccacaccatgtggcatgtgacaagaggcgccgttcttatgcacaaagggaagcggatcgagccctcctgggctgacgtgaaaaaggatctgattagctatggaggcgggtggaaactcgagggagaatggaaggagggcgaagaggtccaggtgctggccctcgaacctggcaagaacccgcgcgccgtgcaaaccaaacccgggctgtttaagacgaacaccggaacaatcggcgctgtttcccttgacttctctcctgggaccagcggatcccccattatcgataaaaagggcaaagtcgtggggctgtacggaaatggcgtggtcacaagaagcggcgcctatgtgtctgcgatcgctcagaccgagaagtccattgaggacaaccctgaaatcgaggatgacatttttcggaagcgcagactgacaatcatggatctccaccccggggccggaaaaacgaagcggtacctgcctgccattgttagagaagctatcaaacgcggccttcggaccctgattctcgccccgacaagagtggtcgcggctgagatggaagaggccctgcgcgggctccccatccggtatcagacccctgccatcagagctgagcataccggacgcgaaattgtggacctgatgtgtcacgccacattcacgatgcggcttctgagccccgttagagtgcctaattacaacctgatcattatggacgaggctcatttcaccgatcccgcctctatcgcggcccgcggctatatttccacacgggtcgaaatgggggaggctgccggcatctttatgaccgctacaccgcctggaagcagagaccccttcccccaatccaatgcccctatcattgatgaggaacgggagatccccgaacgctcttggaacagcggccacgagtgggtgaccgactttaaggggaaaacggtttggttcgtgccttccattaaggccggaaatgatatcgctgcgtgcctcagaaagaacggcaaaaaggtcattcagctgagccggaaaacatttgactctgaatacgtgaagacccgcaccaatgattgggacttcgtggtcacaaccgatatctccgagatgggggccaactttaaagctgagagagttatcgacccgcggagatgtatgaagcccgtgattcttacagatggagaggaacgcgtgatcctggccggccctatgcccgtcacccatagctctgccgctcagcggagagggcgcattggccggaatcctaaaaacgaaaatgaccagtacatctatatgggagagcccctcgaaaacgacgaggattgcgcccactggaaggaggcgaagatgctgctggacaatattaacacgccggaaggcatcattcctagcatgttcgagcccgaaagagagaaagtggatgctatcgttggggaataccgcctccggggagaggccagaaagacatttgtggaccttatgcgcagaggcgatctgcctgtctggctggcctataaagtggctgccgaggggatcaactacgcggaccggcgctggtgtttcgatggaattaagaataaccaaatcctcgaagagaatatggaagttgagatttggaccaaagagggcgaaagaaagaagctgaaaccccggtggcttgacgcccgcatctattccgatcctctggctctcaaggagtttaaagagttcgccgctgggagaaagtctctgacactgaacctcattaccgagatgggccggcttcccacgttcatgacccagaaaacaagagacgccctggataatctggctgtgctccacaccgccgaagcgggaggccgcgcctacaaccatgctctgagcgagcttccggagacactggaaaccctcctgctgctcacacttctggccaccgtcacagggggaatctttctgttcctcatgtccggccgggggatcggaaagatgacactgggcatgtgctgcattatcaccgcttctattcttctgtggtatgcccagatccagcctcactggattgccgctagcatcatcctcgagtttttcctgattgtgctgctcatccccgaacccgagaagcaaagaacccctcaggacaatcagcttacatacgtcgtgattgcgatcctgaccgttgtggccgctacaatggccaacgaaatgggctttctggagaaaacgaagaaagatctcgggctgggatccattgccacccagcaaccggagagcaatatccttgacattgacctgcgccccgcttctgcctggacactctacgcggtggccaccacattcgtcacccctatgctgcggcattccatcgaaaacagctccgttaatgtgtctctgacggctatcgccaaccaggctaccgtgctcatgggccttgggaagggatggcccctgagcaaaatggatattggcgtccctctgctcgccatcgggtgttattcccaggtgaatcccattacactgaccgcggcccttctgctcctggttgctcactacgccatcattggacctggcctgcaggctaaggccacaagagaggctcaaaagcgggccgcggccggcatcatgaaaaacccgaccgtggacgggatcacggtcattgatctcgaccccatcccttatgatcccaagtttgaaaaacagcttggacaggtgatgctgctggtcctctgcgtgacacaagttctgatgatgcgcaccacatgggctctttgtgaggccctgaccctcgctaccggccctatttctacactgtgggaagggaatcccggaagattctggaacacgaccatcgccgtgagcatggccaatatttttcggggctcctacctggcgggggctggactccttttcagcatcatgaagaacacaaccaacacacgcagaggcaccggcaatatgggggagacgctgggagagaaatggaagtctcggctgaacgccctcggcaaatccgaatttcagatctataaaaagagcgggattcaggaggtcgaccgcacactggctaaagaaggaatcaagagaggcgagaccgatcaccatgccgtgtctcgggggtccgccaaacttcgctggttcgttgagagaaatatggtgaccccggaaggaaaggtcgtggacctgggctgcggcagagggggatggagctactattgtggcgggctcaaaaacgtgcgggaggttaagggactgacaaagggcgggcctggacacgaagaacccattcccatgtctacctacggctggaatctggtccgcctccagagcggcgtggatgtgtttttcatccctcccgaaaaatgcgacacacttctgtgtgatattggggagtcctctcctaacccgacggtcgaggctggacggaccctgagagttctcaatctggtggaaaactggcttaataacaatacacaattctgcatcaaggtgctgaacccctacatgcctagcgtcatcgagaaaatggaagccctccagcgcaagtatggcggggcgctggtgcggaatcccctgtccagaaacagcacccatgagatgtactgggtttccaatgcctctggaaacattgtgagctccgtcaacatgatctctcgcatgctcattaatcggtttacaatgagacacaaaaaggctacctatgaacctgacgtggatcttggcagcgggacgcgcaacatcggaattgagtccgagatccccaatctggacattatcggcaagcggatcgagaagattaagcaggagcatgaaacctcttggcactacgaccaggatcacccgtataaaacatgggcctaccatggcagctatgagaccaagcaaacagggtccgctagctctatggttaacggagtggtcagactgctcaccaaaccttgggacgtgctgcccacagtgacccagatggccatgacggatacaacccctttcggccagcagcgcgtctttaaggaaaaggttgacacccggacacaagagcccaaagaggggacgaagaaacttatgaagatcaccgcggaatggctgtggaaagagctcggaaagaaaaagacacctagaatgtgtacccgcgaagagttcacaagaaaggtgcggtccaatgccgctctgggcgccatttttaccgatgagaacaaatggaaaagcgctcgcgaagccgtggaggactctagattctgggaactggtcgataaagagcggaatctccacctggaagggaagtgcgagacatgtgtgtacaacatgatgggaaaaagagagaagaaacttggcgaatttggcaaagctaaggggtcccgggccatctggtacatgtggctgggagcgcgcttcctcgagtttgaagccctgggcttccttaatgaggaccattggtttagcagagaaaactctctgtccggggttgagggagagggcctccacaaactggggtatattctgcgggatgtgagcaagaaagaaggcggagctatgtacgccgacgataccgctggctgggacacgcgcgtcaccctcgaggacctgaagaatgaagagatggtgacaaaccacatggaaggggagcataagaaacttgccgaggccatcttcaagctgacctatcagaataaagttgtgagagtccagcggcccacaccgcgcggaaccgtgatggatatcatttccagacgggaccaacgcggcagcgggcaggttggaacgtacggcctcaacacatttaccaatatggaagcgcagctgatcagacagatggagggggaaggcgtgttcaagaacattcaacaccttacagtcaccgaggaggtggctgtcaaaaactggctggcccgggtgggacgcgaaagactctctcggatggccatcagcggcgatgactgcgttgtgaagcctctggatgaccgcttcgctaatgccctgacggctctcaacgatatggggaagattagaaaagacatccagcagtgggagccctcccggggatggaatgattggacccaggtccccttttgctctcatcacttccatgaactgatcatgaaggacggcagagtgcttgtggttccttgtcgcaaccaagatgagctgattgggcgggccagaatcagccagggagcgggctggtccctccgcgaaacagcctgcctggggaaatcttatgctcagatgtggagccttatgtactttcaccggagagacctgcgcctcgccgctaatgccatttgttccgcggtgccgtctcactgggtccccaccagccggacaacctggtccatccatgccaagcacgagtggatgacaaccgaggatatgctgacggtgtggaacagagtttggattcgcgaaaatccttggatggaggacaaaacacccgtggaaagctgggaggaaatcccttatctgggcaagcgggaggaccagtggtgcggatctctcattggcctgacctccagagctacctgggccaagaacatccaagctgccatcaatcaggtccgcagccttattgggaacgaggaatacacagattacatgccctctatgaaacggttcagacgggaggaagaggaagctggagtgctgtggtga

SEQ ID NO: 20168 - RNA, 9876 nt, synthetic construct
  misc_feature 1..9876: note = derived and/or modified CDS sequence (opt5) from DENV-2__KU094070__SS-prME
  source 1..9876: mol_type = other RNA
accgcgggaatgatcattatgctgatccccaccgtgatggctttccacctcacgaccagaaacggggagcctcatatgattgtcagccggcaggaaaagggaaagtccctgctttttaagacagaggacggcgttaatatgtgcaccctgatggccatggatctcggggaatggctggaggacaagatcacatacaagtgtccgcttctgagacaaaacgaacccgaggatattgactgctggtgtaattctaccagcacatgggtgacctatggaacgtgcaccacaaccggcgagcacagacgggaaaaacgctccgtggcgctcgtccctcatgtggggatgggactggagacaagaaccgaaacgtggatgtctagcgagggcgcttggaagcacgcccagcggatcgagacatggatcctgcgccatcccggcttcaccattatggccgctatcctcgcctacacaattgggaccacccactttcagagagctctgatcttcattcttctgacagccgttgcgccttccatgacgatgcggtgtatcggaatttctaaccgcgattttgtggaaggcgtcagcgggggatcctgggtggacatcgttctcgagcacggcagctgcgtgaccacaatggccaagaataaacccaccctggatttcgaacttatcaagacagaggctaaacagcctgccaccctgagaaagtattgtattgaagctaaactcacgaacacaaccaccgagtctcggtgcccgacacaaggggagccctccctgaatgaagaacaggacaagcgctttgtctgtaagcatagcatggtggatagaggatggggcaacggctgcgggctgttcggaaaaggctctatcgtgacctgtgccatgtttacatgcaagaaaattatgaaggggaaagtcgttcagcctgaaaatctcgagtacacgatcgtgattacaccccactccggagaagaacatgcggtgggcaacgacacagggaagcacggaaaagagatcaagatcacccctcagagctctattacagaagccgagctgaccggctatggcacggtcaccatggaatgcagcccccggacagggcttgatttcaatgagatggtgctgctccaaatggaaaacaaggcttggctggttcaccgccagtggtttcttgacctgccgctcccttggctgcccggagccgatacccagggcagcaattggatccagaaagagacactggtgaccttcaagaaccctcatgctaaaaagcaagacgtcgtggttctcgggtcccaggagggagccatgcacacggccctgacaggcgctaccgaaattcagatgtctagcgggtaccttctgtttacaggccatctcaaatgtagactgcggatggacaaacttcaactgaagggaatgtcctatagcatgtgcaccggcaaattcaaggtggtcaaagagatcgcggaaacccagcacgggacaattgtgatcagagtccagtacgagggagatggctctccctgtaagatccccttcgagattatggacctcgaaaaacgccatgtgctggggcggctgatcacggttaatcctattgtgaccgagaaggattccccggtcaacatcgaagccgagcccccttttggagacagctacattatcattggcgtggaacccgggcagctcaagctgaactggttcaaaaagggctctagcatcggacaaatgtttgagacaaccatgagaggcgctaaacgcatggccatccttggggatacagcctgggacttcggatccctgggcggggtttttacctctattggaaaggctctccaccaggtgttcggcgccatctatggggcggcttttagcggcgtctcctggacgatgaaaattctgacaggagtgatcattacctggatcggcatgaatagccggtctacctccctgagcgtgtctcttgttctcgtcggggccgtgacactgtacctgggagtgatggtccaggccgattccggctgcgtggttagctggaagaacaaggagctcaaatgtgggtccggaatcttcattaccgacaatgtgcacacatggacggaacagtataagtttcaacctgagtctcccagcaaactggcttccgccatccagaaggctcatgaagagggcatttgcgggatcagatctgtcacccgccttgaaaacctgatgtggaaacagattacaccggagctcaatcacatcctgagcgagaacgaagtgaagctgaccatcatgacaggcgatattaaaggaatcatgcaggccggcaagcggtcccttagacctcaacccaccgagctcaagtacagctggaaaacgtgggggaaggcgaaaatgctgtctaccgaatcccataatcagacattcctgattgacggacctgagaccgccgaatgtcccaacacaaatcgcgcttggaacagcctcgaggttgaggattatggctttggggtgttcaccacaaatatctggctgaaacttcgggaggaacaggacgtcttttgcgactctaaactgatgtccgccgctattaaggataacagagccgtgcacgcggacatgggatactggatcgaaagcgccctcaatgatacctggaagatcgagaaggcttctttcattgaggttaagagctgtcactggcctaaatcccatacgctgtggagcaacggcgtgctggaatctgagatgatcattcccaagaatttcgccggcccggtctcccagcacaactatcgccctgggtaccatacacaaaccgctggaccctggcaccttggcaaactcgaaatggactttgatttctgcgaggggaccacagtggtggtcaccgaagactgtggaaaccggggccccagcctgagaacgacaaccgcctccgggaagctgatcacagagtggtgctgccggtcttgtaccctccctccgctgcgctacagaggagaggatggctgctggtatggcatggaaattcggccccttaaggagaaagaagagaatctggttaacagcctcgtgacagccgggcatggacagatcgacaatttttccctgggcgtgctggggatggctcttttcctcgaagagatgctgagaacccgcgtcggaacgaagcacgcgattctgctcgtggccgtttcttttgtgaccctgatcacaggcaacatgagcttccgggatcttgggagagtcatggtgatggttggagctaccatgacagacgatatcggcatgggcgtgacctacctggccctcctggccgcttttaaagtccgccctacgttcgccgcggggctgcttctgagaaagctcacatccaaagagctgatgatgaccacaattggaatcgtgctcctgtctcagagcaccattcccgaaaccatccttgagctgacagacgctctcgccctgggcatgatggttctgaagatggtgcggaagatggaaaaatatcaacttgccgtcacgattatggctatcctgtgtgtgcctaatgccgtgatcctccagaacgcgtggaaggtctcctgcaccattctggctgttgtgagcgtgtctcccctctttctgacatccagccagcagaaagccgattggatccctcttgccctgaccattaaggggctcaatcccacagctatcttcctgaccacgctgtctcgcacaaacaaaaagagatcctggccgcttaatgaggccattatggctgtcggaatggtgagcatcctggcctcttccctcctgaaaaacgacatccctatgaccggccccctcgttgccgggggactgcttaccgtgtgttacgtcctgacaggccggagcgccgacctggaactcgagcgcgctgccgatgtgaagtgggaggaccaagctgaaatttccggcagctctcctatcctgagcattaccatctccgaggatgggtctatgagcattaagaatgaagaggaggaacagacacttacgatcctgattagaaccggactcctggttatctccggcctctttcccgtgtctatcccgattacagccgccgcttggtatctgtgggaggtcaaaaagcagcgggcgggggtgctttgggacgtcccttctccccctcccgtgggaaaagccgaactggaggatggcgcttaccgcatcaagcagaaagggattctgggatattcccaaatcggcgccggcgtttacaaggaagggaccttccacacaatgtggcatgtgaccagaggagccgtcctcatgcacaagggcaaacggattgagccctcctgggctgacgtgaagaaagatctgatcagctacgggggaggctggaaacttgagggggaatggaaagagggagaagaggttcaggtgctggccctcgaacctggcaagaacccgcgcgcggtccagacgaagcccggcctgtttaaaaccaatgctgggacaatcggagccgtgtccctcgacttcagccctggcacctctgggtcccccattatcgataagaaaggaaaggtggttggcctgtatgggaacggagtcgtgacaagaagcggcgcctacgtgtctgctattgcccagaccgagaaatccatcgaggacaatcctgaaattgaggatgacatcttccggaagagaaaacttacaatcatggatctgcatcccggcgcggggaaaacgaagcgctatctgcctgctattgtccgggaagccatcaaaagaggactccgcaccctgattcttgccccgacacgggtggttgctgccgagatggaagaggctctgagaggcctccccatccgctaccaaacccctgccattcgggcggagcacaccgggagagaaatcgtggacctgatgtgccatgccacatttacgatgcgcctcctgagccccgtccgggtgcctaactataaccttattatcatggacgaggctcacttcaccgatcccgcctccatcgctgccagaggatacatttctacacgggttgaaatgggcgaggccgctgggatctttatgaccgcgacaccgcctggcagccgcgaccccttcccccagtccaatgcccctattatggatgaggaaagagagatccccgaacggagctggtcttccggacacgagtgggtgaccgactttaagggcaaaacggtctggttcgtgcctagcattaaggctgggaacgatatcgccgcctgtctgcgcaagaatggcaagaaggttatccagctgtctagaaaaacatttgacagcgaatatgtgaagacccggaccaacgattgggacttcgtcgtgacaaccgatatttccgagatgggcgctaattttaaagccgagagagtgatcgacccgcgccggtgcatgaagcccgtcattctcacagatggggaagagagagttaccctggcgggacctatgcccgtgacgcattctagcgctgcccaacgccggggcagaatcgggcgcaaccctaaaaatgaaaacgaccagtacatttacatgggcgagccccttgaaaatgacgaggattgtgcccactggaaggaggctaagatgctgctcgacaacatcaatacaccggaaggaatcattccttccatgttcgagcccgaacgggagaaagtggatgccatcgacggcgaatatagactgcgcggggaggcgagaaagacctttgtcgatctgatgcggcgcggagacctccctgtgtggcttgcctacagagttgctgccgagggcattaactatgctgatcggcgctggtgcttcgacgggatcaaaaataaccagattctggaagagaatgtggaagtcgagatctggacaaaggagggagaacgcaagaagctgaagccccggtggctcgatgccagaatttactctgaccctctggctcttaaagagttcaaggaatttgccgcgggccgcaaaagcctgaccctcaacctgatcacggagatggggcggctgcccaccttcatgacacagaaggccagagatgctctcgacaaccttgccgtgctgcataccgctgaagccggcggacgcgcctataatcacgctctgtccgagctcccggagacactggaaacccttctgctcctgacactgctcgcgaccgttacgggcgggatctttcttttcctgatgagcggacggggcattgggaaaatgacactgggaatgtgttgcatcattaccgcctctatcctcctgtggtacgctcaaattcagcctcactggatcgccgcctccatcattcttgagtttttcctgatcgtgctcctgattcccgaacccgagaagcagagaacccctcaggataaccaactgacatatgtcgtgatcgctattctcaccgtcgtggccgcgacaatggccaatgaaatgggctttcttgagaagacgaaaaaggacctgggcctggggagcatcaccacacagcagccggagtccaacatcctcgacattgatctgcggcccgcttctgcctggaccctttacgctgttgccacaaccttcgtgacgcctatgctgcgccatagcatcgaaaattcctctgtgaacgtcagcctcaccgcgattgccaatcaggctacagttctgatgggactgggcaaagggtggcccctctccaagatggacatcggagtgcctcttctggccattggctgctacagccaagtgaaccccatcaccctgacagctgccctctttctgcttgtcgctcactatgccattatcgggcctggactgcaggcgaaagccaccagagaggctcagaagcgggccgctgccggcatcatgaagaatccgacggtggatggcattacagttatcgacctcgatcccattccttacgaccccaaattcgaaaagcagctggggcaagtgatgctgctcgtcctttgtgtgacccaggtcctgatgatgcgcacaacctgggccctgtgcgaggcgctcaccctggctacaggacctatctctacgctttgggaaggcaaccccgggagattttggaataccacaattgccgtgtccatggctaacatcttccggggaagctatctggccggcgccgggctcctgttttctatcatgaaaaataccacaaacacccgcagaggaacgggcaatattggcgagacactgggggagaagtggaaatcccggctcaacgctcttggaaagagcgagttccagatctacaaaaagtctggcattcaagaggttgatcgcaccctggccaaggaagggatcaaaagaggagagaccgaccatcacgcggtgagccggggctccgccaagctgagatggttcgtcgagcgcaatctcgtgacaccggaagggaaagttgtggatctgggatgtggccggggcgggtggtcttattactgcggaggccttaagaacgtcagagaggtgaaagggctgaccaagggaggccctgggcatgaggaacccattcccatgagcacatatggatggaacctcgtgcgcctgcagtccggcgttgacgtctttttcacgcctcccgaaaagtgtgataccctgctctgcgacatcggcgagagctcccctaatccgacagtggaggctgggcggacccttagagtgctgaacctggtcgaaaattggctcaacaataacacacagttttgtatcaaagttctgaatccctacatgccttctgtgattgagaagatggaagcccttcagcgcaaatacggaggcgctctggtgcggaaccccctcagcagaaattccacccacgagatgtattgggtctctaacgccagcgggaatatcgtgtcctctgttaacatgattagccgcatgctgatcaatcggttcacgatgagacacaagaaagcgacctacgaacctgatgtggacctgggatccggcacacgcaacattgggatcgagagcgagatccccaatctcgacattatcggaaagcggattgaaaagatcaaacaagagcatgaaacctcttggcactatgatcaggaccatccgtacaagacatgggcctatcacggctcctacgagaccaaacagacaggcagcgcttcttccatggtcaacggggtggttagacttctgaccaagccttgggatgtggtccccatggtgacgcagatggccatgacagacaccaccccttttggacaacagcgcgtgttcaaagaaaaggtcgatacaagaacgcaggagcccaaggagggcaccaaaaagctgatgaaaattacagctgaatggctctggaaggagctggggaaaaagaaaacccctcggatgtgcacacgcgaagagtttaccagaaaggttcggagcaacgccgctcttggagccatcttcacagacgagaataagtggaaatctgcgagagaagccgtggaggattcccggttttgggaactggtggacaaggagcgcaacctccacctggaaggcaaatgtgagacctgcgtctataatatgatggggaagagagagaaaaagctgggagagttcggcaaggctaaaggcagccgggccatttggtacatgtggctcggggctcgctttctggagttcgaagcccttggatttctgaacgaggatcattggttctccagagaaaatagcctctctggcgtggagggggagggactgcacaaacttggctacatcctgcgggacgttagcaaaaaggaagggggcgccatgtatgcggatgacacggctggatgggacacccgcatcacactcgaggatctgaaaaacgaagagatggtgaccaatcatatggaaggcgagcacaagaagctggccgaggccattttcaaactcacataccagaacaaggtcgtgagagttcaacggcccaccccgcgcgggacggtgatggacatcatttccagacgggatcagcgcggatctggccaggtcgggacatatggactgaatacctttacaaacatggaagctcaacttatcagacagatggagggcgaaggggtgttcaaaagcattcagcatctgaccgttacggaggagatcgccgtgcagaattggctcgctcgggtcggccgcgaaagactgtcccggatggccatctctggagacgattgtgtggtcaagcctcttgacgatagatttgcgagcgccctgaccgctctcaacgacatgggcaaagtgcgcaaggatattcaacagtgggagccctcccgggggtggaatgactggacacaggttcccttctgctctcaccactttcatgaactgatcatgaaggatggaagagtgctggtcgtgccttgccgcaaccaggacgagctcattggccgggccagaatcagccaaggggctggatggtccctgcgcgaaaccgcctgtcttggcaaaagctacgcgcagatgtggtctctgatgtatttccaccggagagatctccgcctggccgctaatgccatttgctccgctgtgccgagccattgggttcccacatctcggaccacatggtccatccacgccaagcacgagtggatgaccacggaggacatgcttacagtgtggaacagagtctggatccaggaaaacccttggatggaggacaaaacccccgtggaaagctgggaggaaattccttacctggggaagcgcgaggatcagtggtgtggctccctcatcggactgacctctcgggttacatggggcaaaaatattcaaaccgctatcaaccaggtgagaagcctgattgggaatgaggaatatacagactacatgccctccatgaagcggtttagacgcgaggaagaggaagccggagtcctctggtga

SEQ ID NO: 20169 - RNA, 9876 nt, synthetic construct
  misc_feature 1..9876: note = derived and/or modified CDS sequence (opt5) from DENV-2__FM210215__SS-prME
  source 1..9876: mol_type = other RNA
agcgccggcatgatcgtgatgctgattcccacagtgatggctttccacctgacaacgagaaatggggagcctcatatgatcgttggcattcaagaaaagggaaaatccctgctttttaagaccgaggacggggtgaatatgtgcacactgatggccatggatctgggagaactgtgtgaggacaccatcacatacaaatgcccgcttctgcggcaaaacgaacccgaggatattgactgttggtgcaattctaccagcacatgggtgacctatggcacgtgtaccacaaccggggagcaccgcagagaaaagcggtccgtcgcgctcgtgcctcatgttggaatgggcctggagacacgcaccgaaacgtggatgtctagcgagggcgcttggaaacacgcccagagaatcgagacatggatcctgcggcatcccgggttcaccattatggccgctatcctcgcctacacaattggaaccacccactttcagcgcgtgctgatcttcattcttctgacagctgtcgccccttccatgacgatgagatgcatcggcatttctaaccgggattttgtggaaggggttagcggaggctcctgggtggacatcgtcctcgagcacgggagctgtgtgaccacaatggcgaagaataagcccaccctggatttcgaacttatcaaaacagaggccaagcagcctgctaccctgcgcaaatattgcattgaagccaagctcacgaacacaaccaccgagtctagatgtccgacacaaggagagccctccctgaaagaagaacaagacaagcggtttgtgtgcaagcatagcatggtcgatcgcggctggggcaatgggtgtggactgttcggcaaagggggaatcgttacctgcgctatgtttacatgcaagaaaaacatggaaggcaagattgtgcagcctgagaatctcgaatacacgatcgtggtcacaccccactctggggaggagcatgccgtgggaaacgacacaggcaaacacggcaaggaaattaaagttacccctcagtccagcatcacagaggcggaactgaccgggtatggaacggtgaccatggagtgttctcccagaacaggccttgatttcaatgaaatggtcctgctccaaatggagaacaaggcctggctggtgcaccggcagtggtttcttgacctgccgctcccttggctgcccggggctgataagcaggagtccaattggatccagaaagaaaccctggttacattcaagaaccctcatgccaaaaagcaagacgtggtcgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgttatccgggtgcagtatgaaggcgatgggagcccctgcaagattcccttcgagatcatggacctcgagaagcggtacgtcctgggacgcctgatcacagtgaaccctattgttacggagaaggattctccggtgaacatcgaagcggagcccccttttggcgactcctacattatcattggggtcgagcccggccagctcaagctgaattggttcaaaaagggaagctctatcggccaaatgtttgaaaccacaatgagaggggccaaaagaatggctattcttggagataccgcctgggacttcggcagcctcgggggagtgtttacatccatcggcaaggccctccatcaggtgttcggggctatctatggcgccgcgttttctggagttagctggaccatgaaaattctgatcggcgtcattatcacgtggattgggatgaactcccgcagcacatctctgtccgtgagccttgtgctcgtcggaatcgtgaccctgtacctgggcgttatggtgcaggctgattctgggtgtgtcgtgtcctggaagaataaggagctcaaatgcggaagcggcatcttcattaccgacaacgttcacacatggaccgaacagtataagtttcaacctgagtccccctctaaactggccagcgccatccagaaggctcaggaagaggggatttgtggcatccggtccgtgacaagacttgagaatctgatgtggaaacagattacgccggaactcaaccacatcctggccgagaatgaagtcaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagttttcaccacaaacatctggctgaaacttaaagaaaagcaggacgctttttgtgactccaagctgatgagcgccgctattaaagataatcgcgccgtgcatgcggacatgggctattggatcgagtctgccctcaacgatacctggaagatcgagaaggctagcttcattgaagtcaagaattgccactggcctaaaagccatacactgtggtctaacggcgtgctggagagcgaaatgatcattcccaagaaccttgccgggccggtgtcccaacacaattaccggcctggataccacacccagatcgctggcccctggcatctcgggaagctggagatggacttcgatttttgtgacggaacgacagtcattgttaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaattcgccccctgaaggagaaagaagagaatctcgtgaacagcctggtgaccgccggacacggccaggtcgataatttctccctgggggtgcttggaatggctctctttctggaagagatgctgagaacacgggttggcaccaagcatgcgatcctcctggtggccgtctctttcgtgacacttatcaccgggaacatgagctttaaagacctgggaagagttgtggtcatggtgggcgctacgatggccgatgacattggcatgggggttacctatctcgccctgctggctgccttcaaggtgcgccctacatttgcggctggacttctgctccggaagctgacctccaaagagctcatgatgacaaccatcggcattgtcctgctttctcaaagcacgatccccgaaacagtgctggagctcaccgatgccctggccctggggatgatggtgcttaagattgtcagaaatatggaaaaataccagctggctgttacaatcatggccatcctctgcgtgcctaacgcggtggtcctgcagaatgcttggaaggtgtcctgtaccattctcgccgttgtgtctgtcagccccctgcttctgacctccagccagcagaagacggactggatccctctcgccctgacgattaagggactgaaccccaccgctatcttccttacaaccctgtctcgcacaaataaaaagagatcctggccgctcaacgaggccattatggctgtgggcatggttagcatcctggcctcttccctcctgaagaatgacatccctatgaccgggccccttgtggcgggaggcctgctgacggtctgctatgtgctcacaggccggagcgccgatctggaacttgagaaagctaccgacgtcaagtgggaggatcaggccgaaatttctgggtccagccctatcctgtccattaccatcagcgaggacggatctatgagcattaaaaacgaagaggaggaacagacactcaccatcctgattcgcacaggcctcctggtgatctccgggctttttcccatctctattccgatcacggctgccgcctggtacctgtgggaggttaagaaacagagagctggagtgctgtgggatgtcccttctccccctcccatgggcaaggcggaactcgaggacggggcctatcggattaagcaaaaaggaatcctgggctactcccagattggcgctggggtgtacaaggaaggaaccttccacacaatgtggcatgttacccgcggcgccgtgcttatgcacaaagggaagagaatcgagccctcctgggccgatgtcaaaaaggacctgatcagctatggaggcgggtggaagctcgagggagaatggaaagagggcgaagaggtccaggtgctggctctcgaacctggcaagaatccgcgggccgttcagacaaaacccgggctgtttaagaccaacacgggaaccattggcgcggtctcccttgatttctctcctgggacaagcggatcccccatcattgacaaaaagggcaaggtggtggggctgtacggaaacggcgtcgtgacccgcagcggcgcttatgtttctgccatcgcccaaacagagaaatccattgaggataatcctgaaatcgaggacgatatctttagaaagcggcgcctgaccattatggacctccaccccggggctggaaaaacaaagagatacctgcctgccatcgtgcgggaagcgattaaaagaggccttcgcacgctgatcctcgctccgacccgggtcgtggccgccgagatggaagaggctctgagagggctccccattcgctatcagacccctgccatcaaggctgagcataccggacgggaaattgttgacctgatgtgtcacgccaccttcacaatgagacttctgagccccgtgcgcgtccctaactacaatctgatcatcatggatgaggcgcatttcacggaccccgcctctattgctgcccggggctatatctccaccagagtggaaatgggggaggctgccggcatttttatgacagccaccccgcctggaagccgcgatcccttcccccagtccaacgctcctatcattgacgaggaacgggagatccccgaaagatcttggaatagcggccacgagtgggttacagattttaaggggaaaaccgtgtggttcgtcccttccatcaaggcgggaaacgacattgccgcttgcctccggaaaaatggcaagaaagtgatccaactgagccgcaagacgtttgattctgaatacgtgaaaacaagaaccaacgactgggatttcgtcgttaccacagacatttccgagatgggggccaattttaaggccgagcgggtgatcgatccgcgcagatgtatgaagcccgtgattcttaccgacggagaggaacgggtcatcctggctggccctatgcccgtgacacatagctctgccgcgcagagacgcgggcggatcggcagaaaccctaaaaatgaaaacgaccagtacatttatatgggagagcccctcgaaaatgatgaggactgcgctcactggaaggaggccaaaatgctgctggataacatcaataccccggaaggcattatccctagcatgttcgagcccgaacgcgagaaggttgacgccattgatggggaataccggctcagaggagaggctcgcaaaacgtttgtggaccttatgcggagaggcgatctgcctgtctggctggcctataaggtggcggccgaggggatcaactacgctgaccgcagatggtgtttcgatggaattaagaacaatcagatcctcgaagagaacgttgaagtggagatctggacaaaagagggcgaacggaagaaactgaagccccgctggcttgacgccagaatttattccgatcctctggctctcaaagagtttaaggagttcgccgctgggcggaagtctctgaccctgaatctcatcacagagatgggccgccttcccaccttcatgacgcagaagacaagagacgccctggataacctggcggtcctccacacagccgaagctggaggccgggcctacaatcatgctctgagcgagcttccggagaccctggaaacactcctgctgctcacccttctggccacagtgaccgggggaatttttctgttcctcatgtccggcagagggatcggaaagatgacgctgggcatgtgctgcattatcacagcctctatccttctgtggtatgctcagattcagcctcactggatcgcggccagcattatcctcgagtttttcctgattgtcctgctcatccccgaacccgagaaacagcgcacccctcaagacaaccagcttacctacgtggttatcgctattctgacagtggtggccgccaccatggctaatgaaatgggctttctggagaagaccaagaaggacctcgggctgggatccatcgccacgcagcagccggagagcaacattcttgatatcgacctgcggcccgcgtctgcctggaccctctacgctgtcgccacaaccttcgttacacctatgctgagacattccattgaaaatagctccgtgaacgtgtctctgaccgctatcgccaatcaagcgacggtcctcatgggccttgggaagggatggcccctgagcaaaatggatattggcgtgcctctgctcgccatcgggtgttattcccaggttaaccccatcaccctgacagctgcccttctgctcctggtggctcactacgccattatcggacctggcctgcaggctaaggccacccgcgaggcgcagaaacgggccgctgccggcattatgaagaatccgacagtcgacgggatcaccgtgattgatctcgaccccatcccttatgatcccaaatttgaaaagcaacttggacaggtcatgctgctgatcctctgcgtgacgcaggttctgatgatgagaacaacctgggctctttgtgaggccctgacactcgccaccggccctatttctaccctgtgggaagggaaccccggacggttctggaatacaacgatcgcggtgagcatggctaacatttttcgcggctcctacctggccggggctggactccttttcagcatcatgaaaaataccacaaacaccagacggggcacaggcaacattggggagaccctgggagagaagtggaagtctcgcctcaattccctcggcaaaagcgaatttcaaatctataagaaatctgggatccaggaggtcgacagaacgctggccaaggaaggaattaaacggggcgagacagatcaccatgccgtgtcccgcgggagcgctaaacttagatggttcgttgagcggaacatggtgaccccggaaggaaaggtcgtggacctgggctgcggccgcgggggatggtcttactattgtggcgggctcaaaagcgtgagagaggttaagggactgaccaaaggcgggcctggacacgaagaacccatccccatgtccacatacggctggaatctggtccggctccagtctggcgtggatgtgtttttcattcctcccgaaaagtgcgacacccttctgtgtgatatcggggagagctcccctaacccgacagtcgaggccggaagaacgctgcgcgttctcaatctggtggaaaactggcttaataacaatacccagttctgcattaaagtgctgaacccctacatgcctagcgtcatcgagaagatggaagcgctccaacggaagtatggcggggccctggtgagaaatcccctgtcccgcaactctacacatgagatgtactgggttagcaatgcttccggaaacatcgtgtctagcgtcaatatgatttcccggatgctcatcaacagatttaccatgcgccacaaaaaggccacatatgaacctgacgtggaccttggctctgggacccggaacattggaatcgagagcgagattcccaatctggatatcattggcaaaagaatcgaaaagatcaaacaggagcatgaaacgtcctggcactacgaccaggatcacccgtataagacctgggcttaccatggcagctatgagacaaagcagaccgggtctgcctccagcatggttaacggagtggtccgcctgctcacaaaaccttgggacgtgctgcccaccgtgacacaaatggcgatgaccgatacgacacctttcggccagcagcgggtctttaaggaaaaagttgacaccagaacccaggagcccaaggaggggaccaagaaacttatgaaaattacggccgaatggctgtggaaagagctcggaaagaaaaagacccctcgcatgtgtacacgggaagagttcaccagaaaagtgcgctctaatgctgccctgggcgctatctttacagatgagaacaagtggaaatccgccagagaagctgtggaggacagccggttctgggaactggtcgataaggagcgcaatctccacctggaagggaagtgcgagacctgtgtgtacaacatgatgggaaaaagagagaagaaacttggcgaatttggcaaggccaaagggtctcgggcgatttggtacatgtggctgggagccagattcctcgagtttgaagctctgggcttccttaatgaggaccattggttttcccgggaaaacagcctgtccggggttgagggagagggcctccacaagctggggtatatcctgcgcgatgtgagcaagaaagaaggcggagccatgtacgctgacgacacagccggctgggataccagaattacgctcgaggacctgaagaatgaagagatggtcaccaaccacatggaaggggagcataagaaacttgccgaggcgatcttcaaactgacatatcaaaataaagtggttcgggtgcagcgccccaccccgagaggaacagtcatggatatcatttctcggcgcgaccagagaggcagcgggcaagtgggaacctacggcctcaacacgtttacaaatatggaagctcagctgatccggcagatggagggggaaggcgttttcaagaacattcagcaccttaccgtgacagaggaggtcgccgtgcaaaattggctggcccgcgtcggaagagaacggctctcccgcatggctatctctggcgatgactgcgtggttaaacctctggatgacagattcgccaacgctctgaccgccctcaacgatatggggaagattcggaaagacatccagcagtgggagcccagcaagggatggaatgattggacacaggtgcccttttgctcccatcacttccatgaactgatcatgaaagacggccgcgtccttgtggtgccttgtagaaaccaagatgagctgattgggcgggcgagaatctctcagggagccggctggagcctccgcgaaaccgcttgcctggggaagtcctatgcccagatgtggtctcttatgtactttcaccggagagacctgcgcctcgctgccaatgcgatttgtagcgccgttccgtcccactgggtgcccacaagccggaccacatggtctatccatgctaagcacgagtggatgaccacagaggacatgctgaccgtctggaacagagtgtggattcgcgaaaatccttggatggaggataaaacgcccgttgaatcctgggaggaaatcccttatctgggcaagcgggaggaccagtggtgcggaagcctcattggcctgacatctagagccacctgggctaaaaacatccaagccgctatcaatcaggtgcgctcccttattgggaacgaggaatacaccgattacatgcccagcatgaagcggttcagacgcgaggaagaggaagccggagtcctgtggtga

SEQ ID NO: 20170 - RNA, 9876 nt, synthetic construct
  misc_feature 1..9876: note = derived and/or modified CDS sequence (opt5) from DENV-2__FM210216__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccacagagtgccccaataccaacagagcgtggaactctctcgaagtcgaggattacgggtttggagtgttcacaaccaacatttggctgaaacttaaagaaaagcaggacgccttttgtgactccaagctgatgagcgctgccatcaaagataatcgcgctgttcatgccgacatgggctattggatcgagtctgcgctcaacgatacatggaagattgagaaagcctccttcatcgaagtgaagaattgccactggcctaaaagccataccctgtggtctaacggcgtcctggagagcgaaatgattatccccaagaaccttgctgggccggtgtcccaacacaattaccggcctggataccacacgcagattgccggcccctggcatctcgggaagctggagatggacttcgatttttgtgacggaacaaccgtgatcgtcaccgaagattgcggcaacagagggcccagcctgcgcacaaccacggcttctggaaaactcattacagagtggtgctgtcggtcctgcaccctgcctccgcttagatatcggggcgaggacggctgttggtacgggatggaaatccgccccctgaaggagaaagaagagaatctcgttaacagcctggtgacagccggacacggccaggtggataatttctccctgggggtccttggaatggccctctttctggaagagatgctgagaacccgggtgggcacaaagcatgctatcctcctggttgcggtgtctttcgtcacccttattacggggaacatgagctttaaagacctgggaagagtggttgtgatggtcggcgccaccatggctgatgacatcggcatgggggtgacatatctcgccctgctggccgctttcaaggttcgccctacctttgccgcgggacttctgctccggaagctgacatccaaagagctcatgatgaccacgattggcatcgtgctgctttctcaaagcacaattcccgaaaccgtcctggagctcacagatgctctggccctggggatgatggtgcttaagatcgtgagaaatatggaaaaataccagctggccgtcaccatcatggctattctctgcgttcctaacgccgtgatcctgcagaatgcgtggaaggtgtcctgtaccattctcgctgtcgtgtctgttagccccctgcttctgacatccagccagcagaagacggactggatccctctcgccctgaccattaagggactgaaccccacagccatcttccttaccacactgtctcgcaccaataaaaagagatcctggccgctcaacgaggctatcatggccgtgggcatggtcagcattctggcttcttccctcctgaagaatgacatccctatgacggggccccttgtggccggaggcctgctgacagtttgctatgtgctcaccggccggagcgcggatctggaacttgagcgcgccaccgacgtcaaatgggaggatcaggctgaaatttctgggtccagccctatcctgtccattacaatcagcgaggacggatctatgagcattaagaacgaagaggaggaacagaccctcacaatcctgatcagaacgggcctcctggtgatttccgggctttttcccatctctattccgatcaccgccgctgcctggtacctgtgggaggtcaaaaagcagcgggccggagtgctgtgggatgttccttctccccctcccatgggcaaagctgaactcgaggacggggcgtatcgcattaagcaaaagggaatcctgggctactcccagatcggcgccggggtgtacaaagaaggaacattccacaccatgtggcatgtcacaagaggcgctgtgcttatgcacaaggggaaacggattgagccctcctgggccgatgttaagaaagacctgatcagctatggaggcgggtggaagctcgagggagaatggaaggagggcgaagaggtgcaggtcctggccctcgaacctggcaaaaatccgcgcgctgtgcagaccaagcccgggctgtttaaaacgaacaccggaacaattggcgccgtgtcccttgatttctctcctgggaccagcggatcccccatcattgacaagaaaggcaaggttgtcgggctgtacggaaacggcgtggtgacaagaagcggcgcgtatgtctctgctatcgcccaaaccgagaagtccatcgaggataatcctgaaattgaggacgatatctttcggaaacgcagactgacaattatggacctccaccccggggccggaaagacgaaacggtacctgcctgctatcgtgagagaagccattaagcgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaactacaatctgattatcatggatgaggcccatttcaccgaccccgcgtctattgccgctcgcggctatatctccacacgggtggaaatgggggaggccgctggcatttttatgaccgccacaccgcctggaagcagagatcccttcccccagtccaacgcccctatcatcgacgaggaacgggagattcccgaacgctcttggaatagcggccacgagtgggtcaccgattttaaagggaagacggtgtggttcgttccttccatcaaggctggaaacgacattgcggcctgcctccgcaaaaatggcaagaaagtgatccaactgagccggaagacatttgattctgaatacgtcaaaacccgcaccaacgactgggatttcgtggtgacaaccgacatttccgagatgggggctaattttaaggccgagagagtcatcgatccgcggagatgtatgaaacccgttatccttacagacggagaggaacgcgtgattctggccggccctatgcccgtgacccatagctctgctgcccagcggagagggcgcatcggccggaaccctaagaatgaaaacgaccagtacatttatatgggagagcccctcgaaaatgatgaggactgcgcgcactggaaggaggctaaaatgctgctggataacatcaatacgccggaaggcattatccctagcatgttcgagcccgaaagagagaaggtcgacgccattgatggggaataccgcctccggggagaggccagaaaaacatttgtggaccttatgcgcagaggcgatctgcctgtttggctggcttataaggtggccgcggaggggatcaactacgccgaccggcgctggtgtttcgatggaatcaaaaacaatcagattctcgaagagaacgtcgaagtggagatctggaccaaggagggcgaaagaaagaaactgaagccccggtggcttgacgctcgcatttattccgatcctctggccctcaaagagtttaaggagttcgctgccgggagaaaatctctgacactgaatctcatcaccgagatgggccggcttcccacgttcatgacccaaaagacaagagacgctctggataacctggccgttctccacaccgcggaagccggaggccgcgcttacaatcatgccctgagcgagcttccggagacactggaaaccctcctgctgctcacacttctggctaccgtgacagggggaatttttctgttcctcatgtccggccgggggatcggaaagatgacactgggcatgtgctgcatcattaccgcctctatccttctgtggtatgcccagattcagcctcactggatcgctgcgagcattatcctcgagtttttcctgatcgtcctgctcattcccgaacccgagaaacagagaacccctcaagacaaccagcttacatacgtggtcatcgccattctgaccgtggttgctgccacaatggccaatgaaatgggctttctggagaagacgaaaaaggacctcgggctgggatccatcgctacccagcagccggagagcaacattcttgatatcgacctgcgccccgcctctgcgtggacactctacgccgtggctaccacattcgtgacccctatgctgcggcattccattgaaaatagctccgtcaacgtttctctgacggccatcgctaatcaagccaccgtgctcatgggccttgggaaaggatggcccctgagcaagatggatatcggcgtgcctctgctcgcgattgggtgttattcccaggtcaaccccatcacactgaccgccgcccttctgctcctggtggcccactacgctattatcggacctggcctgcaggccaaggctacaagagaggcccagaaacgggcggccgctggcattatgaagaatccgaccgttgacgggatcacggtgatcgatctcgaccccattccttatgatcccaaatttgaaaagcaacttggacaggtcatgctgctgatcctctgcgtgacacaggtcctgatgatgcgcaccacatgggccctttgtgaggctctgaccctcgccaccggccctatttctacactgtgggaagggaaccccggaagattctggaatacgaccatcgccgtgagcatggcgaacatttttcggggctcctacctggctggggccggactccttttcagcatcatgaaaaatacaaccaacacacgcagaggcaccggcaacatcggggagacgctgggagagaagtggaaatctcggctgaatgctctcggcaagtccgaatttcaaatttataagaaaagcgggatccaggaggttgaccgcacactggccaaggaaggaattaaaagaggcgagaccgatcaccatgccgtgtctcgggggtccgctaaacttcgctggttcgtcgagagaaacatggtgaccccggaaggaaaagttgtggacctgggctgcggcagagggggatggagctactattgtggcgggctcaagaatgtccgggaggtgaagggactgacaaaaggcgggcctggacacgaagaacccatccccatgtctacctacggctggaacctggtgcgcctccagagcggcgttgatgtctttttcattcctcccgaaaagtgcgacacacttctgtgtgatatcggggagtcctctcctaatccgacggtggaggccggacggaccctgagagtgctcaacctggtcgaaaattggcttaacaataacacacagttctgcatcaaagttctgaatccctacatgcctagcgtgattgagaagatggaagcgctccaacgcaaatatggcggggccctggtgcggaaccccctgtccagaaatagcacccatgagatgtactgggtctccaacgcttctggaaatatcgtgagctccgttaacatgatttctcgcatgctcatcaaccggtttacaatgagacacaagaaggccacctatgaacctgacgtggaccttggcagcgggacgcgcaatattggaatcgagtccgagattcccaacctggatatcatcggcaaacggattgaaaagatcaaacaggagcatgaaacctcttggcactacgaccaggatcacccgtataagacatgggcttaccatggcagctatgagaccaaacagacagggtccgccagctctatggtcaatggagtggttagactgctcaccaagccttgggacgtgctgcccacagtcacccaaatggcgatgacggatacaacccctttcggccagcagcgcgtgtttaaggaaaaagtggacacccggacacaggagcccaaggaggggacgaagaaacttatgaaaattaccgccgaatggctgtggaaagagctcggcaagaagaagacacctagaatgtgtacccgcgaagagttcacaagaaaagtccggtccaacgctgccctgggcgctatctttaccgatgagaataagtggaaaagcgcccgcgaagctgttgaggactctagattctgggaactggtggataaggagcggaacctccacctggaagggaaatgcgagacatgtgtgtacaatatgatgggaaagagagagaagaaacttggcgaatttggcaaggccaaagggtcccgggcgatttggtacatgtggctgggagcccgcttcctcgagtttgaagctctgggcttccttaacgaggaccattggtttagcagagaaaattctctgtccggggtcgagggagagggcctccacaagctggggtatatcctgcgggatgtgagcaaaaaggaaggcggagccatgtacgctgacgacaccgccggctgggatacgcgcatcaccctcgaggacctgaagaacgaagagatggttacaaatcacatggaaggggagcataagaaacttgccgaggcgattttcaaactgacctatcaaaacaaagtggtcagagtgcagcggcccacaccgcgcggaaccgttatggatatcatttccagacgggaccagcgcggcagcgggcaagtgggaacgtacggcctcaatacatttaccaacatggaagctcagctgatcagacagatggagggggaaggcgtcttcaaaaatattcagcaccttacagtgaccgaggaggttgccgtgcaaaactggctggcccgggtcggacgcgaaagactctctcggatggctatcagcggcgatgactgcgtggtcaagcctctggatgaccgcttcgccaacgctctgacggccctcaatgatatggggaagatcagaaaagacattcagcagtgggagccctccaagggatggaacgattggacccaggtgcccttttgctctcatcacttccatgaactgatcatgaaagacggccgggttcttgtggtcccttgtagaaatcaagatgagctgattgggcgcgcgcggatcagccagggagccggctggtccctcagagaaacagcttgcctggggaagtcttatgcccagatgtggagccttatgtactttcaccgccgggacctgagactcgctgccaacgcgatttgttccgccgtgccgtctcactgggtgcccaccagccgcacaacctggtccatccatgctaaacacgagtggatgacaaccgaggacatgctgacggtttggaatcgggtgtggattagagaaaacccttggatggaggataagacacccgtcgaaagctgggaggaaatcccttatctgggcaagcgcgaggaccagtggtgcggatctctcatcggcctgacctcccgggccacctgggctaaaaatattcaagccgctatcaaccaggtgagaagccttattgggaatgaggaatacacagattacatgccctctatgaagcgcttccggagagaggaagaggaagccggagttctgtggtga

SEQ ID NO: 20171 - RNA, 9876 nt, synthetic construct
  misc_feature 1..9876: note = derived and/or modified CDS sequence (opt5) from DENV-2__FM210217__SS-prME
  source 1..9876: mol_type = other RNA
accgccggcgtgatcattatgctgatccccacagctatggccttccacctcacgaccagaaacggggaacctcatatgattgtcggacggcaggaaaagggcaagagcctgctttttaagacagaagacggggttaatatgtgcaccctgatggcgatcgatctcggagaactgtgtgaagacacaattacctacaagtgcccccttctgcgccaaaacgaacccgaggatatcgactgttggtgcaattccacatctacctgggtgacgtatggcacctgtacaaccacaggggatcacagacgggagaagcgcagcgtggctctcgtccctcatgtgggaatgggcctggaaaccagaacggagacatggatgtcctctgaaggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgactttgtcgagggggtgtctggaggcagctgggttgatatcgtgctcgaacacgggtcctgtgtcaccacaatggccaagaataagcccaccctggacttcgagcttatcaaaacagaagctaagcagcctgccaccctgagaaaatattgcattgaggcgaagctcacgaacacaaccaccgaaagccggtgtccgacacaaggagagccctctctgaatgaggaacaggataaacgctttgtgtgcaagcattccatggtggacagaggctggggcaacgggtgtggactgttcggcaaagggggcatcgttacctgcgccatgtttacatgcaaaaagaatatggagggcaaaattgttcagcctgaaaacctcgagtacacgatcgtgattacaccccacagcggggaagaacatgctgtgggaaatgatacaggcaagcacggcaaagagatcaagatcacccctcagtctcccattacagaagccgagctgaccgggtatggaacggtcaccatggaatgttccccgcggacaggccttgacttcaacgagatggtgctgctccaaatggaagataaggcttggctggttcaccgccagtggtttcttgacctgcctctcccctggctgcctggggccgacacccagggaagcaattggatccagaaggagacactggtgaccttcaagaacccccatgccaaaaagcaagatgtcgtggttctcggctctcaggagggggctatgcacacggcgctgacaggcgccaccgaaattcagatgtccagcggaaatcttctgtttacaggccatctcaaatgcagactgcggatggacaaacttcaactgaaagggatgtcctactctatgtgtaccggaaagttcaagatcgtgaaagagattgctgaaacccagcacggcacaatcgtcatcagagtgcagtatgagggggatggaagcccctgcaagattcctttcgagatcatggacctcgaaaaacgccatgtcctgggccggctgattacggtgaacccgatcgttaccgagaaggattcccccgtgaacattgaagccgagcctccctttggggacagctacatcattatcggcgtcgaacctggacagctcaaactgaattggttcaagaagggatcttccatcgggcaaatgtttgagacaaccatgagaggagccaaacgcatggctattcttggcgatacagcctgggacttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgattccggatgtgtggtcagctggaagaataaagagctcaagtgcggctctgggattttcatcacagacaacgtgcacacctggacagaacagtacaagtttcaacccgagtccccgagcaaactggcttccgccattcagaaggcgcatgaagagggcatctgtggaatcagatctgttacgcgccttgaaaatctgatgtggaaacagattacccctgagctcaaccacatcctgagcgagaatgaagtgaagctgacaattatgaccggcgatatcaaagggattatgcaggccggaaagcggtcccttagaccccaacctacagagctcaaatattcttggaagacctggggcaaggctaaaatgctgagcacggaatcccataaccagaccttcctgatcgacgggcccgagacagccgaatgccctaataccaaccgcgcttggaatagcctcgaggtcgaggactacggatttggcgtgttcacaaccaacatctggctgaaacttcgggaaaaacaggatgtcttttgtgactctaagctgatgtccgccgcgattaaagataatagagccgtgcacgctgacatgggctattggatcgagagcgccctcaacgatacatggaagatggaaaaggcttctttcattgaggtcaaatcctgccactggcccaagagccataccctgtggtctaatggggtgctggagagcgaaatgatcattccgaaatccttcgccggacctgttagccagcacaactaccgccccggctattacacgcaaacagccgggccctggcatcttggaaagctcgagatggactttgatttctgtgaaggcaccaccgtggtcgtgacagaggactgcgggaaccggggaccttctctgagaaccacgacagcttccggcaaactgatcaccgaatggtgctgtcggagctgcacactcccgcccctgcgctacagaggcgaggatgggtgttggtatggaatggagattcggcctcttaaggaaaaggaggaaaatctggtgaactccctcgtcaccgcgggccacgggcagatcgacaatttttctctgggagttctgggcatggcccttttcctcgaggaaatgctgagaacacgcgtggggaccaaacatgctatcctgctcgtggccgtcagctttgtgacgctgattaccggaaacatgtccttccgggatcttggcagagttatggtgatggtcggcgccgctatgacagacgatatcgggattggagtgacctacctggccctcctggcggcttttaaggttcgccccacattcgccgccggcctgcttctgagaaaactcacctctaaggagctgatgatggctacgatcgggattgccctcctgagccagtccacaatccctgagaccatccttgaactgacagacgcgctcgctctgggaatgatggtgctgaaaattgtccggaatatggagaagtatcaacttgccgtgaccatcatggccatttcttgcgttcccaacgctgtgatcctgcagaatgcctggaaggtcagctgtaccattctcgctacagtgtccgtgagccctctgctcctgacgtcttcccagcagaaagccgactggatcccccttgcgctgaccatcaagggcctcaacccgacagccatttttctgaccacactgagccgcacctctaaaaagagatcctggcctcttaatgaagctatcatggccgtcgggatggttagcattctggcttcttccctcctgaaaaacgatatccccatgacgggacctctcgtggccggcggcctgcttacagtgtgctacgtcctgaccgggcggagcgccgacctggagctcgaacgcgctaccgatgtgaagtgggaggaccaagcggagatttccggaagctctcccatcctgagcattacaatcgccgaagatggctccatgtctatcaaaaatgaggaagaggagcagacccttacaattctgatcagaacggggctcctggttattagcggactcttcccggtgtccatccctattaccgctgccgcctggtatctgtgggaagtcaagaagcagcgggctggcgtgctttgggacgttccctctcctccgcccgtggggaaagccgagctggaagatggagcgtaccgcatcaagcagaaaggcatcctgggctatagccaaattggggctggagtctacaaggagggcacatttcacaccatgtggcacgtgacaagaggggccgtcctcatgcatcggggaaaacgcatcgaaccttcctgggccgacgtgaagaaggatctgatttcttacggcgggggatggaaacttgagggcgagtggaaggaaggcgaggaagttcaggtgctggctctcgagccggggaaaaaccccagagccgtccagaccaagcctggactgttcaaaacgaataccggcacaatcggggcggtgagcctcgacttttcccccggaaccagcggctctcctattgttgatcggaaggggaaggtggtcggactgtatggcaacggcgtggtgacaagatccggggcttacgttagcgccatcgcccagaccgaaaaatctatcgaggacaatcccgagattgaagatgacatcttccgcaagaaacggcttacaattatggacctgcaccctggagctggcaagacgaaaagatatctgccggccatcgtccgcgaggctattaagcgggggctcagaaccctgatccttgcccccacacgcgtggtggcggccgaaatggaggaagctctgcggggactccctattagataccaaacccccgccatccgcgctgagcataccggccgggagatcgtcgatctgatgtgtcacgccacattcacgatgagactcctgtcccctgtgcgggttcccaactataaccttattatcatggacgaagcccattttaccgatccggctagcattgcggcccgcgggtacatctccacaagagtggagatgggcgaagctgccggaattttcatgaccgccacacctcccggctctaaggacccctttcctcagagcaatgctcccatcatggatgaggagcgggaaatccctgagcgctcctggaacagcgggcacgaatgggtcaccgacttcaaaggaaagacggtgtggtttgttccgtctattaaagccggcaatgatatcgcggcttgcctgagaaagaacgggaaaaaggtgattcagctgtcccggaagacattcgacagcgagtatgtcaaaaccagaaccaatgattgggactttgtggttacaaccgatatctctgaaatgggagccaacttcaaggccgagcgcgtgattgacccccggagatgtatgaaacctgtcatcctcacagacggcgaggaacgcgtgatcctggctgggcccatgcctgtgacccacagctccgccgcgcaacggagaggccgcattggacggaatcccaagaacgagaatgatcagtacatctacatgggcgaaccgcttgagaacgacgaagattgcgcccattggaaagaggctaagatgctgctcgacaatattaacacgcctgaggggatcattccctctatgtttgaacctgagagagaaaaagtcgatgccatcgacggagagtatcgcctgagaggcgaagctcggaagacattcgttgatctgatgcgcagaggggacctccccgtgtggcttgcctaccgggtggctgccgagggaattaattatgcggatcgcagatggtgttttgacggcgtcaagaacaatcagatcctggaggaaaacgtggaggttgaaatctggaccaaagagggggagcggaagaaactgaagcctagatggctcgatgcccgcatttacagcgaccccctggctcttaaagagttcaaggagttcgccgctggccggaagtccctgacactcaacctgatcaccgaaatgggaagactgccgacgtttatgacccagaaagcccgcgatgccctcgacaatcttgctgtgctgcacacagcggaggccggcgggcgggcttataaccatgccctgtctgaactccctgagaccctggagacacttctgctcctgaccctgctcgccacagtcaccggaggcattttcctttttctgatgagcgggaagggagtgggcaaaatgacgctgggcatgtgctgcatcattacagcttccatcctcctgtggcacgcccaaatccagccccactggattgcggccagcatcattcttgagttctttctgatcgttctcctgattcccgagcctgaaaagcagagaaccccgcaggacaatcaactgacctacgtggtcatcgctatcctcacagtggtcgccgctaccatggccaacgagatggggttccttgagaagaccaagaaggatctgggactgggctctattgcgacgcaggagcccgagtccaatatcctcgacattgatctgcggcctgccagcgcttggaccctttatgccgtggctacaacctttgttacacccatgctgcgccattccatcgaaaactctagcgtgaatgtgtccctcaccgccattgctaaccaggccacggtcctgatggggctgggaaaaggctggcctctctctaagatggacatcggggttccccttctggcgattggatgttacagccaggtgaatcctatcaccctgacagccgctctcctgcttctggtggcccactacgctatcattggcccgggcctccaagccaaagccaccagagaggcgcagaagcgggctgccgctgggatcatgaaaaaccccacagtcgatggaattaccgtgatcgacctggatcctattccctatgaccctaagttcgaaaagcagctgggccaggttatgctccttatcctgtgcgtgacgcaagtcctgatgatgcgcacaacctgggccctctgtgaggccctgacacttgctaccgggcccatctccaccctgtgggaaggaaatccgggcagattttggaacacaacgattgccgtgagcatggcgaatatcttccgggggtcttacctcgccggagctggcctgctgttttccattatgaaaaacaccacaaatacccgcagaggcacagggaacatcggagagaccctcggcgagaagtggaaaagccggcttaatgccctggggaagtctgagttccagatttataaaaagtccggaatccaggaggtcgatcgcacgctggctaaagaaggcatcaagagaggggagacagaccatcacgccgtgagccggggatctgcgaagctcagatggtttgttgagcgcaacatggtgacccctgaaggcaaagtcgtggatctgggctgcgggcggggaggctggagctactattgtgggggacttaagaacgttagagaggtgaaaggcctgaccaaagggggacccggccatgaagaacccattcctatgtccacatacggctggaatctcgtccgcctgcaatctggggtggacgtgttcttcacaccccctgaaaaatgcgataccctgctctgtgacatcggagagagctccccgaaccccacgattgaggccggccggacccttagagttctgagcctggtcgaaaattggctcaacaatgacacacagttttgcatcaaggtgctgaacccttatatgccctccgtgattgagaagatggaaacccttcagcgcaaatacgggggagctctggtccggaatcctctctctagaaacagcacacacgagatgtactgggtttccaatgccaccggcaacatcgtgtctagcgtgaatatgatctcccgcatgctgattaaccggttcacgatgaagcacaaaaaggctacctatgaacccgatgtcgacctggggtctggaacaagaaatatcggcattgagagcgagatcccgaacctcgatattatcggcaaacgcattgaaaagatcaagcaggagcatgaaacctcctggcactacgaccaagatcatccttataaaacatgggcctaccacgggagctatgagaccaagcagacaggatctgcttccagcatggtgaatggcgttgtgcggcttctgaccaaaccctgggacgtcgtgcctatggttacgcagatggccatgacagataccaccccctttgggcagcaaagagtgttcaaggaaaaagtcgacacacgcacgcaggagcctaaggagggaaccaagaaactgatgaagatcacagcggaatggctctggaaagagctgggcaagaaaaagacccccagaatgtgtacacgggaagagtttacccgcaaagtgagatctaacgccgctcttggggccattttcacagatgagaacaagtggaagtccgctcgggaagccgtggaggacagcagattttgggaactggtcgataaagagcggaatctccacctggaaggaaagtgcgagacctgtgtttacaacatgatgggcaaacgcgagaagaaactgggcgagttcgggaaggccaagggatctagagcgatctggtatatgtggctcggcgctcggtttctggagttcgaagcccttgggtttctgaatgaggaccattggttctcccgcgaaaacagcctctccggagtggagggcgaggggctgcacaaacttggctacattctgagagacgtgagcaagaaagaaggaggcgccatgtacgctgatgacacggccgggtgggatacccggatcacactcgaggacctgaagaatgaagagatggtcaccaaccatatggaaggagagcacaaaaagctggctgaggccatttttaagctcacatatcagaataaagtggttcgcgtgcagagaccgacccctcggggcacggtcatggatatcatctctcgcagagaccaacgggggagcggacaggtgggcacatacgggctgaacaccttcacaaatatggaagcgcagcttattcgccaaatggagggcgaaggaatcttcaagtccattcagcatctgaccgccacggaggagatcgctgttcagaactggctcgccagagtgggccgggaacgcctgtctagaatggctattagcggggatgactgcgtcgtgaaaccccttgatgaccggtttgcctccgcgctgaccgccctcaatgatatgggaaaggttagaaaagacatccagcaatgggagccctctcgcggctggaacgattggacacaggtgcctttctgcagccaccactttcatgaactgatcatgaaggacgggcgggtcctggtggtcccgtgtagaaatcaggacgagctcattggacgcgctcggatctcccagggcgccgggtggtctctgaaggaaaccgcttgccttggcaaaagctatgcccaaatgtggtccctgatgtacttccacagacgcgatctccggctggctgccaacgcgatttgtagcgccgtgccctctcattgggttcctacatccagaaccacatggagcatccacgctaagcacgagtggatgaccacggaggacatgcttacagtgtggaatcgcgtctggattcaggaaaacccctggatggaggataaaacccctgtggaatcttgggaggaagtgccctatctgggaaagcgggaggaccagtggtgcggctccctcatcgggctgaccagcagagccacatgggccaaaaacattcagaccgctatcaatcaagttcgctccctgatcggaaacgaggaatacacagattatatgccttctatgaagcggtttagacgggaggaagaggaagccggcgtgctctggtga

SEQ ID NO: 20172 - RNA, 9876 nt, synthetic construct
  misc_feature 1..9876: note = derived and/or modified CDS sequence (opt5) from DENV-2__JX286524__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaagagcttcgccggaccggtgtctcagcacaactaccgccctggctatcatacccaaacagctgggccctggcaccttggaaagctcgaaatggattttgacttctgtgagggcaccacggtcgtggtgacagaagattgcgggaaccggggaccctccctgagaaccacaaccgccagcggcaaactgattacagagtggtgctgtcggtcctgcaccctccctccgctgcgctacagaggcgaggacgggtgttggtacggaatggaaatccggccccttaaggagaaggaagagaatctggtcaactctctcgttacggccggccatgggcagattgataattttagcctgggagtgctgggcatggctcttttcctcgaagagatgctgagaacccgcgtggggacaaaacacgcgatcctgctcgtcgccctgtcctttgtgacccttatcacaggaaacatgtctttccgggacctgggcagagttatggtgatggtcggcgctaccatgacggatgacattgggatgggagtgacatatctcgccctgctggccgcttttaaggttcgccctaccttcgccgcgggccttctgctcagaaaactgacaagcaaggagctcatgatggctaccatcgggattgccctgctttcccagtctaccctgcccgaaacaatcctcgagctgacggatgccctggctcttggaatgatggccctgaaaattgtgcggaatatggaaaagtaccaactcgcggtcaccatcatggctatcagctgcgtgcctaacgccgttattctgcagaatgcctggaaggtgtcctgtacaatcctcgctgccgtcagcgtgtctcccctgcttctgacctccagccagcagaaagctgactggattcctctcgccctgacaatcaagggcctgaaccccaccgcgatttttcttacgacactgtctcgcacctccaaaaagagaagctggccgctcaatgaggccatcatggctgtggggatggtctctatcctggcctccagcctcctgaaaaacgacattcctatgaccggaccccttgttgctggcggcctgctgacagtgtgctatgtgctcaccgggcggtccgccgatctggaacttgagcgcgccgctgacgtcaagtgggaggatcaagcggaaatcagcggatctagccctattctgtccatcacaatttctgaggacggcagcatgtccatcaaaaatgaagaggaggaacagacgctcaccattctgatcagaacagggctcctggtgatctctggagttttccccgtgagcattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctacagccaaattggggcgggagtctataaagaaggcacatttcacaccatgtggcatgtgacgagaggggctgtcctgatgcaccgcggaaagagaatcgagcccagctgggccgatgtgaaaaaggaccttatctcctacggcgggggatggaagctggagggcgaatggaaagagggcgaagaggttcaggtgctcgccctggaacctgggaagaacccgcgggctgtccagaccaaacccggaattttcaagacaaataccggcacaatcggggccgtgagcctcgatttttctcctggaacctccggcagccccattgttgacagaaaagggaaggtggtcggactgtacggcaacggcgtggtgacacgctctggggcgtatgtttccgctatcgcccagacggaaaagtccattgaggataatcctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgtcccccgtgcgcgttcctaactacaaccttatcatcatggatgaggcccactttaccgaccccgcctctattgctgcgagagggtatatcagcacacgggtggaaatgggcgaggccgctggaattttcatgaccgccacgccgcctggctcccgcgatccctttccccagagcaatgcccctatcatggacgaggaaagagagattcccgaacggtcttggaactccgggcacgagtgggtcacagatttcaagggaaagaccgtgtggtttgttcctagcatcaaagctggcaatgacatcgccgcgtgcctgagaaagaacgggaaaaaggtgattcagctgtctcgcaaaaccttcgatagcgaatacgtcaagacacgggctaatgactgggattttgtggttaccacagacatctccgagatgggagccaacttcaaggccgagagagtgattgatccgcgccggtgtatgaaacccgtcatcctcaccgacggcgaagagagagtgattctggctgggcctatgcccgtgacgcattctagcgccgcgcaacgccggggcagaatcggacgcaatcctaagaacgaaaatgaccagtatatctacatgggcgagccccttgaaaacgatgaggactgcgcccactggaaagaggctaagatgctgctcgataatattaacacaccggaagggatcattccttccatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaattacgcggacagaaagtggtgttttgatggcatcaagaacaatcagattctggaagagaacgtcgaagtggagatctggacaaaagagggggaacggaagaaactgaagcccagatggctcgacgcccgcatctattctgatcctctggctcttaaagagttcaaggagttcgccgctggcagaaagagcctgaccctcaacctgattacggagatgggaagactgcccacctttatgacacagaaagcccgcaatgccctcgacaaccttgctgttctgcataccgcggaagtgggcgggaaggcctacacacacgctctgtccgagctcccggagaccctggaaacacttctgctcctgaccctgctcgccgccgtcacgggaggcatcttcctttttctgatgagcgggaaaggaattggcaagatgacactgggcatgtgctgcatcattaccgcttctatcctcctgtggtatgcccaaatccagcctcactggattgcggcctccatcattcttgagttctttctgatcgtgctcctgattcccgaacccgagaaacagcggacccctcaggataatcaactgacatacgttgtgatcgctatcctcaccgtcgtggccgctacaatggccaacgaaatggggttccttgagaagacgaagaaagacctgggatttggcagcattaccacacaggagtccgaatctaatatcctggacattgatctcagaccggcgagcgcctggaccctgtatgctgtcgccacaaccttcgtgacgcccatgcttcggcattccatcgagaactctagcgttaatgtgtccctgaccgctattgccaaccaggctacagtgctcatggggctgggaaagggctggcctctgagcaaaatggacatcggggtccccctccttgccattggatgttactctcaggttaatcctatcaccctgacagcggccctgctcctgcttgtggctcactacgccatcattggccccggcctgcaagctaaggccacccgcgaagcccagaaaagagcggctgccgggatcatgaagaaccctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctccacgctttgggagggaaatcctggccgcttctggaacaccacaattgctgtcagcatggccaatatctttagagggtcttacctggcgggagccggcctcctgttctccattatgaagaacaccacaaatacccggcgcggcacggggaacgtgggagaaacactgggcgagaaatggaaaagcagactcaatgctcttgggaaatctgaatttcagatctataagaaaagcggcattcaggaggtcgaccggaccctggccaaggagggcatcaagcgcggggaaaccgatcatcacgctgtgtccagaggatctgccaaactgcggtggttcgttgagagaaacatggtgacacccgaaggcaaggtcgtggacctcggctgcgggcgcggaggctggagctactattgtgggggactgaaaaacgttcgggaggtgaagggccttaccaaagggggaccgggccatgaggaacctatccccatgtccacatacggctggaatctggtcagactccaaagcggggtggatgtgttctttacgccccctgagaagtgcgacaccctgctgtgtgatattggagaatcctctcccaaccctacaatcgaggcgggccgcaccctccgggttcttaatctggtcgaaaactggctgaataacaatacacagttctgcattaaggtgctcaacccgtatatgcccagcgtgatcgagaaaatggaaaccctgcagagaaagtacgggggagcccttgtccgcaatcctctgtcccggaactctacgcacgagatgtactgggttagcaatgctaccggcaacattgtgtcctctgtgaatatgatcagcagaatgctcatcaaccgctttacaatgaaacacaagaaagccacctatgagcccgacgtcgatctggggtccggaacacggaatattggcatcgaaagcgagattcctaacctggacatcattggcaagagaatcgaaaagattaaacaggagcatgaaacctcttggcactacgaccaagatcatccctataagacatgggcttaccacgggtcctatgagaccaaacagacgggaagcgcctcttccatggtgaacggcgttgtgcgcctccttacaaagccgtgggacgtcgtgcctatggttacccagatggctatgaccgatacaacgcccttcgggcagcaacgggtgtttaaagagaaggtcgacaccagaacacaggaacctaaggagggaaccaaaaagctgatgaaaatcacagccgaatggctgtggaaggagctcggcaaagagaagacaccccgcatgtgtacaagagaagagttcacccggaaagtgcgcagcaatgcggccctgggggctgtgtttacggatgaaaacaagtggaagtctgccagagaggctgtcgaagacggacggttctgggagcttgttgatagagagcggaatctgcacctcgaaggcaaatgcgagacctgtgtgtacaacatgatgggcaagcgcgagaagaagctgggggagtttggaaaagccaagggctccagagccatctggtatatgtggctgggggcgcggttcctcgaatttgaggctctgggattccttaatgaggaccattggtttagccgcggcaactccctgagcggggtggaaggcgagggactccacagactgggctacattcttcgggaagtcgggaagaaagagggaggcgccatgtacgccgatgacacagctgggtgggatacccgcatcacactggaagacctcaagaatgaggagatggtgaccaaccatatgaaaggagaacacaagaaactggccgaggctattttcaagctgacgtatcagaataaggttgtgagagtccagcggcctacaccccgcggcaccgtgatggacatcatttctagaaaagatcaacgggggagcggccaggttggaacatacggcctcaacaccttcacgaatatggaagcccagctgatccgccaaatggagggggagggaatctttaagtccattcagcatcttaccgcgacagaagagatcgccgtgcagaactggctggctagagtcggccgggaacgcctctctagaatggccattagcggggacgattgcgtggttaaaccgatcgacgatcggttcgcttccgccctgaccgcgcttaatgacatgggaaaggtgagaaaagatattcagcaatgggagccttctcgcggctggaacgactggacacaggtccccttttgcagccaccacttccatgaactggtgatgaaggatgggcgggtcctcgtggttccctgtagaaatcaggacgagctgatcggccgcgcccggatctcccagggagctggctggtctctgaaggagaccgcctgcctcgggaaaagctatgctcaaatgtggacactgatgtactttcacagacgcgatcttcggctggccgctaacgccatttgttccgcggtgcctagccattgggtcccgacctctagaacgacatggtccatccacgccaagcacgaatggatgaccaccgaggacatgctcgctgtgtggaaccgcgtgtggattcaggaaaatccctggatggaggataaaacacctgttgaaagctgggaggaggtgccctatctgggaaagcgggaagaccagtggtgcggctctcttatcgggctgacctccagagccacatgggccaaaaacattcagacggctatcaatcaagtccgcagcctcattggaaacgagggctacaccgactatatgccttccatgaagcggttcagacgggaagaggaagaggccggggtgctgtggtga

SEQ ID NO: 20173 - RNA, 9876 nt, synthetic construct
  misc_feature 1..9876: note = derived and/or modified CDS sequence (opt5) from DENV-2__JX286520__SS-prME
  source 1..9876: mol_type = other RNA
acagccggcgtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaatcgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcgtcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtatcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccctgagctttgtgacacttattaccggaaatatgtccttccgggacctgggcagagttatggtgatggtcggcgctacaatgaccgatgacatcgggatgggagtgacgtatctcgccctgctggccgcttttaaggttcgccctacattcgccgcgggccttctgctcagaaaactgacctctaaggagctcatgatggctacaattgggatcgccctgcttagccagtccaccctgcccgaaaccattctcgagctgacagatgccctggctcttggaatgatggccctgaaaatcgtgcggaacatggaaaagtaccaactcgcggtcacgatcatggctatttcttgcgtgcctaatgccgttatcctgcagaacgcctggaaggtgagctgtaccattctcgctgccgtctccgtgagccccctgcttctgacatcttcccagcagaaagctgactggatccctctcgccctgaccattaagggcctgaatcccacagcgatctttcttaccacgctgagccgcacatctaaaaagagatcctggccgctcaacgaggccatcatggctgtggggatggtcagcattctggcctcttccctcctgaaaaatgacatccctatgaccggaccccttgttgctggcggcctgctgaccgtgtgctatgtgctcacagggcggagcgccgatctggaacttgagcgcgccgctgacgtcaagtgggaggatcaagcggaaatttccggaagctctcctatcctgagcattaccatctccgaggacggctctatgagcattaaaaacgaagaggaggaacagacactcacgatcctgatcagaaccgggctcctggtgatttccggagttttccccgtgtctatcccgattacagccgctgcctggtacctttgggaggtcaagaagcagcgggccggcgtgctgtgggatgttccttctccccctcccgtggggaaagctgaactggaggacggagcctatcgcatcaagcagagaggcattctcggctactcccaaatcggggcgggagtctataaagaaggcacctttcacacaatgtggcatgtgaccagaggggctgtcctgatgcaccgcggaaagagaatcgagccctcctgggccgatgtgaaaaaggaccttattagctacggcgggggatggaagctggagggcgaatggaaagagggcgaagaggttcaggtgctcgccctggaacctgggaagaatccgcgggctgtccagacgaaacccggaatcttcaagaccaacacaggcaccattggggccgtgtccctcgattttagccctggaacatctggctcccccatcgttgacagaaaagggaaggtggtcggactgtacggcaatggcgtggtgacccgcagcggggcgtatgtttctgctattgcccagacagagaagtccatcgaggataaccctgaaatcgaggacgatattttccggaaaaagagacttacgatcatggacctgcatcccggagccggcaaaaccaagcgctacctgcctgctattgtccgggaagccatcaaaagagggctccgcacactgattcttgctccgacccgggtggtggccgcggagatggaagaggccctgagaggactccccatccgctatcaaacccctgctattcgggccgagcacacaggcagagaaatcgtcgacctgatgtgtcatgctacgttcaccatgcggctcctgagccccgtgcgcgttcctaactacaatcttatcattatggatgaggcccactttacagaccccgcctccatcgctgcgagagggtatatttctacccgggtggaaatgggcgaggccgctggaatcttcatgacagccaccccgcctggcagccgcgatccctttccccagtccaacgcccctattatggacgaggaaagagagatccccgaacggagctggaactctgggcacgagtgggtcacggatttcaagggaaagacagtgtggtttgttccttccatcaaagctggcaacgacattgccgcgtgcctgagaaagaatgggaaaaaggtgatccagctgagccgcaaaaccttcgattctgaatacgtcaagacccgggctaacgactgggattttgtggttacaaccgacattagcgagatgggagccaatttcaaggccgagagagtgatcgatccgcgccggtgtatgaaacccgtcattctcacagacggcgaagagagagtgatcctggctgggcctatgcccgtgacccattcctctgccgcgcaacgccggggcagaatcggacgcaaccctaagaatgaaaacgaccagtatatttacatgggcgagccccttgaaaatgatgaggactgcgcccactggaaagaggctaagatgctgctcgataacatcaatacgccggaagggattatccctagcatgtttgagcccgaaagagagaaagtcgacgccattgatggagaataccggctgcgcggcgaggctagaaagacattcgttgacctgatgcggcgcggggatctccctgtgtggcttgcctataaagtggctgccgagggaatcaactacgcggacagaaagtggtgttttgatggcattaagaataaccagatcctggaagagaacgtcgaagtggagatctggaccaaagagggggaacggaagaaactgaagcccagatggctcgacgcccgcatttattccgatcctctggctcttaaagagttcaaggagttcgccgctggccggaagtctctgacactcaatctgatcaccgagatgggaagactgcccacgtttatgacccagaaagcccgcaacgccctcgacaatcttgctgttctgcatacagcggaagtgggcgggaaggcctacacccacgctctgagcgagctcccggagacactggaaacccttctgctcctgacactgctcgccgccgtcaccggaggcattttcctttttctgatgtccgggaaaggaatcggcaagatgacgctgggcatgtgctgcattatcacagctagcatcctcctgtggtatgcccaaattcagcctcactggatcgcggcctctattatccttgagttctttctgattgtgctcctgatccccgaacccgagaaacagcggacccctcaggataaccaactgacctacgttgtgatcgctattctcacagtcgtggccgctaccatggccaatgaaatggggttccttgagaagacaaagaaagactttggattcggctccatcacgacccaggagagcgaatccaacattctggacatcgatctgagaccggcgtctgcctggacactctatgctgtcgccaccacatttgtgacccccatgctgcggcatagcattgaaaatagctctgttaacgtgagccttacggctatcgccaatcaggctaccgtgctgatggggctcggaaagggctggcctctgtccaaaatggacattggggtccccctgctcgccatcggatgttacagccaggttaaccctatcacacttaccgcggccctgctgctcctggtggctcactacgccattatcggccccggccttcaagctaaggccacacgcgaagcccagaaaagagcggctgccgggattatgaagaatcctaccgtggatggaatcacggtcattgacctggagccgatcccctatgatcctaagttcgaaaaacagctcggccaggtgatgctgctgatcctctgcgttacacaagtgcttatgatgcggaccacatgggctctgtgtgaggccctgaccctcgccaccgggcccatttctacactgtgggagggaaaccctggccgcttttggaatacgaccatcgctgtctccatggccaacattttcagagggagctaccttgcgggagccggcctgctcttttctatcatgaagaatacaaccaacacacggcgcggcaccgggaatgtgggagaaacgctgggcgagaaatggaagtccagactgaacgctctcgggaaaagcgagttccagatttataagaaatctggaatccaggaggtcgaccggacacttgccaaggagggcatcaagcgcggggaaaccgatcatcacgctgtgagcagaggatccgccaaactgcggtggttcgttgagagaaacatggtgacccccgaaggcaaggtcgtggacctgggctgcgggcgcggaggctggtcttactattgtgggggactcaaaaatgttcgggaggtgaagggcctgacaaaagggggaccgggccatgaagaacctattcccatgagcacctacggctggaaccttgtcagactgcaatccggggtggatgtgtttttcacaccccctgagaagtgcgacacgctcctgtgtgatatcggagaaagctcccccaatcctaccattgaggcgggccgcacactgcgggttctcaaccttgtcgaaaattggctgaacaataacacccagttttgcatcaaggtgctgaatccgtatatgccctctgtgattgagaaaatggaaacactccagagaaagtacgggggagccctggtccgcaaccctcttagcagaaattccacccacgagatgtactgggtttctaacgctacgggcaatatcgtgagctccgtgaacatgatctctagaatgctgattaatcgcttcaccatgaaacacaagaaagccacatatgagcccgacgtcgatctcgggagcggaacccggaacatcggcattgaatccgagatccctaacctggacattatcggcaagagaattgaaaagatcaaacaggagcatgaaacaagctggcactacgaccaagatcatccctataagacctgggcttaccacgggtcttatgagacaaaacagaccggatccgccagctctatggtgaatggcgttgtgcgcctgctcacgaagccgtgggacgtcgtgcctatggttacacagatggctatgaccgataccacaccctttgggcagcaacgggtgttcaaagagaaggtcgacacgagaacccaggaacctaaggagggaaccaagaaacttatgaaaatcaccgccgaatggctgtggaaggagctgggcaaagagaagacaccccgcatgtgtaccagagaagagtttacacggaaagtgcgctccaacgcggccctcggggctgtgttcaccgatgaaaataagtggaaaagcgccagagaggctgtcgaagacggacggttttgggagctggttgatagagagcggaaccttcacctggaaggcaaatgcgagacgtgtgtgtacaatatgatgggcaagcgcgagaagaagctcggggagttcggaaaagccaagggctctagagccatttggtatatgtggctgggggcgcggtttctggagttcgaggctctcggatttctgaacgaggaccattggttctcccgcggcaatagcctttccggggtggaaggcgagggactgcacagactcggctacatcctgcgggaagtcgggaagaaagagggaggcgccatgtacgccgatgacaccgctgggtgggatacacgcattacccttgaagacctgaagaacgaggagatggtgacaaatcatatgaaaggagaacacaagaaactcgccgaggctatcttcaagctgacctatcagaacaaggttgtgagagtccagcggcctacgccccgcggcacagtgatggacattatcagcagaaaagatcaacgggggtctggccaggttggaacctacggcctgaatacatttaccaacatggaagcccagctcatccgccaaatggagggggagggaattttcaagagcatccagcatctgacggcgaccgaagagattgccgtgcagaattggcttgctagagtcggccgggaacgcctgtccagaatggccatctctggggacgattgcgtggttaaaccgattgacgatcggtttgctagcgccctcacagcgctgaacgacatgggaaaggtgagaaaagatatccagcaatgggagccttcccgcggctggaatgactggacccaggtccccttctgctctcaccactttcatgaacttgtgatgaaggatgggcgggtcctggtggttccctgtagaaaccaggacgagctcatcggccgcgcccggattagccagggagctggctggtccctgaaggagacagcctgcctggggaaatcttatgctcaaatgtggaccctcatgtacttccacagacgcgatctgcggcttgccgctaacgccatctgtagcgcggtgccttcccattgggtcccgacaagcagaaccacgtggtctattcacgccaagcacgaatggatgacaaccgaggacatgctggctgtgtggaatcgcgtgtggatccaggaaaacccctggatggaggataaaacccctgttgaatcctgggaggaggtgccctatctcggaaagcgggaagaccagtggtgcggcagcctgattgggcttacatctagagccacctgggccaaaaatatccagacagctattaaccaagtccgctccctgatcggaaatgagggctacacggactatatgcctagcatgaagcggtttagacgggaagaggaagaggccggggtgctctggtga

SEQ ID NO: 20174 - RNA, 9876 nt, synthetic construct
  misc_feature 1..9876: note = derived and/or modified CDS sequence (opt5) from DENV-2__JX286525__SS-prME
  source 1..9876: mol_type = other RNA
accgccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaagagcttcgccggaccggtgtctcagcacaactaccgccctggctatcatacccaaacagctgggccctggcaccttggaaagctcgaaatggattttgacttctgtgagggcaccacggtcgtggtgacagaagattgcgggaaccggggaccctccctgagaaccacaaccgccagcggcaaactgattacagagtggtgctgtcggtcctgcaccctccctccgctgcgctacagaggcgaggacgggtgttggtacggaatggaaatccggccccttaaggagaaggaagagaatctggtcaactctctcgttacggccggccatgggcagattgataattttagcctgggagtgctgggcatggctcttttcctcgaagagatgctgagaacccgcgtggggacaaaacacgcgatcctgctcgtcgccctgtcctttgtgacccttatcacaggaaacatgtctttccgggacctgggcagagttatggtgatggtcggcgctaccatgacggatgacattgggatgggagtgacatatctcgccctgctggccgcttttaaggttcgccctaccttcgccgcgggccttctgctcagaaaactgacaagcaaggagctcatgatggctaccatcgggattgccctgctttcccagtctaccctgcccgaaacaatcctcgagctgacggatgccctggctcttggaatgatggccctgaaaattgtgcggaatatggaaaagtaccaactcgcggtcaccatcatggctatcagctgcgtgcctaacgccgttattctgcagaatgcctggaaggtgtcctgtacaatcctcgctgccgtcagcgtgtctcccctgcttctgacctccagccagcagaaagctgactggattcctctcgccctgacaatcaagggcctgaaccccaccgcgatttttcttacgacactgtctcgcacctccaaaaagagaagctggccgctcaatgaggccatcatggctgtggggatggtctctatcctggcctccagcctcctgaaaaacgacattcctatgaccggaccccttgttgctggcggcctgctgacagtgtgctatgtgctcaccgggcggtccgccgatctggaacttgagcgcgccgctgacgtcaagtgggaggatcaagcggaaatcagcggatctagccctattctgtccatcacaatttctgaggacggcagcatgtccatcaaaaatgaagaggaggaacagacgctcaccattctgatcagaacagggctcctggtgatctctggagttttccccgtgagcattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctacagccaaattggggcgggagtctataaagaaggcacatttcacaccatgtggcatgtgacgagaggggctgtcctgatgcaccgcggaaagagaatcgagcccagctgggccgatgtgaaaaaggaccttatctcctacggcgggggatggaagctggagggcgaatggaaagagggcgaagaggttcaggtgctcgccctggaacctgggaagaacccgcgggctgtccagaccaaacccggaattttcaagacaaataccggcacaatcggggccgtgagcctcgatttttctcctggaacctccggcagccccattgttgacagaaaagggaaggtggtcggactgtacggcaacggcgtggtgacacgctctggggcgtatgtttccgctatcgcccagacggaaaagtccattgaggataatcctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgtcccccatccgcgtgcctaactacaaccttatcattatggatgaggcccactttaccgaccccgcctctatcgctgcgagagggtatattagcacacgggttgaaatgggcgaggccgctggaatcttcatgaccgccacgccgcctggctcccgcgatccctttccccagagcaatgcccctattatggacgaggaaagagagatccccgaacggtcttggaactccgggcacgagtgggtgacagatttcaagggaaagaccgtctggtttgtgcctagcatcaaagctggcaatgacattgccgcgtgcctgagaaagaacgggaaaaaggttatccagctgtctcgcaaaaccttcgatagcgaatacgtgaagacacgggctaatgactgggattttgtcgtgaccacagacatttccgagatgggagccaacttcaaggccgagagagttatcgatccgcgccggtgtatgaaacccgtgattctcaccgacggcgaagagagagtcatcctggctgggcctatgcccgtgacgcattctagcgccgcgcaacgccggggcagaatcggacgcaatcctaagaacgaaaatgaccagtatatttacatgggcgagccccttgaaaacgatgaggactgcgcccactggaaagaggctaagatgctgctcgataatatcaacacaccggaagggattatcccttccatgtttgagcccgaaagagagaaagtggacgccattgatggagaataccggctgcgcggcgaggctagaaagaccttcgtcgacctgatgcggcgcggggatctccctgtttggcttgcctataaagtggctgccgagggaatcaattacgcggacagaaagtggtgttttgatggcattaagaacaatcagatcctggaagagaacgtggaagtcgagatctggacaaaagagggggaacggaagaaactgaagcccagatggctcgacgcccgcatttattctgatcctctggctcttaaagagttcaaggagttcgccgctggcagaaagagcctgaccctcaacctgatcacggagatgggaagactgcccacctttatgacacagaaagcccgcaatgccctcgacaaccttgctgtgctgcataccgcggaagttggcgggaaggcctacacacacgctctgtccgagctcccggagaccctggaaacacttctgctcctgaccctgctcgccgccgtgacgggaggcattttcctttttctgatgagcgggaaaggaatcggcaagatgacactgggcatgtgctgcattatcaccgcttctatcctcctgtggtatgcccaaattcagcctcactggatcgcggcctccattatccttgagttctttctgattgtcctcctgatccccgaacccgagaaacagcggacccctcaggataatcaactgacatacgtggttatcgctattctcaccgtggtcgccgctacaatggccaacgaaatggggttccttgagaagacgaagaaagacctgggatttggcagcatcaccacacaggagtccgaatctaatattctggacatcgatctcagaccggcgagcgcctggaccctgtatgctgtggccacaaccttcgtcacgcccatgcttcggcattccattgagaactctagcgtgaatgtttccctgaccgctatcgccaaccaggctacagtgctcatggggctgggaaagggctggcctctgagcaaaatggacattggggtgcccctccttgccatcggatgttactctcaggtcaatcctatcaccctgacagcggccctgctcctgcttgttgctcactacgccattatcggccccggcctgcaagctaaggccacccgcgaagcccagaaaagagcggctgccgggattatgaagaaccctacggtggatggaatcacagtgattgacctcgagccgatcccctatgatcctaagtttgaaaaacagctgggccaggtcatgctgctcatcctttgcgtgacccaagttctgatgatgcggacaacctgggctctgtgtgaggccctcaccctggccacagggcccatttccacgctttgggagggaaatcctggccgcttctggaacaccacaatcgctgtgagcatggccaatatttttagagggtcttacctggcgggagccggcctcctgttctccatcatgaagaacaccacaaatacccggcgcggcacggggaacgtcggagaaacactgggcgagaaatggaaaagcagactcaatgctcttgggaaatctgaatttcagatttataagaaaagcggaatccaggaggtggaccggaccctggccaaggagggcatcaagcgcggggaaaccgatcatcacgctgtctccagaggatctgccaaactgcggtggttcgtggagagaaacatggttacacccgaaggcaaggtggtcgacctcggctgcgggcgcggaggctggagctactattgtgggggactgaaaaacgtgcgggaggttaagggccttaccaaagggggaccgggccatgaggaacctattcccatgtccacatacggctggaatctggtgagactccaaagcggggtcgatgtgttctttacgccccctgagaagtgcgacaccctgctgtgtgatatcggagaatcctctcccaaccctacaattgaggcgggccgcaccctccgggtgcttaatctggttgaaaactggctgaataacaatacacagttctgcatcaaggtcctcaacccgtatatgcccagcgtgattgagaaaatggaaaccctgcagagaaagtacgggggagcccttgtgcgcaatcctctgtcccggaactctacgcacgagatgtactgggtcagcaatgctaccggcaacatcgtttcctctgtgaatatgatcagcagaatgctcattaaccgctttacaatgaaacacaagaaagccacctatgagcccgacgtggatctggggtccggaacacggaatatcggcattgaaagcgagatccctaacctggacattatcggcaagagaattgaaaagatcaaacaggagcatgaaacctcttggcactacgaccaagatcatccctataagacatgggcttaccacgggtcctatgagaccaaacagacgggaagcgcctcttccatggtcaacggcgtggttcgcctccttacaaagccgtgggacgtggtccctatggtgacccagatggctatgaccgatacaacgcccttcgggcagcaacgggtttttaaagagaaggtggacaccagaacacaggaacctaaggagggaaccaaaaagctgatgaaaatcacagccgaatggctgtggaaggagctcggcaaagagaagacaccccgcatgtgtacaagagaagagttcacccggaaagtccgcagcaatgcggccctgggggctgtgtttacggatgaaaacaagtggaagtctgccagagaggctgtggaagacggacggttctgggagcttgtcgatagagagcggaatctgcacctcgaaggcaaatgcgagacctgtgtttacaacatgatgggcaagcgcgagaagaagctgggggagtttggaaaagccaagggctccagagccatttggtatatgtggctgggggcgcggttcctcgaatttgaggctctgggattccttaatgaggaccattggtttagccgcggcaactccctgagcggggtggaaggcgagggactccacagactgggctacatccttcgggaagtggggaagaaagagggaggcgccatgtacgccgatgacacagctgggtgggatacccgcattacactggaagacctcaagaatgaggagatggtcaccaaccatatgaaaggagaacacaagaaactggccgaggctatcttcaagctgacgtatcagaataaggtggttagagtgcagcggcctacaccccgcggcaccgtcatggacattatctctagaaaagatcaacgggggagcggccaggtgggaacatacggcctcaacaccttcacgaatatggaagcccagctgatccgccaaatggagggggagggaatttttaagtccatccagcatcttaccgcgacagaagagattgccgttcagaactggctggctagagtgggccgggaacgcctctctagaatggccatcagcggggacgattgcgtcgtgaaaccgattgacgatcggttcgcttccgccctgaccgcgcttaatgacatgggaaaggttagaaaagatatccagcaatgggagccttctcgcggctggaacgactggacacaggtgcccttttgcagccaccacttccatgaactggtcatgaaggatgggcgggtgctcgtcgtgccctgtagaaatcaggacgagctgatcggccgcgcccggatttcccagggagctggctggtctctgaaggagaccgcctgcctcgggaaaagctatgctcaaatgtggacactgatgtactttcacagacgcgatcttcggctggccgctaacgccatctgttccgcggttcctagccattgggtgccgacctctagaacgacatggtccattcacgccaagcacgaatggatgaccaccgaggacatgctcgctgtctggaaccgcgtgtggatccaggaaaatccctggatggaggataaaacacctgtggaaagctgggaggaggttccctatctgggaaagcgggaagaccagtggtgcggctctcttattgggctgacctccagagccacatgggccaaaaacatccagacggctattaatcaagtgcgcagcctcatcggaaacgagggctacaccgactatatgccttccatgaagcggttcagacgggaagaggaagaggccggggtcctgtggtga

SEQ ID NO: 20175 - RNA, 9876 nt, synthetic construct
  misc_feature 1..9876: note = derived and/or modified CDS sequence (opt5) from DENV-2__KM279598__SS-prME
  source 1..9876: mol_type = other RNA
accgccggcatcattatcatgatgattcccaccgtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggataccattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacgtgggacgcgttatggtgatggtcggcgccaccatgacagatgacattggcatgggggtgacctacctggccctcctggctgcctttaagatcagacccacgttcgcggctggactgcttctgcggaaactcacatccaaggagctgatgatgaccacaatcggcattgtgctcctgtctcaaagcaccatccctgagtccattcttgaactgaccgatgccctcgccctggggatgatggtcctgaaaatcgttcgcaatatggagaagtatcagcttgctgtgacaattatggccatcctgtgcgtgcccaacgcggtcatcctccagaatgcttggaaagtgtcttgtacgaccctggccgttgtgagcgtctcccctctcctgcttacaagctctcaacagaaggccgactggattcccctggctctcaccatcaagggactgaaccctacagccatttttctgaccacgctttccagaacaagcaaaaagcggtcttggcccctgaatgaagctatcatggccgtgggcatggtttccattctcgcgagctctctgctcaaaaacgatatcccgatgaccgggcctctggtggccggaggccttctgaccgtctgctacgtgctgacaggccgctccgctgacctcgagctggaaagagccgctgacgtccggtgggaggagcaggccgaaatcagcgggtccagccccattctttctatcaccattagcgaggatggatccatgtctatcaagaatgaagaggaggaacagacactgacgattctcatccgcaccggcctgctcgtgattagcgggctgttccctgtttccatccccatcacagccgctgcgtggtatctttgggaggtgaaaaagcaaagagccggagtcctgtgggacgtgccgtctcctccccctgttggcaaagctgaactggaggatggggcctaccggattaagcagaagggaatcctcggctatagccagattggcgccggggtgtacaaagaaggaacctttcacacaatgtggcatgtcacccgcggcgctgtgctgatgcacaaggggaaaagaatcgagccctcctgggccgacgtgaagaaagatcttatttcttacggaggcgggtggaagctggagggagaatggaaggagggcgaagaggttcaggtcctcgcgctggaacccggcaaaaaccctcgggctgtgcaaacgaagccgggactcttcaaaaccaacacaggaaccatcggcgccgtgagcctggacttttcccccgggacaagcggatctcctatcgtcgataagaaaggcaaggtggttgggctttatggaaatggcgtggtcaccagatccggcacatacgtgagcgccattgctcagacggagaagtctatcgaggacaaccccgaaattgaggatgacatcttccgcaaaaagcggctgaccattatggatctgcatcctggggccggaaaaacaaagagatatctccccgcgatcgttcgcgaagctatcaaacggggcctgagaacccttattctggcccctacccgcgtggtcgccgctgagatggaagaggccctccgggggctgccgatcagataccagacacccgctattcgcgccgagcacacgggacgggaaatcgtggacctcatgtgtcatgcgaccttcacaatgagactgctttcccctattcgggttcccaattataacctgatcattatggatgaggcccactttaccgaccctgctagcatcgccgctcgcggctacatctccacaagagtggaaatgggggaggccgccggcattttcatgaccgctacgcccccgggatctcgggacccttttccccagagcaatgcgcccatcatggatgaggaaaaggagattcctgaacgctcctggaacagcggccacgagtgggtcacagacttcaaggggaaaaccgtgtggtttgtgccctctatcaaggccggaaatgatattgctgcctgcctgcgcaaaaacggcaagaaagtcatccaactctcccggaagaccttcgacagcgaatatatcaagacaagaaccaatgattgggactttgttgtgacaaccgatatttctgagatgggggccaacttcaaagctgagcgcgtgatcgaccctcggagatgtatgaagccggtcattctgacggatggagaggaacgcgtgatccttgccggccccatgcctgttacacatagctccgcggctcagcggagagggcgcgtgggccggaatcccaaaaacgaaaatgaccagtacatttacatgggagagcctctggaaaacgatgaggactgcgcccactggaaggaggccaaaatgctcctggacaatatcaacacccccgaaggcatcattccgtctatgtttgagcctgaaagagagaaggtcgatgctatcgacggggaatatcgcctgagaggagaggcccggaaaacattcgtggatctcatgcgcagaggcgaccttcccgtttggctggcgtaccgggtggccgctgaggggattaactatgccgatcgcagatggtgttttgacggagtcaagaataaccaaatcctggaagagaatgtggaagtcgagatttggaccaaggagggcgaacggaaaaagctcaaacctagatggctggatgctcgcatctacagcgacccccttgccctgaaggagttcaaagagttcgctgccgggcggaagtccctcacgctgaacctgattaccgagatgggcagactccctacatttatgacccagaaggcgaaaaatgcccttgataacctggctgtgctgcatacagccgaagctggaggccgcgcctataatcacgccctctctgagctgcccgagacccttgaaacactgctcctgctgaccctccttgctacggttacagggggaatcttcctgtttctgatgagcggcaaggggatcggaaaaatgaccctcggcatgtgctgcattatcaccgcgtccattctgctttggtacgcccagatccagccgcactggattgctgccagcatcatcctggagttctttctcattgtgctgctgatccctgaacccgagaagcaacggacaccccaggacaaccagctcacctatgtggtcattgccatccttacagttgtggctgccacgatggcgaatgaaatgggcttcctggagaaaaccaagaaggattttgggctgggatctattacaacccagcaacctgagtccaacatcctcgacatcgatctgagaccggccagcgcttggacactttacgccgtggctaccacgttcattacccccatgctgcggcattccatcgaaaattctagcgtcaacgtgtccctcacagccattgcgaatcaggccaccgttctgatgggcctggggaaaggatggcctctctctaagatggacatcggcgtgccccttctggctattgggtgttacagccaggtcaaccctatcacactgaccgccgctctcctgcttctggtggcccactatgctattatcggacccggcctccaggccaaagcgacgcgcgaggcccaaaagagagctgccgctggcatcatgaaaaatcctacagtcgacgggatgaccgtgattgatctggacccgatcccctacgatcctaagtttgaaaagcagctgggacaggttatgctccttgtgctgtgcgtcacacaggtgctgatgatgcggaccacctgggccctctgtgaggccctgacacttgcgacgggccccatttccaccctgtgggaagggaaccctggacgcttctggaatacaaccatcgctgttagcatggccaacatttttagaggctcttatctcgctggggccggactgctgttctccatcatgaaaaacacagccaatacccggcgcggcacgggcaacacaggggagaccctcggagagaagtggaaaaatagacttaacgctctgggcaagagcgaatttcaaatctacaaaaagtctgggattcaggaggtggaccggaccctggccaaagaaggaatcaagcgcggcgagacagatcatcacgcggtctccagagggagcgccaagctccggtggttcgtggagagaaatctggtgacccccgaaggaaaagttgtcgaccttggctgcggccgcgggggatggtcttattactgtggcgggctgaagaacgtgaaagaggtgaagggactcacaaaaggcgggccgggacatgaagaacctattcccatgagcacgtatggctggaatctggtccggctgcagtccggcgttgatgtgttctttacaccccctgaaaagtgcgacacactcctttgtgatatcggggagtctagccccaaccctaccgtggaggctggaagaacactgcgcgtcctgaatctcgtggaaaactggctgaataacaatacccaattctgcattaaggttcttaacccgtacatgccctccgtgatcgagaaaatggaagccctgcagcggaagtacggcggggctctcgtcagaaatcctctgagccgcaactccacgcacgagatgtattgggtgtctaacgccagcggaaatatcgtttcctctgtgaacatgattagccggatgctgatcaatagatttaccatgcgccacaaaaaggcgacatacgaacccgacgtcgatctcggctccgggacccggaacattggaatcgagtctgagacacctaatcttgacattatcggcaaaagaatcgaaaagattaagcaggagcatgaaaccagctggcactatgatcaggaccatccctacaaaacatgggcctatcacggctcctacgagaccaagcaaacggggagcgcttcttccatggtgaacggagtggtccgcctgctgacaaaaccgtgggacgttatccctatggtgacccagatggccatgaccgatacaacgcccttcggccagcagcgggtgtttaaggaaaaagtcgacaccagaacacaagagcctaaggaggggaccaagaaactcatgaagattacagctgaatggctgtggaaagagcttggaaagaaaaagacccccagaatgtgtacaagagaagagttcacccggaaagtgcgcagcaatgccgctctgggcgccatctttacggatgagaacaagtggaagtctgcgagagaagccgttgaggactccgggttctgggaactcgtggataaagagcggaatctgcacctggaaggaaagtgcgagacctgtgtctataacatgatgggcaaaagagagaagaaactcggcgaatttgggaaggctaagggaagccgggccatttggtacatgtggctgggcgctcgcttccttgagtttgaagccctggggttcctcaatgaggaccattggttttctagagaaaactccctgagcggagtggagggcgaggggcttcacaaactgggctacatcctccgggatgtttccaagaaagaaggaggcgccatgtatgcggacgatacagctgggtgggacacccgcattacactggaggatctgaagaatgaagagatggtgaccaaccatatggaaggagagcacaaaaagctcgccgaggccatcttcaagctgacgtaccagaataaagtcgtgagagttcagcggcctacaccccgcggcaccgtgatggacatcattagcagacgggaccagcgcgggtctggacaagtcgtgacatatggccttaacaccttcacgaacatggaagctcagctgatcagacagatggagggggaaggcgtctttaagagcattcaacagctcaccgtgaaagaggagatcgccgttaagaattggctgattcgggtgggacgcgaaagactttcccggatggctatctctggcgatgactgcgtcgtgaaaccgctggatgaccgcttcgccagcgcgctcacagccctgaacgatatggggaaggtgagaaaggacatccagcagtgggagccttcccggggatggaatgattggacccaagttcccttttgctctcatcacttccacgaactgattatgaaagacggcagagtgctcgtcgtgccctgtcgcaaccaggatgagctgatcgggcgggctagaattagccagggagccggctggtcccttcgcgaaacagcttgcctggggaagtcttacgcccagatgtggagcctcatgtattttcatcggagagacctgcgccttgcggccaatgctatctgttccgccgttcctagccactggattccgacctctcggacaacctggtccatccatgctacgcacgagtggatgacaaccgaggatatgctgaccgtgtggaacagagtctggatccaagaaaatccctggatggaggacaaaacacctgtggaaagctgggaggaaattccctacctcggcaagcgcgaggatcagtggtgcggatctctgatcggcctgacctcccgggccacatgggctaaaaacattcagacggccatcaatcaggtcagaagcctcattgggaacgaggaatataccgactacatgccttccatgaagcgcttccggagagaggaagaggaagcgggagtgctgtggtga

SEQ ID NO: 20176 - RNA, 9876 nt, synthetic construct
  misc_feature 1..9876: note = derived and/or modified CDS sequence (opt5) from DENV-2__KM279576__SS-prME
  source 1..9876: mol_type = other RNA
accgccggcatcattatcatgatgattcccaccgtgatggctttccacctgacgaccagaaacggggagcctcatatgatcgtcagccggcaggaaaagggaaaatccctcctgtttaagaccgagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaagatcagacccacgttcgcggctggacttctgctccggaaactgacatccaaggagctcatgatgaccacaatcggcattgtgctgctttctcaaagcaccatccctgagtccattctggaactcaccgatgccctggccctggggatgatggtgcttaaaatcgtccgcaatatggagaagtatcagctggctgttacaattatggccatcctctgcgtgcccaacgcggtgatcctgcagaatgcttggaaagtctcttgtacgaccctcgccgtggttagcgtgtcccctctgcttctgacaagctctcaacagaaggccgactggattcccctcgctctgaccatcaagggactgaaccctacagccatttttcttaccacgctgtccagaacaagcaaaaagcggtcttggcccctcaatgaagctatcatggccgtcggcatggtgtccattctggcgagctctctcctgaaaaacgatatcccgatgaccgggcctcttgttgccggaggcctgctgaccgtgtgctacgtcctcacaggccgctccgctgacctggagcttgaaagagccgctgacgtgcggtgggaggagcaggccgaaatcagcgggtccagccccattctgtctatcaccattagcgaggatggatccatgtctatcaagaatgaagaggaggaacagacactcacgattctgatccgcaccggcctcctggtcattagcgggcttttccctgtgtccatccccatcacagccgctgcgtggtatctgtgggaggttaaaaagcaaagagccggagtgctgtgggacgtcccgtctcctccccctgtgggcaaagctgaactcgaggatggggcctaccggattaagcagaagggaatcctgggctatagccagattggcgccggggtttacaaagaaggaacctttcacacaatgtggcatgtgacccgcggcgctgtccttatgcacaaggggaaaagaatcgagccctcctgggccgacgtgaagaaagatctgatttcttacggaggcgggtggaagctcgagggagaatggaaggagggcgaagaggtgcaggttctggcgctcgaacccggcaaaaaccctcgggctgtccaaacgaagccggggctgttcaaaaccaacacaggaaccatcggcgccgtgagccttgacttttcccccgggacaagcggatctcctatcgtggataagaaaggcaaggtcgtggggctgtatggaaatggcgttgtgaccagatccggcacatacgtcagcgccattgctcagacggagaagtctatcgaggacaaccccgaaattgaggatgacatcttccgcaaaaagcggctgaccattatggatctccatcctggggccggaaaaacaaagagatatctgcccgcgatcgtgcgcgaagctatcaaacggggccttagaaccctgattctcgcccctacccgcgttgtggccgctgagatggaagaggccctgcgggggctcccgatcagataccagacacccgctattcgcgccgagcacacgggacgggaaatcgtcgacctgatgtgtcatgcgaccttcacaatgagacttctgtcccctattcgggtgcccaattataacctgatcattatggatgaggcccactttaccgaccctgctagcatcgccgctcgcggctacatctccacaagagttgaaatgggggaggccgccggcattttcatgaccgctacgcccccgggatctcgggacccttttccccagagcaatgcgcccatcatggatgaggaaaaggagattcctgaacgctcctggaacagcggccacgagtgggtgacagacttcaaggggaaaaccgtctggtttgtgccctctatcaaggccggaaatgatattgctgcctgcctccgcaagaacggcaagaaagtgatccaactgtcccggaagaccttcgacagcgaatatatcaagacaagaaccaatgattgggactttgtcgttacaaccgatatttctgagatgggggccaacttcaaagctgagcgcgtgatcgaccctcggagatgtatgaagccggtgattcttacggatggagaggaacgcgtcatcctggccggccccatgcctgtgacacatagctccgcggctcagcggagagggcgcgttggccggaatcccaaaaacgaaaatgaccagtacatttacatgggagagcctctcgaaaacgatgaggactgcgcccactggaaggaggccaaaatgctgctggacaatatcaacacccccgaaggcatcattccgtctatgtttgagcctgaaagagagaaggtggatgctatcgacggggaatatcgcctcagaggagaggcccggaaaacattcgtcgatcttatgcgcagaggcgacctgcccgtgtggctggcgtaccgggttgccgctgaggggattaactatgccgatcgcagatggtgttttgacggagtgaagaataaccaaatcctcgaagagaatgtcgaagtggagatttggaccaaggagggcgaacggaaaaagctgaaacctagatggcttgatgctcgcacgtacagcgaccccctggccctcaaggagttcaaagagttcgctgccgggcggaagtccctgaccctgaacctcatcacagagatgggcagacttcctacctttatgacacagaaggcgaaaaatgccctggataacctggctgtcctccataccgccgaagctggaggccgcgcctataatcacgccctgtctgagcttcccgagacactggaaaccctcctgctgctcacgcttctggctacagtgaccgggggaattttcctgtttctcatgagcggcaaggggatcggaaaaatgaccctgggcatgtgctgcatcattacagcgtccatccttctgtggtacgcccagattcagccgcactggatcgctgccagcattatcctcgagttctttctgatcgttctgctcattcctgaacccgagaagcaacggacaccccaggacaaccagcttacatatgtggtgatcgccattctgacggtcgttgctgccaccatggcgaatgaaatgggcttcctggagaaaacaaagaaggattttgggctcggatctatcaccacacagcaacctgagtccaacattctggacatcgatcttagaccggccagcgcttggaccctgtacgccgtggctacgaccttcatcacacccatgctccggcattccattgaaaattctagcgtgaacgtctccctgaccgccatcgcgaatcaggccacagtgctgatgggcctcgggaaaggatggcctctttctaagatggacattggcgttcccctgctggctatcgggtgttacagccaggtgaaccctattaccctcacggccgctctgcttctgctcgtcgcccactatgctatcattggacccggcctgcaggccaaagcgacacgcgaggcccaaaagagagctgccgctggcatcatgaaaaatcctaccgtggacgggatgacagtcatcgatctggacccgattccctacgatcctaagtttgaaaagcagctcggacaggtgatgcttctggttctgtgcgtgacccaggtcctcatgatgcggaccacatgggccctgtgtgaggcccttacgctggcgaccggccccatctccacactctgggaagggaaccctggacgcttctggaataccacaattgctgtgagcatggccaacatctttagaggctcttatctggctggggccggactcctgttctccattatgaaaaacaccgccaatacgcggcgcggcacaggcaacaccggggagacccttggagagaagtggaaaaatagactgaacgctctgggcaagagcgaatttcaaatctacaaaaagtctgggatccaggaggttgaccggacactcgccaaagaaggaattaagcgcggcgagaccgatcatcacgcggtgtccagagggagcgccaagctgcggtggttcgtcgagagaaatcttgtgacacccgaaggaaaagtggttgacctgggctgcggccgcgggggatggtcttattactgtggcgggctcaagaacgtcaaagaggtgaagggactgacgaaaggcgggccgggacatgaagaacctatccccatgagcacctatggctggaatctggtgcggctccagtccggcgtcgatgttttctttacaccccctgaaaagtgcgacacccttctgtgtgatattggggagtctagccccaaccctacagtggaggctggaagaaccctgcgcgtgctcaatctggtcgaaaactggcttaataacaatacgcaattctgcatcaaggtgctgaacccgtacatgccctccgttattgagaaaatggaagccctccagcggaagtacggcggggctctggtgagaaatcctctgagccgcaactccacccacgagatgtattgggtctctaacgccagcggaaatatcgtgtcctctgttaacatgatcagccggatgctcattaatagatttacaatgcgccacaaaaaggcgacctacgaacccgacgtggatcttggctccgggacacggaacatcggaattgagtctgagacccctaatctggacatcattggcaaaagaatcgaaaagatcaagcaggagcatgaaacaagctggcactatgatcaggaccatccctacaaaacctgggcctatcacggctcctacgagacgaagcaaacagggagcgcttcttccatggtcaacggagtggtgcgcctgctcaccaaaccgtgggacgtcattcctatggttacccagatggccatgacagatacgacccccttcggccagcagcgggtgtttaaggaaaaagtggacacaagaacccaagagcctaaggaggggacaaagaaactgatgaagatcaccgctgaatggctttggaaagagctgggaaagaaaaagacaccccgcatgtgtaccagagaagagttcacgcggaaagtccgcagcaatgccgctctcggcgccatttttaccgatgagaacaagtggaagtctgcgagagaagccgtggaggactccgggttctgggaactggttgataaagagcggaatctgcacctcgaaggaaagtgcgagacatgtgtgtataacatgatgggcaaaagagagaagaaactgggcgaatttgggaaggctaagggaagccgggccatctggtacatgtggcttggcgctcgcttcctggagtttgaagccctcgggttcctgaatgaggaccattggttttctagagaaaactcccttagcggagtcgagggcgaggggctgcacaaactcggctacattctgcgggatgtgtccaagaaagaaggaggcgccatgtatgcggacgataccgctgggtgggacacacgcatcaccctggaggatctcaagaatgaagagatggttacgaaccatatggaaggagagcacaaaaagctggccgaggccattttcaaacttacataccagaataaagtggtcagagtgcagcggcctacccccagaggcacagttatggacatcatcagcagacgggaccagcgcgggtctggacaagtggtcacctatggcctgaacacgttcaccaacatggaagctcagctcattagacagatggagggggaaggcgtgtttaagagcatccaacagctgacagtcaaagaggagattgccgtgaagaattggcttatccgggttggacgcgaaagactgtcccggatggctatttctggcgatgactgcgtggtcaaaccgctcgatgaccgcttcgccagcgcgctgaccgccctgaacgatatggggaaggtgagaaaggacatccagcagtgggagccttcccggggatggaatgattggacacaagtgcccttttgctctcatcacttccacgaactcatcatgaaagacggcagagttctggtggtcccctgtcgcaaccaggatgagcttattgggcgggctagaatcagccagggagccggctggtccctgcgcgaaaccgcttgcctcgggaagtcttacgcccagatgtggagcctgatgtattttcatcggagagaccttcgcctggcggccaatgctatttgttccgccgtgcctagccactggatcccgacatctcggaccacgtggtccattcatgctacacacgagtggatgaccaccgaggatatgctcacagtttggaacagagtgtggatccaagaaaatccctggatggaggacaaaacccctgtcgaaagctgggaggaaatcccctacctgggcaagcgcgaggatcagtggtgcggatctctgattggcctcacatcccgggccacgtgggctaaaaacatccagaccgccattaatcaggtgagaagcctgatcgggaacgaggaatatacagactacatgccttccatgaagcgcttccggagagaggaagaggaagcgggagtcctttggtga

SEQ ID NO: 20177 - RNA, 9876 nt, synthetic construct
  misc_feature 1..9876: note = derived and/or modified CDS sequence (opt5) from DENV-2__KC964095__SS-prME
  source 1..9876: mol_type = other RNA
tccgccggcatgatcattatgctcatccccaccgtgatggctttccacctcaccacgcgcaatggggagcctcatatgattgtctccatccaggaaaagggaaaatctctgctttttaagaccgaggacggcgttaatatgtgcacactgatggccatggatctcggggaactgtgtgaggacaccattacatacaaatgcccccttctgcggcaaaatgaacccgaggatatcgaccgctggtgtaatagcacctccacatgggtgacctatggaacgtgcaccacaaccggcgagcacagacgggaaaagcgctctgtggcgctcgttcctcatgtggggatgggactggagacaagaaccgaaacgtggatgagctccgagggcgcttggaaacacgcccagcggatcgagacatggattctgcgccatcccggcttcaccatcatggccgctattctcgcctacacaatcgggaccacccactttcagagagctctgattttcatccttctgacagccgttgcgcctcccatgacgatgcggtgtattggaatctctaaccgcgattttgtggaaggcgtcagcgggggatcctgggtggacatcgttctcgagcacggcagctgcgtgaccacaatggccaagaataagcctaccctggatttcgaacttattaaaacagaggctaagcagcccgccaccctgagaaaatattgtatcgaagctaagctcacgaacacaaccaccgagtctcggtgccccacacaaggggagccttccctgaaagaggaacaggacaagcgctttgtctgtaagcatagcattgtggatagaggatggggcaatggctgcgggtctttcggaaaaggcgggatcgtgacctgtgccatgtttacatgcaagaaaaacatggaaggaaagattgtccagcccgagaatctggaatacacgatcgttgtgacccctcactccggcgaggagcatgcgatcgggaacgacacaggaaaacacggcaaggaaattaaagtgacaccccagagctctgtcacagaggccgaactcaccggctatgggacggtgaccatcgagtgcagcccccggacaggactggatttcaatgaaatggttcttctgcaaatgggcaacaaggcttggctcgtgcaccgccagtggtttctggaccttcctctgccctggctccctggggccgatacccagggaagcaattggattcagaaggagacactggtcaccttcaaaaacccccatgctaagaaacaagacgtggttgtgctgggctcccaggagggggccatgcacacggccctcacaggcgctaccgaaatccagatgtctagcggaaatctgctttttacaggccatctgaagtgtgggctcagaatggacaaactgcaacttaagggaatgtcctacagcatgtgcaccggcaagttcaaagtcgtgaaggagattgcggaaacccagcacgggacaatcgtcatccgggtgcagtatgagggagatggctctccctgtaaaattcctttcgagatcatggacctggaaaagagatacgttctcgggcgcctgattacggtgaacccgatcgtcaccgagaaagattcccccgtgaacattgaagccgagcctccctttggcgacagctacatcattatcggagttgaacctggccagctgaagctcaattggttcaagaaagggtctagcatcggacaaatgtttgagacaaccatgcggggcgctaagagaatggccattctgggggatacagcctgggacttcggatcccttggcggggtgtttacctctatcggcaaagctctgcatcaggtcttcggagccatttatggcgcggcttttagcggggtgtcctggacgatgaagatcctcattggagtgatcatcacatggattggcatgaacagccgctctacctccctgagcgtttctctggtccttgtggggatcgtgaccctctacctgggagtcatggtgcaggccgattccggctgcgttgtgagctggaaaaataaggagctgaagtgtgggtccggcattttcatcacagacaacgtccggacctggacagaacagtataaatttcaacccgagtctccgagcaagctcgcctccgctattcagaaagcccaggaagagggaatctgcggcatcagatctgtgacgcgcctggaaaatcttatgtggaagcagattacccctgagctgaaccacatcctcgctgagaatgaagttaaactgacaattatgaccggggatatcaagggaacaatgcaagccggcaaacggagcctgagaccccagcctaccgagcttaagtactcctggaagacgtgggggaaagcgaagatgctcagcaccgaatctcacaaccagacattcctgattgacggacccgagaccgccgaatgtcctaatacaaaccgcgcttggaactccctggaggtggaggattatggctttggcatgttcaccacaaacatctggctccagctgaaagaaaagcaagacgccttttgcgacagcaaacttatgtctgctgccatcaaggataatcgggcggtccatgccgacatggggtactggattgagtccgctctgaacgatacctggaagatcgaaaaagccagcttcattgaggtgaagaattgtcactggcccaaatctcatacgctctggagcaacggagttctggagtccgaaatgatcattccgaagaacctggctggccctgtgagccagcacaattatagacccgggtaccacacacagatcgccggaccctggcatcaaggcaaacctgagatggacttcgatttttgcgacgggaccaccgtcgtggtgacagaagattgtggaaaccgcggcccgtctcttcggaccacgacagcctccggcaagctcattaccgagtggtgctgcagaagctgtacactgccccctctgcggtaccgcggggaagacggatgctggtatggcatggagatcagacccctcaaggagaaagaagagaatctggtcaactcccttgttaccgctgggcacggacagatcgataatttctctctgggcgtgctcgggatggcgctgtttctggaagagatgcttcggacaagagtgggaaccaagcatgccattctcctggtcgctgtgagcttcgttacgctgatcaccggcaacatgtcctttaaagacctcggccgcgtggtcgtgatggttggggccacaatgaccgatgacattggaatgggcgtgacatacctggcccttctggctgccttcaaggtccggcctacctttgcggctgggctcctgctgagaaaacttacgtctaaggaactgatgatgacaaccatcggaattgtgctcctgagccagtccacaatccccgagaccgttctcgagctgaccgatgcccttgccctgggcatgatggctctcaagatcgtgcgcgacatggaaaaatatcagctggccgtcacaattatggcgatcctgtgtgtgcctaatgctgtgattcttcaaaacgcctggaaggtctcttgcacgatcctggccgttgtgagcgtgagccccctcctgctcaccagctctcagcagaaaacagactggattccgctggctcttaccatcaaggggctgaatcctacagccatcttcctcaccacgctgtccagaacaaacaaaaagcggagctggcccctgaatgaggctattatggccgtcggaatggtgtctatccttgcgtccagcctgctcaaaaacgatattcctatgaccggccccctggttgccggcgggctcctgaccgtgtgttacgtccttacaggacgctctgctgacctggaactggagagagccaccgatgtgaattgggaagaccaggctgagatctccggcagctccccgattctcagcatcacaatttctgaggatgggagcatgtccatcaagaacgaagaggaggaacaaacgctgaccatccttattcggacaggactgctcgttatctctggcctgtttcctgtgagcattcccatcaccgccgccgcttggtatctctgggaggtcaagaaacagcgcgcgggggtgctgtgggacgtccctagcccgccccctatgggaaaggccgaacttgaggatggcgcttacagaattaaacagaagggcgtgctggggtattctcagatcggagccggcgtttacaaagaagggacattccacaccatgtggcatgtgacgcggggagccgtcctgatgcacaagggcaagcgcatcgagccgagctgggctgacgtgaaaaaggatctcatttcctacgggggaggctggaaactgggcggggaatggaaggagggagaggaagttcaagtgcttgccctggagcccggcaaaaatcctagagcggtccagaccaagcccgggctctttaagacaaacaccggaacaatcggcgctgtgtctctggacttcagccctgggacctccggaagccccattatcgataaaaagggcaaagtggaaggcctctatgggaacggagttgtcacacggtctggcacgtacgtgtccgccattgcccagaccgaaaagtccatcgaagacaatcctgagatcgaggatgacatttttcgcaaaaagagactgacaatcatggaccttcacccgggggctggaaagaccaaacggtatctgcccgccattgtgagagaagcgatcaagcgcggcctgcggaccctcattctggctcctacaagagtcgtggccgccgagatggaagaggctcttagagggctgcccatccggtaccaaacgcctgccattagagctgaacataccggccgcgagatcgttgatctcatgtgccacgccacattcaccatgcggctgctctctcccgtgagagtcccgaactataatctgatcattatggacgaggcgcatttcacagatcctgcctccatcgctgcccgcggatacattagcacccgggtggaaatgggcgaggctgccgggatctttatgacggccacaccgcccggatccagagaccctttcccccagtctaacgctcctattatcgatgaggaacgggagatcccggaacgcagctggaactccggccacgagtgggttaccgactttaaagggaagaccgtgtggttcgtccccagcattaaagcgggaaacgatatcgccgcttgtcttagaaagaatggcaagaaagtgattcagctgtctcggaagacatttgactccgaatatgttaaaacccgcacaaacgattgggacttcgtggtcaccacggatatcagcgagatgggggccaattttaaggccgaaagagtgattgaccctcggagatgcatgaaacccgtgatcctgacagacggcgaggagcgcgtcatcctcgctggacctatgcccgttacccattctagcgccgcgcagcggagaggccgcattgggcggaacccgaagaatgaaaacgatcaatacatctacatgggagagcctctggaaaatgacgaggattgtgctcactggaaagaagccaagatgcttctggacaacattaatacacccgagggcatcattccttccatgttcgagcccgaaagagagaaggtggatgccatcgacggggaatatcgcctccggggagaggctagaaaaacctttgtggatctgatgcgcagaggcgacctgcctgtctggctcgcctacaaggtggcggccgaagggattaactatgctgatcggcgctggtgcttcgacggcatcaaaaacaatcagatccttgaggagaacgttgaagtggagatttggacgaaggaaggagagcgcaaaaagctgaagccccggtggctggatgcccgcatctactctgacccgctcgctctgaaagagtttaaggagttcgccgctggcagaaaaagccttaccctgaatctcattacagagatggggcggctgcctaccttcatgacacagaagaccagagatgccctggacaacctcgcggtccttcacacagccgaagctggaggccgcgcctataatcatgctctgtccgagctgcccgaaaccctcgagacgctgcttctgctcacactgctggccaccgtgaccgggggaatctttctcttccttatgtctggccggggcattgggaaaatgacactgggaatgtgttgcatcatcaccgccagcattctgctctggtacgctcagatccaaccccactggattgcggcctccatcattctggagtttttccttatcgttctgctcatccctgaaccggagaagcagagaacaccccaggacaaccagctgacgtatgtggtcattgctatcctgaccgtggtcgccgccacaatggctaatgaaatgggctttctcgagaagaccaaaaaggatcttgggctgggaagcattacaacccaacagcctgaatctaacatcctggacattgatctgccccctgcctccgcgtggacgctgtacgccgtggctaccacattcgttacccccatgcttcgccatagcatcgaaaattcctctgtgaacgtgagcctgacagccattgctaatcaggccaccgtcctcatgggcctggggaaaggatggcctctgtccaagatggacatcggcgttccgctccttgcgatcggctgctactctcaggtgaaccccattacgctgacagccgctctgctcctgcttgtggcccactatgctatcattgggcctggactgcaagccaaagctacccgggaggcccagaagagagcggccgctggcatcatgaagaatcccacagtcgatgggattaccgtgatcgacctcgatcctatcccctacgacccgaaatttgaaaagcagctgggacaagttatgctgctcgtgctttgtgtcacccaggtgctgatgatgcggacaacgtgggccctgtgcgaggctctcaccctggccacaggccctattagcaccctttgggaagggaaccccggacgcttctggaatacaaccatcgccgtctccatggcgaacatttttagaggcagctatctggctggcgccgggctcctgttctctatcatgaaaaatacgacaaacacccggcgcggaaccggcaacattggggagacactgggagaaaagtggaaatccagactcaatgctcttggcaagagcgagtttcagatctacaaaaagtctgggatccaggaggtggatcggaccctggccaaggaaggaattaaacgcggcgagacagaccaccatgccgtttccagaggcagcgctaagctgcggtggttcgtggaacgcaacatggtcacgcccgaggggaaagtggttgatctcggatgtggcagagggggatggtcttattactgcggcgggctgaagaatgtgcgggaggtcaaaggacttaccaagggcggccctgggcacgaggagcccatccctatgagcacatatggatggaacctggtgagactccaatccggcgtggacgtctttttcattccgcccgaaaagtgtgataccctgctgtgcgacatcggggagtggtctcctaatcccacagtcgaagccggacgcaccctccgggtgcttaacctggtggagaattggctgaacaataacacgcagttctgtattaaagtcctcaatccttacatgcccagcgttatcgagaagatggaaaccctgcagagaaaatacggcggggcgcttgtgcgcaacccgctgtcccggaatagcacacatgagatgtattgggtgtccaacgcctctggaaatatcgtcagctccgtgaacatgatttctagaatgctcatcaaccgctttaccatgcggcacaagaaagctacatacgaacctgacgttgatctgggcagcggcaccagaaatattgggatcgagtccgaaacacccaacctggacattatcggaaagcgcattggcaagatcaaacaggagcatgagacctcttggcactatgatcaagaccacccttacaagacgtgggcctatcatgggagctacgaaacaaaacagaccggatccgctagctctatggtggatggcgtcgtgcggctccttaccaagccctgggacgttatccctatggtgacacagatggccatgacggataccacacccttcgggcagcaaagagtctttaaagagaaggtggacacccgcacacaggaaccgaaggagggaaccaaaaagctgatgaaaattacagcggaatggctgtggaaggagctcggcaaaaaggagacccctcggatgtgcacgagagaagagttcacccgcaaagtgagatccaatgccgctctgggcgccatctttacagatgaaaacaagtggaagtccgctcgggaggccgtcgaggactctgggttctgggaacttgttgataaagagcgcaatctgcacctcgaaggaaagtgtgagacctgcgtgtataacatgatgggcaaaagagaaaagaaactgggggagtttggaaaggctaagggctcccgggccatttggtacatgtggctgggggcgagattcctcgagtttgaagccctgggcttccttaatgaggaccattggtttagccgggaaaactctctgtccggagtggagggcgaagggctccacaaactgggatacatccttcgcgacgtcagcaagaaagagggcggggctatgtatgccgatgacacagctggatgggataccagaattacgctggaggacctcaagaatgaagagatggtgacaaaccacatggaaggcgagcataaaaagctggccgaagccatcttcaagctgacctaccagaataaagttgtgcgggtccaaagaccgccccctagagggacagtgatggatatcatttcccggcgcgaccagagaggcagcggacaggttgtgacctatggcctcaacacgtttaccaatatggaggcgcagctgatccggcaaatggagggggaaggagtcttcaagaacattcagcaccttacagtgaccgaggaaatcgctgttcagaattggctggcccgcgtgggcagagagcggctctctcgcatggccattagcggggatgactgtgtcgtgaaaccgctggatgacagattcgcttccgcccttacagctctgaacgatgtcggaaagatccggaaagacatccagcaatgggagccctctcgcggctgggatgactggacccaggtgcctttttgcagccatcactcccatgaactcattatgaaggacgggagagttctggtggtcccctgccggaaccaggatgagctgatcggcagagcccgcatttctcagggagcgggctggagcctccgggaaacagcctgtctggggaagtcctacgctcaaatgtggtctcttatgtatttccacagacgcgacctgcggctcgccgctaatgccatctgcagcgcggtgccttcccactgggtgcccaccagcagaacgacatggtctattcatgccaaacacgagtggatgaccaccgaagatatgctgacagtttggaaccgcgtgtggatccaggagaatccttggatggaggacaagacccccgtcgaatcctgggaggaaattccgtaccttggaaaacgggagggccagtggtgtgggagcctgatcggactcacatctagagctacgtgggccaagaacatccagaccgctattaatcaagtgcgctccctgatcggcaacgaagagtatacagattacatgcctagcatgaaacggtttagacgcgaggaagaggaagccggggttctgtggtga

SEQ ID NO: 20178 - RNA, 9876 nt, synthetic construct
  misc_feature 1..9876: note = derived and/or modified CDS sequence (opt5) from DENV-2__KC964094__SS-prME
  source 1..9876: mol_type = other RNA
agcgcgggcatgatcattatgctgatccccacagtgatggctttccacctcacaacgagaaatggggaacctcatatgattgtttccatccaagaaaagggaaaatctctgctttttaagaccgaagacggcgttaatatgtgcacactgatggccatggatctcggggaactgtgtgaggacaccattacatacaaatgcccgcttctgcggcaaaacgaacccgaggatatcgactgttggtgcaattccacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatgggttctgcggcatcccggcttcaccattatggccgctatcctcgcctacacaattgggaccacctattttcagcgcgtgctgatcttcattcttctgacagctgtcgccccttctatgacgatgagaagcatcggaatttccaaccgggattttgtggaaggcgttagcgggggatcttgggtggacgtcgtgctcgagcacggctcctgcgtgaccacaatggcgaagaataagcccaccctggatttcgaacttacaaaaaccgaggccaagcaccctgctacgctgcgcaaatactgtatcgaagccaagctcacaaacaccaccacagctagcagatgcccgacccagggggagccctctctgaatgaggaacaagacaaacggtttgtctgtaagcattccatggttgatcgcggatggggcaacggctgcgggctgttcggaaagggcgggatcgtgacatgtgccatgtttacgtgcaaaaagaatatggagggaaaagtggtccagcctgaaaacctcgagtataccattgtgatcacaccccacagcggcgaagagaatgcggttgggaacgacaccggaaagcatggcaaagagattaaggtgacacctcagtcttccgtcaccgaagccgagctgacgggctacgggaccgtgacaatggaatgcagccccagaaccggacttgatttcaatgagatggttctgctccagatgaaaaacaaggcttggctggtgcaccggcaatggtttcttgacctgccgctcccttggctgcccggcgccgatacacaggggtccaattggatccagaaggaaaccctggtcacgttcaaaaaccctcacgctaagaaacaggacgtggtcgtgctcggatctcaagagggcgccatgcatacagccctgaccggggctacagagattcagatgagctccggcaaccttctgtttaccggacacctcaagtgtcgcctgagaaccgacaaacttcagctgaagggcatgagctattctatgtgcacagggaagttcaaagttgtgaaggaaatcgcggagacgcaacatggaaccatcgtcattcgggtgcagtacgaaggcgatgggtccccctgtaaaatccccttcgagattatggacctcgagaagagacacgttctgggacgcctgatcacagtgaatcctattgtcaccgaaaaagatagcccggtgaacatcgaggccgaacccccttttggcgactcttacatcattatcggggtggagcccggccagctcaagctgagctggttcaagaaagaatcctctattggacagatgtttgagacaaccatgcggggcgctaagagaatggccatccttggggatacggcctgggacttcggaagcctgggcggggtttttacatccattggaaaagctctccatcaagtcttcggcgccatctatggggcggcttttagcggcgtgtcttggaccatgaagattctgatcggagtggtcatcacctggattggcatgaactcccgcagcacatctctgtccgtgagccttgttctcgtgggggtcgtgaccctgtacctgggagttatggtgcaggccgattccggctgcgtcgtgtcttggaaaaacaaggagctcaagtgtgggagcggaatcttcgttacagacaatgtgcacacgtggaccgaacagtataaatttcagcctgagtccccctctaagctggccagcgctattcaaaaagcccacgaagagggcatctgcgggattcggtccgtcacaagacttgaaaacctgatgtggaagcagatcaccccggagctcaatcatatcctgagcgagaacgaagtgaaactgacaattatgaccggcgatatcaagggaattatgcaggctggcaaacgctctcttcggcctcagcccacggagctcaagtactcctggaaggcctgggggaaagcgaagatgctgagcaccgaactgcacaatcatacattcctcatcgacggacctgagaccgccgaaagacccaacacaaatcgcgcttggaactctctggaggtggaggattatggctttggggtcttcaccacaaatatttggcttaaactgaaggaacggcaagacgtcttttgtgactccaaactcatgagcgccgctatcaaggataacagagccgtgcacgcggacatgggatactggatcgagtctgccctgaatgatacctggaagattgaaaaagctagcttcatcgaggtgaagtcctgccactggcctaaaagccatacgctgtggtctaacggcgtccttgagtccgaaatgattatccccaagaacttcgccggcccggtgagccagcacaattatcgccctgggtaccatacacagaccgctggaccctggcacctcggccggctggagatggactttgatttctgtgaagggaccacagttgtggtcaccgaggactgcggaaacagaggcccctccctgcggacgacaaccgcctctgggaaactcattacagaatggtgttgccgcagctgcaccctgcctccgcttagataccggggagaggatggctgttggtatggcatggagatcagacccctgaaggaaaaggaggaaaatctcgtgaactccctggttacagccgggcatggacagatcgacaatttttctctgggcgtgcttgggatggctctcttcctggaggaaatgctgcgcacccgggtcggaacgaaacacgcgattctcctggtggccgttagctttgtgacccttatcacaggcaacatgtccttcagagatctggggcgcgtcatggtgatggtgggagctaccatgacagacgatattggcatgggcgtcacctacctcgccctgctggccgcttttaaggttagacctacgttcgccgcggggcttctgctccggaaactgacatctaaggagctcatgatgaccacaatcggaattgtgctgcttagccaatccaccatccccgagaccattctggaactcacagacgctctggccctgggcatgatggtgcttaaaatcgtccgcaatatggagaagtatcagctggccgtgacgatcatggctattctctgcgttcctaacgccgtgatcctgcagaatgcgtggaaggtcagctgtaccacactcgctgtggtttctgtgagccccctgcttctgaccagctctcaacagaaagccgattggattcctctcgccctgacaatcaaggggctgaaccccaccgctatttttcttacgacactgtccagaaccagcaaaaagcggtcttggccgctcaatgaagccatcatggctgtcggaatggtgtccatcctggccagctccctcctgaaaaacgacattcctatgaccggcccccttgtcgccgggggactgctgacagtgtgctacgttctcgccggccgcagcgctgacctggagcttgaaagagccgctgatgtgcggtgggaggagcaggccgaaatctctggcagctcccctattctgtctatcaccattagcgaggacgggggaatgtccatcaagaatgaagaggaggaacagacactcacgatcctgattcgcaccggcctcctggtcatctctgggcttttccccgtgagcattccgatcacagccgctgcgtggtatctgtgggaggttaaaaagcaaagagccggagtgctgtgggatgtcccttctccccctcccgtgggcaaggctgaactcgaggacggggcctaccggattaaacagaagggaatcctgggctatagccagattggcgccggggtgtacaaagaaggaacctttcacacaatgtggcatgttacccgcggcgctgtccttatgcacaaggggaaaagaatcgagcccagctgggccgatgtgaagaaggacctgatctcctacggaggcgggtggaaactcgagggagaatggaaggagggcgaagagattcaggtgctggcgctcgaacctggcaaaaacccgcgggctgtccaaacgaagcccgggctgttcaaaaccaatacaggaaccatcggcgccgtgagccttgatttttctcctgggacatccggaagccccattgttgacaagaagggcaaagtggtcgggctgtatggaaacggcgtggttaccagatctggcacatacgtgtccgccatcgctcagacggaaaagtccattgaggataaccctgaaatcgaggacgataccttccgcaaaaagcggctgacaatcatggacctccatcccggggccggaaaaaccaagagatatctgcctgcgattgtccgcgaagctatcaagcggggccttagaaccctgattctcgccccgacacgcgtggttgccgctgagatggaagaggccctgcgggggctccccatcagataccagacgcctgctattcgcgccgagcacaccggacgggaaatcgtggatctgatgtgtcatgcgacattcaccatgagacttctgtcccccatccgggtccctaattataacctgattatcatggacgaggcccactttacagaccccgcttctattgccgctcgcggctacatcagcaccagagtggaaatgggggaggccgccggcattttcatgacggctacaccgcctggatcccgggatccctttccccagagcaatgcgcctatcatggacgaggaacgcgagattcccgaaagatcttggaactccggccacgagtgggtgaccgatttcaaagggaagaccgtctggtttgttcctagcatcaaagccggaaatgacatcgctgcctgcctccggaagaacggcagaaaagtgattcaactgtctcgcaagacaagcgattccgaatatatcaagacccggacaaatgactgggatttcgtggtcaccacggacatttctgagatgggggccaactttaaagctgagagagtgatcgatccgcgccggtgtatgaagcccgttattcttacagacggagaagagagagtgatcctggccggccctatgcccgtcacccatagctccgcggctcagcgccgggggagagtgggccgcaatcctaaaaacgaaaatgatcagtacatctacatgggagagcccctcgaaaacgacgaggactgcgcccactggaaggaggccaaaatgctgctggataatattaacacaccggaaggcatcattccttctatgttcgagcccgaaagagagaaggttgacgctatcgatggggaatatcggctccgcggagaggccagaaaaacctttgtggaccttatgcggcgcggcgatctgcctgtctggctggcgtacagagtggccgctgaggggattaattatgccgaccggagatggtgtttcgatggagtcaagaacaaccaaatcctcgaagagaatgtggaagttgagatctggacgaaggagggcgaacgcaaaaagctgaaaccccggtggcttgacgctagaatttacagcgatcctctggccctcaaggagtttaaagagttcgctgccgggcgcaagtccctgaccctgaacctcatcacagagatgggccggcttcccaccttcatgacacagaaggcgagaaatgccctggacaacctggctgtgctccataccgccgaagctggaggccgggcctataatcacgccctgagcgagcttccggagacactggaaaccctcctgctgctcacgcttctggctacagtgaccgggggaatttttctgttcctcatgtctggcaaagggatcggaaagatgaccctgggcatgtgctgtattatcacagcgtccattcttctgtggtacgcccagatccagcctcactggatcgctgccagcattatcctcgagtttttcctgattgtcctgctcatccccgaacccgagaaacaacgcacccctcaggataaccagcttacatatgttgtgattgccatcctgacggtggtcgctgccaccatggcgaatgaaatgggctttctggagaagaccaagaaggacttcgggctcggatccatcgccacccagcaaccggagtctaacattctggatatcgaccttagacccgctagcgcctggacactgtacgctgtggccaccacgtttattacccctatgctccggcattccatcgaaaattctagcgttaacgtgtccctgacagcgattgccaatcaggctaccgtcctgatgggcctcgggaagggatggccccttagcaaaatggacatcggcgtgcctctgctggccatcgggtgctactctcaggtcaaccccattacactcaccgctgccctgcttctgctcgtggctcactatgccatcattggacctggcctgcaggcgaaggccacgcgcgaggctcagaaaagagccgctgccggcatcatgaagaatccgacagttgatgggattaccgtgatcgacctggatcccattccttacgaccccaaattcgaaaagcagctcggacaggtcatgcttctggtgctgtgcgttacacaggtgctcatgatgcggaccacctgggccctgtgtgaggcgcttacactggctacgggccctatctccaccctctgggaagggaaccccggacgcttttggaatacaaccatcgccgtcagcatggctaacattttcagaggctcttatctggccggggccggactgctcttttccatcatgaagaatacagctaacacccggcgcggcacgggcaacacaggggagacccttggagagaaatggaagaatagactgaacgccctgggcaaaagcgagttccaaatttacaagaaatctgggatccaggaggtggatcggaccctcgcgaaggaaggaattaaaagaggcgagacagaccatcacgccgtgagccgcgggtccgctaagctgcggtggtttgttgagagaaatcttgtcaccccggaaggaaaggtggtggatctgggctgcggccgcgggggatggtcttattactgtggcgggctcaaaaacgtcaaggaggttaaaggactgacaaagggcgggcctggacatgaagaacccatccccatgagcacgtatggctggaatctggtgcggctccagtccggcgtggacgtcttcttcacccctcccgaaaaatgcgatacacttctgtgtgacatcggggagagctcccctaacccgaccgtggaggccggaagaacactgcgcgttctcaatctggtggaaaactggcttaataacaatacccaattttgcattaaggtcctgaacccctacatgccttctgtgatcgagaagatggaagctctccagcggaaatacggcggggccctggttggaaatcccctgagcagaaactccacgcacgagatgtattgggcgtctaatgccagcggcaacattgtgtcctctgtcaacatgatcagccgcatgctcattaatcggttcaccatgagacacaagaaagctacatacgaacctgatgtggaccttgggtccggaacccgccatatcggcatcgagagcgagacacccaacctggatattatcggcaagcggattgagaaaatcaagcaggagcacgaaacctcttggcattgtgaccaggaccacccgtataagacatgggcctaccacgggtcctatgaggctaaacaaaccggaagcgcctcttccatggtgaatggcgtcgttagactgctcacgaagccttgggatgtgattcccatggtgacacagatggctatgaccgacaccacaccttttgggcagcagcgcgtcttcaaagaaaaggtggatacgagaacccaagagcccaaagagggaacaaagaagctgatgaaaatcaccgccgaatggctttggaaggagctgggcaaaaagaaagcgcctcggatgtgcacacgcgaagagtttaccagaaaggttcggagcaacgccgctctcggggccatgttcacagacgagaataaatggaagtctgctagagaagccgtggaggattccggattttgggaactggtcgacaaggagcggaacctgcatctcgaaggcaaatgtgagacctgcgtgtacaatatgatgggcaagcgcgagaaaaagctgggggagttcggaaaagccaagggcagcagagcgatctggtatatgtggcttggggctcggtttctggagttcgaagccctcggatttctgaacgaggatcactggttctcccgcgaaaatagcctttctggcgttgagggggagggcctgcataagctcggatacattctgagagacgtgagcaaaaaggaaggcggggccatgtacgctgatgacacggccggatgggatacccggatcacactggaggacctcaaaaacgaagagatggtcaccaatcacatggaaggcgagcataagaaactggctgaggccatttttaaacttacatatcagaacaaggtggttcgcgtgcagagacccaccccgcgggggacggtcatggacatcatttcccgcagagatcagcggggatctggccaagtggtcacatacgggctgaataccttcacaaacatggaagcgcagctcatccgccagatggagggcgaaggagtgttcaaaagcattcaacacctgaccgttacggaggagatcgccgtgaagaattggcttgtcagagtgggccgggaacgcctgtccagaatggctatctctggggacgattgtgtggttaaacctctcgacgatcggtttgccagcgctctgaccgccctgaacgacatgggaaaggtgagaaaagatattcagcagtgggagccctcccgcggctggaacgactggacacaggtccccttctgctctcaccattttcacgaactcatcatgaaggatgggcgggtgctggttgtgccttgcagaaatcaagacgagcttattggacgcgcgcggatcagccagggcgccgggtggtccctgagagaaaccgcttgtctcggcaagagctatgcccagatgtggtctctgatgtacttccatcgccgggatcttagactggctgccaacgctatttgctccgccgtcccgagccactgggtgcccacatctcgcaccacatggtccatccacgcgacccatgagtggatgacgacagaggacatgctcaccgtctggaatcgggtgtggatccaggaaaacccttggatggaggataaaacccccgttgaaagctgggaggaaattccttatctgggaaagagagaggaccaatggtgtggctccctgatcgggctcacatctcgcgccacctgggctaaaaatattcagacagccatcaaccaggtgcggagcctgattggaaatgaggaatacacggactatatgccctccatgaagagatttcggagagaggaagaggaagccggcgtcctttggtga

SEQ ID NO: 20179 - RNA, 9876 nt, synthetic construct
  misc_feature 1..9876: note = derived and/or modified CDS sequence (opt5) from DENV-2__KC964093__SS-prME
  source 1..9876: mol_type = other RNA
accgccggcgtgatcattatgatgatccccacggtcgttgctttccacctgacgacccggaatggggagcctcatatgattgtgtcccggcaggaaaagggaaaatccctcctgtttaagacagagaatggcgtgaatatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcaccggcgggaaaaacgctccgtggctctggttcctcatgtggggatgggactcgagacacggaccgaaacgtggatgtcttccgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgacaaagaccgaggctaaacaccctgccacgcttagaaagtactgcatcgaagctaaactgacaaacaccaccacagcctctcggtgtccgacccagggggagccctccctcaatgaggaacaagataagcgctttgtttgcaaacatagcatggtggacagaggatggggcaacggctgtgggctgttcggaaagggcgggatcgtgacatgcgcgatgtttacgtgcaagaaaaatatggagggaaaggtcgtgcagcctgaaaacctggagtataccattgttatcacaccccactctggcgaagagaatgtggtcgggaacgataccggaaaacatggcaaggagattaaagtgacacctcagtccagcatcaccgaagccgagctcacgggctacgggaccgttacaatggaatgttctccccggaccggactggacttcaatgagatggtgcttctgcagatggaagataaggcttggctcgtccaccgccaatggtttctggaccttccgctgccttggctccccggcgccgatacacaggggtccaactggattcagaaagagaccctggtgacgttcaagaaccctcacgctaagaaacaggacgtcgtggttctgggaagccaagagggcgccatgcatacagccctcaccggggctacagaaatccagatgtcctctggcaatctgctttttaccggacacctgaagtgcagactccggatggacaaactgcagcttaagggcatgagctattccatgtgtaccgggaaattcaaggcggtgaaggagatcgccgaaacacaacatggaacgattgtcatcagagtgcagtacgagggcgatgggagcccctgcaaaattcccttcgagatcatggacctggaaaagcgccacgttctcggacggctgattaccgtgaaccctatcgtcacagagaaagattctccggtgaatatcgaagctgagcccccttttggcgactcctacattatcattggggtggaacccggccagctgaagctcagctggttcaaaaagggatctagcatcggccagatgtttgagaccacaatgagaggggccaagcgcatggccattctgggagataccgcttgggacttcggctcccttgggggagtttttacgtctatcggcaaagccctgcatcaagtcttcggggcgatttatggcgctgcctttagcggagtgtcctggacaatgaagatcctcatcggcgtggtcattacctggatcgggatgaacagccggtctacctccctgagcgtgtctctggttcttgtgggagtcgtgacactctacctgggcgttatggtgcaggccgattccgggtgtgtcgtgagctggaaaaataaggagctgaaatgcggatccggcattttcatcaccgacaacgttcacacatggacggaacagtataagtttcagcctgagtctcccagcaagctcgcttccgccattcaaaaagctcacgaagaggggatctgtggcatcagatctgtgacccgcctggaaaatcttatgtggaagcagattacaccggagctgaaccatatcctcagcgagaatgaagtcaaactgaccattatgacaggagatatcaagggcattatgcaggccgggaaacggtccctgagacctcagcccaccgagcttaagtacagctggaaagcgtggggaaaggccaagatgctctctacggaactgcacaaccataccttcctgatcgacggccctgagacagctgaatgccccaataccaaccgcgcctggaactccctcgaggtggaggattatgggtttggagtgttcacaaccaacatctggctgaaacttaaggaacggcaagacgtcttttgtgacagcaaactgatgtctgctgccattaaggataatagagcggttcacgccgacatgggctactggatcgagtccgctctcaacgatacatggaaaattgaaaaggccagcttcatcgaggtgaagtcttgccactggcctaaaagccataccctgtggtccaacggcgtgctggagagcgaaatgattatccccaagaatttcgctgggccggtctctcagcacaactatcgccctggataccatacgcagacagccggcccctggcaccttgggaaactcgagatggactttgatttctgtgaaggaaccaccgtggttgtgacagaggactgcggcaatcgggggccctccctgagaaccacgacagccagcggaaagctgatcaccgaatggtgctgtcggtcctgcacactccctccgctgcgctacagaggcgaggatggctgttggtatgggatggagattcggccccttaaagaaaaggaggaaaacctggtcaattctctcgtgaccgctggacatggccagatcgacaactttagcctgggggttctgggaatggcgcttttcctcgaggaaatgctgagaacacgcgtgggcaccaagcacgccattctgctcgtcgctgtgtcctttgttacgctgatcaccgggaatatgtctagccgggatcttggaagagtgatggtcatggtgggcgccacaatgaccgacgatattggcatgggggtgacatacctggccctcctggctgccttcaaagtccgccctacctttgcggctggactgcttctgagaaagctcacgtccaaagagctgatgatgacaaccatcggcattgttctcctgtctcaaagctccatccccgagacaatccttgaactgaccgacgccctcgccctggggatgatggtgctgaagattgtgcggaacatggagaaatatcagcttgctgtcaccatcatggccattctgtgcgtgcctaatgcggttatcctccagaacgcttggaaggtgagctgtacaacgctggccgtcgtgtctgttagccccctcctgcttaccagctctcaacagaaggccgattggattcctctggctctcacaatcaaaggactgaatcccaccgccatcttcctgacaaccctttcccgcacgagcaagaaaagatcttggccgctgaacgaagctattatggccgtgggcatggtctccatcctcgcgagctccctgctcaagaatgacattcctatgacagggcccctggtggccggaggccttctgaccgtctgctacgtgctggctggccggagcgccgacctcgagctggaacgcgctgccgatgttagatgggaggagcaggccgaaatctctgggagctcccctattctttctatcaccatcagcgaggacggaggcatgtccattaaaaacgaagaggaggaacagacactgaccatcctcattcggacagggctgctcgtgatctctggactgtttcccgtcagcattccgatcacggctgcggcctggtatctttgggaggtgaagaaacaacgcgctggcgttctgtgggatgtgccttctccccctcccgtcgggaaggccgaactggaggacggagcctacagaattaagcagaaaggcatcctcggctatagccagatcggggctggagtgtacaaggaaggcaccttccacacaatgtggcatgtgaccagaggggccgttctgatgcacaaaggaaagcgcattgagcccagctgggcggatgtcaaaaaggaccttatctcctacggcgggggatggaagctggagggcgaatggaaagagggcgaagagattcaggtgctcgctctggaacctgggaagaatccgagagccgtgcaaacaaaacccggactctttaagaccaacacgggcaccatcggggccgtcagcctggatttctctcctggaacatccggcagccccattgtggacaaaaaggggaaggttgtgggactttatggcaacggcgtcgtgacccggtctgggacatacgtttccgctatcgcccagaccgagaaaagcatcgaggataatcctgaaattgaggacgatatctttagaaagaaacgcctgacaattatggacctgcatcccggagcgggcaagacgaaacggtatctccctgctatcgtgagagaagccattaagcgcgggctgcggacccttatcctggccccgacaagagtcgtggctgccgagatggaagaggctctccgcggactgcccatccggtaccagacccctgccattagagcggagcacaccggccgcgaaatcgttgatctcatgtgtcatgccacattcacgatgcggctgctttcccccattagagtgcctaactataatctgatcattatggacgaggctcacttcaccgaccccgcctctatcgctgcccgggggtacattagcacacgcgtcgaaatgggcgaggccgctggaatctttatgaccgcgacaccgcctggctccagagatcccttcccccagagcaacgcccctatcatggacgaggaacgggagattcccgaacgctcttggaactccgggcacgagtgggtgaccgattttaagggaaaaacggtgtggttcgtccctagcatcaaggctggcaacgacattgccgcctgcctgcgcaaaaatgggaagaaagttatccaactctctcggaagacatttgatagcgaatatgtgaagaccagaaccaacgactgggatttcgtggtcacaaccgacatttccgagatgggagctaattttaaagccgagcgcgtgatcgatccgcggagatgtatgaagcccgttatcctgacagacggcgaagaaagagtgattcttgcggggcctatgcccgtcacccattctagcgctgcccagcggagaggccgcgtgggacggaaccctaaaaatgaaaacgatcagtacatctacatgggcgagcccctggaaaatgacgaggactgcgcccactggaaggaggctaaaatgctcctggataacattaatacgccggaagggatcattccttccatgttcgagcccgaaagagagcgcgttgacgccatcgatggagaatatagactgcggggcgaggcgcgcaagacatttgtggacctcatgagaagaggggatcttcctgtctggctggcctaccgcgtggctgccgagggaatcaactatgctgacagacggtggtgtttcgatggcgtcaaaaacaatcaaattctggaagagaacgtggaagttgagatctggaccaaggagggggaaagaaagaaactcaagccccgctggctggacgcccggatttactctgatcctcttgctctgaaagagtttaaggagttcgccgcgggcagaaaaagcctcacactgaatctgatcaccgagatgggacgcctccccacgttcatgacccagaaggcccggaacgctcttgacgatctggccgtgctgcatacagctgaagccggcgggagagcctataatcacgctctctccgagctgccggagacccttgaaacactgctcctgctgaccctccttgcgacagtgaccggaggcatttttctgttcctgatgagcgggaagggaatcggcaaaatgacgctcggcatgtgctgcattatcacagcctctgtcctgctttggtacgctcagatccagcctcactggattgccgcctccatcattctggagtttttcctcatcgttctgctgattcccgaacccgagaagcaacggacccctcaggacaaccagctcacctatgtggctatcgccatccttacagtggtcgcggccaccatggctaatgaaatggggtttctggagaaaacaaagaaagatttcggactgggcagcattgccacgcagcaaccggagtccaacatcctcgacctggaccttcgccccgcttctgcctggaccctgtacgcggtggccacaacctttattacacctatgctcagacatagcatcgaaaattcctctgttaacgtgagcctgaccgctattgccaatcaggctacggtcctgatggggctcggaaagggctggcccctttccaagatggatatcggggtgcctctgctggccatcggatgttacagccaggtcaaccccattaccctcacagctgccctgcttctgctcgtggcgcactatgccatcattggccctggcctgcaggctaaagccacccgggaggctcaaaagcgcgccgccgcggggatcatgaaaaatccgacagttgacggaattaccgtgatcgatctggaccccattccttacgatcccaagttcgaaaaacagctcggccaggtcatgcttctggtgctgtgcgttacacaggtgctcatgatgagaacaacctgggctctgtgtgaggcccttacactggctaccgggcctatctctaccctctgggaaggaaaccccggccggttttggaatacaacgatcgccgtctccatggccaacattttccgcgggagctatctggctggagtgggcctgctcttttctatcatgaagaataccgccaacacaagacggggcaccgggaacacaggagagacccttggcgagaagtggaaaaatcgcctgaacgcgctggggaagtccgagttccaaatttacaaaaagagcggaatccaggaggtggacagaacgctcgccaaagaaggcattaagagaggggaaacagatcatcacgctgtttctagaggaagcgccaaactgcgctggtttgtcgagcggaatcttgtgaccccggaaggcaaggtgatggacctgggctgcgggagaggaggctggtcctattactgtgggggactcaagaacgtcaaagaggttaagggcctgaccaaagggggacctggccatgaagaacccatccccatgtctacatatggctggaatctggtgcgcctccagagcggggtggatgtcttcttcgctcctcccgaaaagtgcgacacccttctgtgtgatatcggagagtccagccctaacccgacagtggaggccggccggacgctgagagttctcaatctggtggaaaactggcttaataacaatacccaattttgcattaaagtcctgaacccctacatgccttccgtgatcgagaagatggaagcgctccagcgcaagtacgggggagccctggttcggaatcccctgtctagaaacagcacacacgagatgtattgggtgtccaatgcttctggcaacattgtcagctccgtgaacatgatctctcgcatgctcattaatcggttcaccatgagacacaaaaaggccacatacgaacctgacgtggatcttgggagcggaacccgcaacatcggcatcgagtccgagattcccaatctggacatcattggcaaacggatcgaaaagattaaacaggagcatgaaacgagctggcactatgaccaggatcatccgtacaagacctgggcttatcacgggtcttacgagacaaagcaaaccggatccgccagctctatggtcaacggcgttgtgagactgctcacaaaaccttgggacgtgatccccatggtcacccagatggctatgacagataccacgccttttgggcagcagcgcgtgttcaaggaaaaagttgacacaagaacccaagagcccaaggagggaaccaaaaagctgatgaagatcacagccgaatggctttggaaagagctgggcaagaaaaagacgcctcggatgtgtacccgcgaagagtttacaagaaaagtgcggtccaatgcggccctcggggctattttcaccgatgagaacaagtggaaaagcgccagagaagctgtcgaggactctggattttgggaactggtggataaggagcggaatctgcacctcgaaggcaagtgcgagacatgtgtttataacatgatgggcaaacgcgagaagaaactgggggagttcggaaaggccaaaggctccagagccatctggtacatgtggcttggggcgcggtttctggagttcgaagctctcggatttctgaatgaggaccattggttcagccgcgaaaactcccttagcggcgtggagggggagggcctgcacaagctcggatacattctgagagaagtctctaagaaagagggcggggccatgtatgccgatgacaccgctggatgggatacacggatcaccctggaagacctcaagaatgaggaaatggtgacgaaccatatggagggcgagcacaaaaagctggccgaagctatttttaaacttacctaccagaataaggttgtgcgcgtccagagacccacaccgcgggggaccgtgatggacatcattagccgcagagatcagcggggatccggccaagtcgtgacatatgggctgaacaccttcacgaatatggaggcccagctcatccgccagatggaaggcgagggagttttcaagtctatccaacatctgacagtgaccgaggaaattgcggtcaaaaactggcttacaagagtgggccgggagcgcctgagcagaatggccatctccggggacgattgcgtggttaagcctctcgacgatcggtttgcttctgccctgaccgctctgaacgacatgggaaaagtgagaaaggatattcagcagtgggaacccagccgcggctggaatgactggacgcaggtccccttctgctcccaccactttcatgagctcatcatgaaagatgggcgggtgctggttgtgccttgtagaaaccaagacgaacttattggacgcgcccggatctctcagggcgcggggtggagcctgagagagaccgcctgcctcggcaagtcctacgctcagatgtggagcctgatgtatttccaccgccgggatcttagactggccgctaatgccatctgttctgctgtcccgtcccattgggtgcccacaagccgcaccacatggtctattcacgccacccacgagtggatgacaaccgaagacatgctcacggtctggaaccgggtgtggatccaggagaatccttggatggaagataagacacccgttgagtcctgggaagagattccttacctgggaaaaagagaggaccaatggtgcggcagcctgatcgggctcacctcccgcgcgacctgggccaagaacattcagacagctatcaatcaggtgcggtctctgatcggaaacgaagagtataccgactacatgcccagcatgaaaagatttcggagagaagagggcgaagccggggtcctttggtga

SEQ ID NO: 20180 - RNA, 9876 nt, synthetic construct
  misc_feature 1..9876: note = derived and/or modified CDS sequence (opt5) from DENV-2__DQ448231__SS-prME
  source 1..9876: mol_type = other RNA
accgccggcgtgatcattatgctgatccccacagctatggccttccacctcacgaccagaaacggggagcctcatatgattgtcagccggcaggaaaagggaaaatccctgctttttaagacagaggacggcgttaatatgtgcaccctgatggcgatggatctcggggaactgtgtgaggacacaatcacctacaactgcccgcttctgcgccaaaatgaacccgaggatattgactgttggtgcaactctacaagcacctgggtgacgtatggaacctgtacagctaccggcgagcacagacgggaaaaacgctccgtggccctcgtccctcatgtggggatgggactggagacaagaaccgaaacgtggatgtctagcgagggcgcctggaagcacgctcagcggatcgagacatggatcctgcgccatcccggcttcaccattatggccgctatcctcgcctacacaattgggaccacctattttcagagagttctgatcttcattcttctgacagcggtggccccttccatgacgatgcggtgcatcggaatttctaatcgcgattttgtcgaaggcgtgagcgggggatcctgggttgacatcgtgctcgagcacggcagctgtgtcaccacaatggctaaaaacaagcccaccctggatttcgaacttatcaagacagaggccaaacagcctgctaccctgagaaagtactgcattgaagccaaactcacgaatacaaccaccgcgtctcggtgtccgacacaaggggagccctccctgaacgaggaacaggacaagcgctttgtgtgcaaacacagcatggtggatagaggatggggcaatggctgtgggctgttcggaaagggcgggatcgtcacctgcgccatgtttacatgcaagaaaaacatggagggaaagattgttcagcctgaaaatctcgagtatacgatcgtggtgaccccccattctggcgaagagaacacagtcgggaatgacaccggaaaacacggcaaggagattaaagtgacacctcagtccagcatcaccgaagctgagctgacgggctacgggaccgttacaatggaatgttctccccggaccggacttgatttcaacgagatggtgctgctccaaatggaaaataaggcctggctggtccatcgccagtggtttcttgacctgccgctcccttggctgcccggcgctgatacacaggggtccaactggatccagaaagagaccctggtgacgttcaagaaccctcacgccaagaaacaagacgttgtggtcctcggaagccaggagggcgccatgcacacagctctgaccggggcgacagaaattcagatgtcctctggcaatcttctgtttaccggacatctcaagtgcagactgcggatggacaaacttcaactgaagggcatgagctattccatgtgtaccgggaaattcaaggtggtcaaggagatcgccgaaacacagcacggaacgattgtggttagagtgcagtacgagggcgatgggagcccctgcaaaatccccttcgagattatggacctcgaaaagcgccatgtcctgggacggctgatcaccgtgaaccctatcgttacagagaaagattctccggtgaatattgaagctgagcccccttttggcgactcctacatcattatcggggtcgaacccggccagctcaagctgagctggttcaaaaagggatctagcattggccaaatgtttgagaccacaatgagaggggccaagcgcatggccatccttggagataccgcttgggacttcggctccctggggggagtgtttacgtctattggcaaagccctccaccaggtgttcggggcgatctatggcgctgcctttagcggagtttcctggacaatgaagatcctgattggcgtcgtgatcacctggattgggatgaacagccggtctacctccctgagcgtgtctcttgtcctcgtgggagttgtgacactgtacctgggcgtcatggtgcaggccgattccgggtgtgttgtgagctggaaaaataaggagctcaaatgcggatccggcatcttcattaccgacaacgtccatacatggacggaacagtataagtttcaacctgagtctcccagcaagctggcttccgccatccagaaagctcacgaagaggggatctgtggcattagatctgtgacccgccttgaaaatctgatgtggaagcagatcacaccggagctcaaccacattctgagcgagaatgaagttaaactgaccatcatgacaggagatattaagggcatcatgcaggccgggaaacggtcccttagacctcaacccaccgagctcaagtacagctggaaaacgtggggaaaggcgaagatcctgtctaccgaacctcataaccagacattcctgattgacggccccgagaccgccgaatgccctaatacaaaccgcgcttggaattccctcgaggtggaggattatgggtttggagtcttcaccacaaacatctggctgaaacttaaggaacggcaggacgtgttttgtgacagcaaactgatgtctgccgctattaaggataatagagccgtgcacgcggacatgggctactggatcgagtccgccctcaacgatacctggaaaattgaaaaggctagcttcatcgaggtcaagtcttgccattggcccaaaagccacacgctgtggtccaacggcgttctggagagcgaaatgatcattccgaagaatttcgccgggcctgtgtctcagcacaactatcgccccggataccatacacaaaccgctggcccctggcaccttgggaaactcgagatggactttgatttctgtgaaggaaccacagtggtcgtgaccgaggactgcggcaatcgggggccttccctgagaacgacaaccgccagcggaaagctgatcacagaatggtgctgtcggtcctgcaccctcccgcccctgcgctacagaggcgaggatggctgttggtatgggatggagattcggcctcttaaagaaaaggaggaaaacctggttaattctctcgtgacagccggacatggccagatcgacaactttagcctgggggtcctgggaatggctcttttcctcgaggaaatgctgagaacccgcgtgggcacgaagcacgcggttctgctcgtggccgtctcctttatgaccctgattacagggaatatgtctttccgggatcttggaagagtgatggttatggtgggcgctgccatgaccgacgatatcggcatgggggtcacatacctggccctcctggctgcctttaaagtgcgccccaccttcgcggctggactgcttctgagaaagctcacgagcaaagagctgatgatgacaaccattggcatcgtgctcctgtcccagtctacaatccctgagaccattcttgaactgaccgacgccctcgccctggggatgatgatcctgaagattgtccggaacatggagaaatatcaacttgctgttacaatcatggccattctgtgcgtgcccaatgcggtgatcctccagaacgcttggaaggtcagctgtacgatcctggccgtggtttccgtgagccctctcctgcttacctcttcccagcagaaggccgattggattcccctggctctcacaatcaaaggactgaatccgaccgccatttttctgacaacccttagccgcacgaacaagaaaagatcttggcctctgaatgaagctatcatggccgtcggcatggtgtccattctcgcgagctctctgctcaagaacgacatccccatgacagggcctctggttgccggaggccttctgaccgtgtgctacgtcctgaccggccggtccgctgacctcgagctggaacgcgccgctgatgtgagatgggaggaccaagccgagatcagcgggtccagccccattctttctatcacaattagcgaagatggatccatgtctatcaaaaatgaggaagaggagcagaccctgacaattctcatccggacgggcctgctcgtcattagcgggctgttcccggtgtccatccctatcaccgccgctgcgtggtatctttgggaagttaagaaacagcgcgccggagtgctgtgggacgtcccctctcctccccccgtgggcaaggctgagctggaagatggggcctacagaattaagcagaaaggaatcctcggctatagccaaattggcgccggggtttacaaggagggaacatttcataccatgtggcacgtgacacggggcgctgtcctgatgcacaaagggaagcgcatcgaaccttcctgggccgacgtgagaaaagatcttatttcttacggaggcgggtggaagctggagggagagtggaaggaaggcgaggaagtgcaggttctcgcgctggagccgggcaaaaacccccgggctgtccagaccaagcctgggctcttcaaaacgaacaccggaacaatcggcgccgtgagcctggacttttcccccgggaccagcggatctcctatcgtggataagaaaggcaaggtcgtggggctttatggaaatggcgttgtgacaagatccggcacctacgtcagcgccattgctcagacagaaaagtctatcgaggacaaccccgagattgaagatgacatcttccgcaaaaagcggctgacgattatggatctgcatcctggggccggaaaaaccaagagatatctcccggcgatcgtgcgcgaggctatcaaacggggcctgagaacacttattctggcccccacccgcgttgtggccgctgaaatggaggaagccctccgggggctgcctatcagataccaaacccccgctattcgcgccgagcacacaggacgggagatcgtcgacctcatgtgtcatgcgacgttcaccatgagactgctttcccctgtgcgggttcccaattataacctgattatcatggacgaagcccactttacagatccggctagcattgccgctcgcggctacatctccaccagagtggagatgggggaagccgccggcatcttcatgacagctacccctcccggatctcgggacccctttcctcagagcaatgcgcccattatggatgaggagcgcgaaatccctgagagatcctggaacagcggccatgaatgggtcacggacttcaaggggaagacagtgtggtttgtgccgtctattaaagccggaaatgatatcgctgcctgcctgcggaagaacggcaaaaaggtcattcagctctccagaaaaaccttcgacagcgagtatatcaagacccgcacaaatgattgggactttgttgtgaccacagatatctctgaaatgggggccaacttcaaggctgagcgggtgattgaccccagacgctgtatgaaacctgtcatcctgaccgatggagaggaacgggtgattcttgccggccccatgcctgttacgcacagctccgcggctcaaagacgcgggcggatcggcagaaatcccaagaacgagaatgaccagtacatttacatgggagaaccgctggagaacgacgaagattgcgcccactggaaagaggccaagatgctcctggacaatatcaacacacctgagggcatcattccctctatgtttgaacctgagcgcgaaaaagtggatgctatcgacggggagtatagactgcggggagaagcccgcaagaccttcgtcgatctcatgagacggggcgaccttcccgtgtggctggcgtaccgcgttgccgctgaggggattaactatgccgatagacggtggtgttttgacggaatcaaaaataaccagattctggaggaaaatgtggaggtcgaaatctggacaaaggagggcgagagaaagaaactcaagcctcgctggctggatgctcggatttacagcgacccccttgccctgaaagaattcaaggagttcgctgccgggagaaaatccctcaccctgaacctgatcacggaaatgggccgcctcccgacctttatgacacagaaggcgcggaatgcccttgataacctggctgtgctgcataccgccgaggctggaggcagagcctataatcacgccctctctgaactgcctgagacacttgagaccctgctcctgctgacactccttgctaccgtcacggggggaatcttcctgtttctgatgagcggcaaggggattggaaaaatgacactcggcatgtgctgcatcattaccgcgtccatcctgctttggtacgcccaaattcagccccattggatcgctgccagcatcattctggaattctttctcatcgtgctgctgattcccgagcctgaaaagcagcggaccccgcaggacaaccaactcacatatgttgtgatcgccattcttaccgtggtcgctgccacaatggcgaatgagatgggcttcctggaaaaaacgaagaaagattttgggctgggatctatcgccacccagcagcccgagtccaacatcctcgacattgacctgcgccctgctagcgcctggacactttacgctgttgccaccacattcatcacccccatgctgagacactccattgagaattctagcgtgaacgtgtccctcacggcgatcgccaatcaggctaccgtcctgatgggcctggggaagggatggcctctctctaagatggatattggcgtgccccttctggccatcgggtgttacagccaagttaaccctattacactgaccgctgccctcctgcttctggtggctcactatgccatcatcggaccgggcctccaggcgaaagccacacgggaagctcagaagcgcgccgctgccggcattatgaaaaatcccaccgtcgacgggatcacggtgattgatctggaccctatcccctacgatcctaagtttgagaaacagctgggacaagtcatgctccttgtgctgtgcgttacacaggtgctgatgatgagaaccacatgggccctctgtgaagcgctgacccttgctaccggccccatttccacactgtgggaggggaacccgggacggttctggaatacgaccatcgccgtcagcatggctaacatctttcgcggctcttatctcgccggggccggactgctgttctccattatgaagaacacaaccaatacaagacggggcaccggcaacacgggggaaacactcggagagaagtggaaaaatcgccttaacagcctgggcaagtctgagtttcagatctacaaaagatccgggattcaagaagtggaccggaccctggctaaggagggaatcaaaagaggcgaaaccgatcatcacgccgttagccgcgggtctgcgaagctccggtggttcgtggagagaaatctggtcacacctgagggaaaagtggtggaccttggctgcggccgcgggggatggagctattactgtggcgggctgaagaacgttcgggaagtcaagggactcaccaaaggcgggcccggacatgaggaacccattcctatgtccacatatggctggaatctggtgagactgcagtctggcgtggatgtcttctttacgccccctgagaagtgcgacaccctcctttgtgatatcggggaaagctccccgaaccccacagttgaggccggacgcaccctgcgggtgctgaatctcgtggagaactggctgaataacaatacacagttctgcatcaaagtccttaacccttacatgcccagcgtgattgaaaagatggagaccctgcagagaaaatacggcggggctctcgttcgcaatcctctgtcccggaactctacgcacgaaatgtattgggtgagcaacgcctccggaaatatcgtctctagcgtgaacatgatttccagaatgctgatcaatcgctttaccatgcggcataagaaggctacatacgagcccgacgttgatctcggctctgggaccagaaacattggaatcgaaagcgagacaccgaatcttgacatcattggcaaacgcatcgagaagattaaacaagaacacgagacctcctggcactatgaccaggatcatccttacaagacatgggcctatcacggcagctacgaaaccaaacagacggggtctgcgtccagcatggtgaacggagtcgtgagactgctgacaaagccctgggacgtgatccctatggtcacccagatggccatgaccgatacaacgcccttcggccaacagcgggtttttaaggagaaagtggacacccgcacacaggaacctaaggaggggaccaaaaagctcatgaaaattacagctgagtggctgtggaaggaacttggaaagaaaaagacccccagaatgtgtacacgggaggaattcaccagaaaagtgcggtctaatgccgctctgggcgccatctttacggatgagaacaagtggaaatccgctcgcgaggccgtcgaagacagcagattctgggagctcgtggataaggaacggaatctgcatctggaggggaaatgcgaaacctgtgtttataacatgatgggaaagcgcgagaagaaaattggcgagtttggcaaggcgaaagggtctagagccatctggtacatgtggctcggagctcggttcctggaatttgaggcccttggcttcctgaatgaagaccactggttttcccgcgagaacagcctctccggggtggaaggagagggcctgcacaagcttgggtacatcctgagagaggtcagcaaaaaggaaggcggagctatgtatgccgatgacacagccggctgggatacccggattacactcgaggacctgaagaatgaagagatggtgaccaaccatatggaaggggagcacaaaaagctggcggaggctatcttcaaactcacgtaccagaataaggttgtgcgcgtccaaagaccgacacctcggggaaccgtgatggacattatctctcgcagagatcagcggggcagcgggcaggttggaacatatggcctgaacaccttcacgaacatgggggcccaacttattcgccagatggaaggcgagggagtgtttaaaggcatccagcatctgaccgccacagaagaggtcgctgtgcaggactggctcgccagagtcgggcgggagagactgtcccgcatggctatctctggagatgactgcgtggttaagccccttgatgaccggttcgccagcgcgctgaccgccctcaatgatatgggcaagattagaaaagacatccaacagtgggaaccctcccgcgggtggaacgattggacacaggtgcctttttgctctcaccatttccacgagctgattatgaaggacggacgggtcctggtggtgccgtgtagaaatcaggatgaactcatcggccgcgctcggattagccaaggggccggctggtccctgagagagaccgcttgccttggaaaatcttacgcccagatgtggagcctgatgtattttcaccgccgggacctcagactggcggccaacgctatctgttccgccgttcccagccattgggtgcctacatctcgcaccacgtggtccatccacgctcggcatgaatggatgacaaccgaggatatgcttaccgtctggaatagagtgtggattcaggagaacccctggatggaagacaagacacctgttgagagctgggaagagatcccctacctgggcaaacgggaagaccagtggtgcgggtctctcattggactgacctccagagccacatgggctaagaatatccaaacggccattaaccaggtgcgcagcctgatcggctccgaggagtataccgattacatgccttctatgaagcggttcagacgcgaagaggaagaggcgggggtcctctggtga

SEQ ID NO: 20181 - RNA, 9876 nt, synthetic construct
  misc_feature 1..9876: note = derived and/or modified CDS sequence (opt5) from DENV-2__JX470186__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattaccccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgctcaccgccaatggtttctggatcttccgctgccttggctccccggcgccgacacccaggggtccaactggattcagaaagagacactggtcaccttcaagaatcctcacgccaagaaacaggatgtggttgtgctgggaagccaagagggcgctatgcatacggcgctcacaggggccaccgaaatccagatgtcctctggcaacctgctttttacaggacacctgaagtgcagactccggatggacaaactgcagcttaagggcatgagctattccatgtgtaccgggaaattcaaggtcgtgaaggagattgctgaaacccaacatggaacaatcgtcattagagtgcagtacgagggcgacgggagcccctgcaaaatccccttcgagatcatggatctggaaaagcgccacgttctcggacggctgattacggtgaatcctatcgtcaccgagaaagactctccggtgaacattgaagccgagcccccttttggcgattcctacatcattatcggggttgaacccggccagctgaagctcagctggttcaaaaagggatctagcattggccagatgtttgagacaaccatgagaggggccaagcgcatggctatcctgggagacacagcctgggatttcggctcccttgggggagtgtttacctctatcggcaaagcgctgcatcaagtcttcggggctatttatggcgccgcctttagcggagtgtcctggacgatgaagatcctcattggcgtggttatcacatggattgggatgaatagccggtctacctccctgagcgtctctctggtgcttgtgggagtcgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaaatgaaggaacggcaagatgtgttttgtgacagcaaacttatgtctgccgcgatcaaggactccagagccgtccacgctgatatgggctactggattgagagcgccctgaacgacacctggaaaatcgaaaaggcttctttcatcgaggtgaagagctgccactggcctaaatcccatacactctggagcaacggcgtgctggagtctgaaatgattatccccaagaatttcgccgggccggtctcccagcacaactatcgccctggataccatacccagacggccggcccctggcacctggggcggcttgagatggattttgacttctgtgaaggaacaaccgttgtggtgaccgaggattgcggcaatagagggcccagcctccggacaaccacggcttccggaaaactgattacagaatggtgctgtcgctcttgcaccctgcctccgctcagataccggggcgaggacggctgttggtatgggatggagatcagacccctgaaggaaaaagaggaaaaccttgtcaatagcctggtgacagcgggacatggccagattgataacttttccctcggggttctgggaatggccctgttccttgaggaaatgctccgcacccgggtgggcacaaagcacgctatcctgctggtcgccgtgtcttttgttaccctcattacggggaatatgagcttcagagacctgggacgcgtgatggtcatggtgggcgccaccatgacagatgacatcggcatgggggttacctaccttgctctgctcgccgcgtttaaggtgagacctacattcgctgccggactgctgcttcggaaactgacctccaaggagctcatgatgacgacaatcggcattgtcctgctctctcaagccaccatccccgagacaattctggaacttaccgatgctctggccctcgggatgatggtgctgaaaatcgtgcgcaacatggagaagtatcagctggcggtcaccattatggctatcctttgcgttcctaatgccgtgatcctgcagaacgcctggaaagtgagctgtacaacgctcgctgtcgtgtccgttagccccctgctcctgacctcttcccaacagaaggccgactggattcctcttgctctgacaatcaagggactcaatcccaccgccatttttctgacaaccctgagcagaacgaacaaaaagcggtcttggccgcttaatgaagcgatcatggccgtgggcatggtctccattctggctagctctctcctgaaaaacgatatccctatgacagggcccctcgtggccggaggcctgcttaccgtttgctacgtgctgaccggccgctccgctgacctggagctcgaaagagccgccgacgtccggtgggaggagcaggctgaaatcagcgggtccagccctattctgtctatcacaattagcgaggatggatccatgtctatcaagaatgaagaggaggaacagacccttacaattctgatccgcacgggcctcctggtggtcagcgggctcttccccgtgtccaccccgattacagcggccgcttggtatctgtgggaggttaaaaagcaaagagccggagtgctttgggacgtcccttctccccctcccgtgggcaaagccgaactggaggatggggcttaccggatcaagcagaagggaatcctgggctatagccagattggcgccggggtttacaaagaaggaacctttcacacaatgtggcatgtgacccgcggcgcggtcctcatgcacaaggggaaaagaatcgagccctcctgggctgacgtgaagaaagatctgatttcttacggaggcgggtggaagcttgagggagaatggaaggagggcgaagaggtgcaggttctggccctcgaacctggcaaaaacccgcgggccgtccaaacgaagcccgggctgttcaaaaccaacacaggaaccatcggcgctgtgagcctcgacttttcccctgggacaagcggatctcccattgtggataagaaaggcaaggtcgtggggctgtatggaaatggcgttgtgaccagatccggcacatacgtcagcgccatcgcgcagacggagaagtctatcgaggacaaccctgaaattgaggatgacatcttccgcaaaaagcggcttaccattatggatctgcatcccggggctggaaaaacaaagagatatctgcctgccatcgtgcgcgaagccattaaacggggcctcagaaccctgatccttgctccgacccgcgttgtggccgctgagatggaagaggccctgcgggggctccccatcagataccagacacctgcgattcgcgccgagcacacgggacgggaaatcgtcgacctgatgtgtcatgctaccttcacaatgagactcctgtcccccattcgggtgcctaattataaccttatcattatggatgaggcccactttaccgaccccgctagcatcgccgcccgcggctacatttccacaagagttgaaatgggggaggctgcgggcatcttcatgaccgccacgccgcctggatctcgggacccctttccccagagcaatgctcctatcatggatgaggaacgcgagattcccgaaagatcctggaacagcggccacgagtgggtgacagacttcaaggggaagaccgtctggtttgtgccttctatcaaagccggaaatgatattgccgcttgcctgcggaagaacggcaaaaaggtgatccaactgtccagaaaaaccttcgacagcgaatatattaagacacgcaccaatgattgggactttgtcgttacaaccgatatctctgagatgggggccaacttcaaggcggagcgggtgatcgacccgagacgctgtatgaaacccgtgattctcacggatggagaagagcgggtcatcctggctggccctatgcccgtgacacatagctccgccgcccagagacgcgggcgggttggcagaaatcctaagaacgaaaatgaccagtacatttacatgggagagccccttgaaaacgatgaggactgcgctcactggaaagaggccaagatgctgctcgacaatatcaacaccccggaaggcattatcccttctatgtttgagcccgaacgcgagaaagtggatgcgatcgacggggaatatagactgcggggagaggcccgcaagacattcgtcgatctgatgagacggggcgacctccctgtgtggcttgcttaccgcgttgccgctgaggggattaactatgccgatagacggtggtgttttgacggagtgaaaaataaccaaatcctggaagagaatgtcgaagtggagatttggaccaaggagggcgaaagaaagaaactgaagccccgctggctcgatgctcggatctacagcgaccctctggcccttaaagagttcaaggaattcgcggccgggagaaaatccctgacgctcaacctgattaccgagatgggccgcctgcccacatttatgacccagaaggctcggaatgccctcgataaccttgctgtcctgcatacagccgaagccggaggcagagcttataatcacgcgctgtctgagctcccggagaccctggaaacacttctgctcctgaccctgctcgccacggtgacagggggaatcttcctttttctgatgagcggcaaggggattggaaaaatgaccctgggcatgtgctgcatcatcaccgcttccattctcctgtggtacgcccagatccagcctcactggattgccgctagcatcattcttgagttctttctgatcgttctcctgatccccgaacccgagaagcaacggacacctcaggacaaccagctgacctatgtggtgattgccatcctcacagtcgttgcggccacgatggctaatgaaatgggcttccttgagaaaaccaagaaagattttgggctgggatctattacaacccagcaaccggagaacaatatcctggacattgatctccgccccgcctccgcttggacactgtacgccgtggcgaccacgttcatcacccctatgcttagacatagcatcgaaaactcctctgtgaatgtcagcctgacagccattgctaaccaggccaccgtgctcatgggcctggggaagggatggcccctgtccaagatggacatcggcgttcctctccttgctattgggtgttactctcaggtgaatcccatcacactgaccgccgctctgctcctgcttgtcgcccactatgcgattatcggacctggcctgcaggccaaagctacgcgggaggcccaaaagcgcgctgccgccggcattatgaaaaacccgacagtggacgggatcaccgtcatcgatctcgaccccattccttacgatcccaagtttgaaaaacagctgggacaggtgatgctgctcgttctttgcgtgacacaggtcctgatgatgagaaccacctgggcgctgtgtgaggctctcacactggccacgggccctatcagcaccctttgggaagggaatcccggacggttctggaacacaaccattgctgtgtccatggccaacatctttcgcggcagctatctggccggggctggactcctgttctctattatgaagaatacagccaacaccagacggggcacgggcaatacaggggagaccctgggagagaagtggaaaaaccgcctcaatgcgcttggcaagtccgaatttcaaatctacaaaaagagcgggatccaggaggttgacagaaccctggccaaagaaggaattaagcggggcgagacagatcatcacgctgtgtctagagggtccgccaaactgcgctggttcgtcgagcggaacctcgtgaccccggaaggaaaggtggttgacctgggctgcggcagagggggatggagctattactgtggcgggcttaagaatgtcaaagaggtgaagggactgacaaaaggcgggcctggacatgaagagcccatccccatgtctacgtatggctggaacctcgtgcgcctgcagagcggcgtcgatgttttctttacccctcccgaaaagtgcgacacactgctctgtgatattggggagtcctctcctaatccgaccgtggaggctggacggacacttagagtgctgaacctggtcgaaaattggctcaacaataacacccaattctgcatcaaagtgctgaatccctacatgcctagcgttattgagaagatggaagcccttcagcgcaagtacggcggggcgctggtgcggaaccccctctccagaaacagcacgcacgagatgtattgggtctccaatgcctctggaaacatcgtgagctccgttaatatgatctctcgcatgctgattaaccggtttaccatgagacacaaaaaggctacatacgaacctgacgtggatctgggcagcgggacccgcaatatcggaattgagtccgagacacccaacctcgacatcattggcaaacggatcgaaaagatcaaacaggagcatgaaacctcttggcactatgatcaggaccatccgtacaagacatgggcctatcacggcagctacgagaccaagcaaacggggtccgctagctctatggtcaatggagtggtgagacttctgacaaaaccttgggacgtcattcccatggttacccagatggccatgaccgatacaacgcctttcggccagcagcgcgtgtttaaggaaaaagtggacaccagaacacaagagcccaaggaggggaccaaaaagctgatgaagatcacagctgaatggctctggaaagagctgggaaagaaaaagacccctcggatgtgtacacgcgaagagttcaccagaaaagtccggtccaacgccgcgcttggcgccatttttacggatgagaataagtggaaaagcgctagagaagccgtggaggactctgggttctgggaactggttgataaggagcggaacctccacctggaaggaaagtgcgagacctgtgtgtataatatgatgggcaaacgcgagaagaaactgggcgaatttgggaaggctaaaggatccagagccatctggtacatgtggctcggcgcccggttcctggagtttgaagcgcttgggttcctgaacgaggaccattggtttagccgcgaaaattctctctccggagtcgagggcgaggggctgcacaagcttggctacattctgagagatgtgagcaagaaagaaggaggcgctatgtatgccgacgatacagccgggtgggacacccggatcacactcgaggatctgaagaacgaagagatggttaccaatcatatggaaggagagcacaaaaagctggctgaggccattttcaaactcacgtaccagaacaaggtggtccgcgtgcagagacccacaccgcggggcaccgttatggacatcatctcccgcagagaccagcgggggagcggacaagtggtcacatatggcctgaacaccttcacgaatatggaagctcagcttattcgccagatggagggggaaggcgtgtttaagtctatccaacagctgaccgtcacagaggagattgccgtgaaaaactggctcgttagagtgggacgggaacgcctgagcagaatggcgatctccggcgatgactgcgtcgtgaagcctcttgatgaccggttcgcctctgctctgaccgccctcaatgatatggggaaagtgagaaaggacattcagcagtgggagcccagccgcggatggaacgattggacacaagttcccttttgctcccatcacttccacgaactgatcatgaaagacggccgggtgctggtcgtgccttgtagaaatcaggatgagctcatcgggcgcgctcggatttctcagggagccggctggagcctgagagaaaccgcgtgccttgggaagtcctacgcccagatgtggtctctgatgtattttcatcgccgggacctcagactggctgccaacgctatctgtagcgccgttccgtcccactgggtgcccacaagccgcaccacgtggtctattcatgctacacacgagtggatgaccaccgaggatatgcttacagtctggaatcgggtgtggatccaagaaaacccttggatggaggacaagacccccgtcgaatcctgggaggaaattccttacctgggcaaaagagaggatcagtggtgcggaagcctcatcggcctgacatctcgcgccacgtgggcgaagaatatccagaccgccattaaccaggtgcggtccctgatcgggaatgaggaatatacagactacatgcccagcatgaaaagattccggagagaggaagaggaagctggagttctctggtga

SEQ ID NO: 20182 - RNA, 9876 nt, synthetic construct
  misc_feature 1..9876: note = derived and/or modified CDS sequence (opt5) from DENV-2__KU517846__SS-prME
  source 1..9876: mol_type = other RNA
accgccggcatcattatcatgatgattcccaccgtgatggctttccacctgacgaccagaaacggggagcctcatatgatcgtcagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggaatcgtgaccctctacctgggcgttatggtgcaggccgactccgggtgtgtcgtgagctggaaaaacaaggagctgaaatgcggatccggcatcttcattacagataatgttcacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcagcgagaacgaagtcaaactgacaatcatgaccggagacattaagggcatcatgcaggccgggaaacggtccctgagacctcagcccacagagcttaagtacagctggaaagcgtggggaaaggccaagatgctctctaccgaactgcacaatcatacgttcctgattgatggccctgagaccgctgaatgccccaacacaaatcgcgcctggaactccctcgaggtggaggactatgggtttggagttttcaccacaaatatctggctgaaacttaaggaacggcaagatgtgttttgtgacagcaaactgatgtctgctgccattaaggacaacagagcggtccacgccgatatgggctactggatcgagtccgctctcaacgacacctggaaaatcgaaaaggccagcttcattgaggtgaagtcttgccactggcctaaaagccatacactgtggtccaatggcgtgctggagagcgaaatgatcattcccaagaacttcgctgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggccagcggaaaactgatcacagaatggtgctgtcgctcctgcaccctccctccgctgagataccggggcgaggacggctgttggtatgggatggagattagaccccttaaggaaaaagaggaaaatctggtcaactctctcgtgacagctggacatggccagatcgataattttagcctgggggttctgggaatggcgcttttcctcgaggaaatgctgcgcacccgggtgggcacaaagcacgccattctgctcgtcgctgtgtcctttatgaccctgatcacggggaacatgtctttcagagaccttggacgcgttatggtgatggtcggcgccaccatgacagatgacatcggcatgggggtgacctacctggccctcctggctgcctttaaggttagacctacattcgcggctggactgcttctgcggaaactcaccagcaaggagctgatgatgacgacaattggcatcgtgctcctgtcccaatctaccattcccgagacaatccttgaactgaccgatgccctcgccctggggatgatggtcctgaaaattgtgcgcaatatggagaagtatcagcttgctgtgaccatcatggccatcctgtgcgtccctaacgcggttattctccagaatgcttggaaagtgagctgtacaatcctggccgtggtctccgtgagccccctcctgcttacgtcttcccaacagaaggccgactggattcctctggctctcaccatcaagggactgaaccccacagccatttttctgaccacacttagcagaacctctaaaaagcggtcctggccgctgaatgaagctatcatggccgttggcatggtgagcatcctcgcgtcttccctgctcaaaaacgatattcctatgacggggcccctggtcgccggaggccttctgacagtgtgctacgttctgaccggccgcagcgctgacctcgagctggaaagagccgctgacgtgcggtgggaggagcaggccgaaatctccgggagctctcctattcttagcatcaccatttccgaggatggatctatgagcatcaagaatgaagaggaggaactgacactcaccattctgatccgcacaggcctcctggtcatctccgggcttttccccgtgtctattccgatcacggccgctgcgtggtatctgtgggaggtcaaaaagcagagagccggagtgctgtgggacgttccttctccccctcccgtgggcaaagctgaactcgaggatggggcctaccggattaagcaaaagggaatcctgggctattcccagattggcgccggggtctacaaagaaggaacctttcacacaatgtggcatgtgacccgcggcgctgttcttatgcacaaggggaaaagaatcgagccctcctgggccgacgtgaagaaagatctgatcagctacggaggcgggtggaagctcgagggagaatggaaggagggcgaagaggtccaggtgctggcgctcgaacctggcaaaaacccgcgggctgtgcagacaaagcccgggctgttcaaaaccaacacgggaaccattggcgccgtttcccttgactttagccctgggacatctggatcccccatcgtcgataagaaaggcaaggtggtggggctgtatggaaatggcgtcgtgaccagaagcggcacatacgtttctgccattgctcaaaccgagaagtccatcgaggacaaccctgaaattgaggatgacatcttccgcaaaaagcggctgacaatcatggatctccatcccggggccggaaaaacgaagagatatctgcctgcgattgtgcgcgaagctatcaaacggggccttagaaccctgattctcgccccgacacgcgtcgtggccgctgagatggaagaggccctgcgggggctccccatcagataccagacccctgctattcgcgccgagcacaccggacgggaaatcgttgacctgatgtgtcatgcgacattcacgatgagacttctgagccccattcgggtgcctaattataacctgatcatcatggatgaggcccactttaccgaccccgcttccattgccgctcgcggctacatctctacaagagtcgaaatgggggaggccgccggcattttcatgaccgctacaccgcctggaagccgggacccctttccccagtccaatgcgcctatcatggatgaggaacgcgagattcccgaaagaagctggaactctggccacgagtgggtgaccgacttcaaggggaagacggtttggtttgtgccttccatcaaagccggaaatgatatcgctgcctgcctccggaagaacggcaaaaaggtcattcagctgagcagaaaaacattcgactctgaatatatcaagacccgcaccaatgattgggactttgtggtgacaaccgatattagcgagatgggggccaacttcaaggctgagcgggtcatcgacccgagacgctgtatgaaacccgttattcttacagatggagaagaacgggtgatcctggccggccctatgcccgtgacccattcctctgcggctcaaagacgcgggcgggtcggcagaaatcctaagaacgaaaatgaccagtacatctacatgggagagcccctcgaaaacgatgaggactgcgcccactggaaagaggccaagatgctgctggacaatattaacacgccggaaggcatcattcctagcatgtttgagcccgaacgcgagaaagtggatgctatcgacggggaatatagactccggggagaggcccgcaagacattcgttgatcttatgagacggggcgacctgcctgtgtggctggcgtaccgcgtcgccgctgaggggattaactatgccgatagacggtggtgttttgacggagtgaaaaataaccagatcctcgaagagaatgttgaagtggagatttggaccaaggagggcgaaagaaagaaactgaagccccgctggcttgatgctcggatctactccgaccctctggccctcaaagagttcaaggagttcgctgccgggagaaaatctctgacactgaacctcatcaccgagatgggccgccttcccacgtttatgacccaaaaggcgcggaatgccctggataacctggctgtcctccatacagccgaagctggaggcagagcctataatcacgccctgagcgagcttccggagaccctggaaacactcctgctgctcacccttctggctacagtgaccgggggaattttcctgtttctcatgtccggcaaggggatcggaaaaatgacgctgggcatgtgctgcattatcacagcgagcattcttctgtggtacgcccagatccagcctcactggatcgctgcctctattatcctcgagttctttctgattgtcctgctcatccccgaacccgagaagcagcggacccctcaagacaaccagcttacctatgtggttattgccatcctgacagtggtggctgccaccatggcgaatgaaatgggcttcctggagaaaacaaagaaagattttgggctcggatccatcacgacccagcagccggagagcaacattctggacatcgatcttcgccccgcctccgcttggacactgtacgccgtcgctaccacattcattacccctatgctcagacattctatcgaaaatagctccgttaacgtgtctctgacggccattgcgaatcaagccaccgtgctgatgggcctcgggaagggatggccccttagcaagatggacatcggcgtccctctgctggctattgggtgttactcccaggtgaaccccatcacactcaccgccgctctgcttctgctcgttgcccactatgctatcattggacctggcctgcaggccaaagcgacacgggaggcccagaagcgcgctgccgctggcatcatgaaaaatccgaccgtggacgggattacggtcatcgatctggaccccattccttacgatcccaagtttgaaaaacaactcggacaggtgatgcttctggtcctgtgcgtgacacaggttctcatgatgagaaccacatgggccctgtgtgaggcccttaccctggcgaccggccctatcagcacactctgggaagggaaccccggacggttctggaatacgaccatcgctgtgtctatggccaacatttttcgcggctcctatctggctggggccggactcctgttcagcatcatgaagaacacagccaataccagacggggcacaggcaacaccggggagacgcttggagagaagtggaaaaatcgcctgaacgctctgggcaagtctgaatttcagatttacaaaaagtccgggatccaagaggtcgacagaacactcgccaaagaaggaattaagcggggcgagaccgatcatcacgcggtgagcagagggtctgccaaactgcgctggttcgttgagcggaatcttgtgaccccggaaggaaaggtcgtggacctgggctgcggcagagggggatggagctattactgtggcgggctcaagaacgtgaaagaggttaagggactgacaaaaggcgggcctggacatgaggaacccatccccatgtccacctatggctggaatctggtccgcctccagtctggcgtggatgtgttctttacacctcccgaaaagtgcgacacgcttctgtgtgatatcggggagagctcccctaacccgaccgtcgaggctggacggacactgagagttctcaatctggtggaaaactggcttaataacaatacccagttctgcattaaagtgctgagcccctacatgccttccgtcatcgagaagatggaagccctccaacgcaagtacggcggggctctggtgcggaaccccctgtctagaaatagcacacacgagatgtattgggtttccaacgcctctggaaacattgtgagctccgtcaatatgatctctcgcatgctcattaaccggtttaccatgagacacaaaaaggcgacgtacgaacctgacgtggatcttggcagcgggacccgcaatatcggaatcgagtccgagacacccaacctggacattatcggcaaacggattgaaaagatcaaacaggagcatgaaaccagctggcactatgatcaggaccatccgtacaagacatgggcctatcacggctcttacgagaccaagcagacagggtccgctagctctatggttaatggagtggtcagactgctcaccaaaccttgggacgtgattcccatggtgacgcaaatggccatgacagataccacccctttcggccagcagcgcgtctttaaggaaaaagttgacacaagaacgcaggagcccaaggaggggaccaaaaagctgatgaagatcacagctgaatggctttggaaagagctgggaaagaaaaagacccctcggatgtgtacacgcgaagagttcaccagaaaagtgcggtccaacgccgctctcggcgccatttttacagatgagaataagtggaaaagcgcgagagaagccgtggaggactctgggttctgggaactggtcgataaggagcggaacctgcacctcgaaggaaagtgcgagacctgtgtgtataatatgatgggcaaacgcgagaagaaactgggcgaatttgggaaggctaaaggatccagagccatctggtacatgtggcttggcgctcggttcctggagtttgaagccctcgggttcctgaacgaggaccattggtttagccgcgaaaattcccttagcggagttgagggcgaggggctgcacaagctcggctacatcctgagagatgtgtctaagaaagaaggaggcgccatgtatgcggacgatacggctgggtgggacacccggattacactggaggatctcaagaacgaagagatggtcaccaatcatatggaaggagagcacaaaaagctggccgaggccatcttccgccttacataccaaaacaaagtggttagagtgcagcggcccaccccgcgcggcacggtcatggacattatcagcagacgggaccagcgcgggtccggacaggtggttacatatggcctgaataccttcacaaacatggaagctcaactcattagacagatggagggggaaggcgtgtttaagtctatccagcatctgaccgtcacggaggagatcgccgtgaagaactggcttgaacgggtcggacgcgagagactgagccggatggctatttccggcgatgactgcgtggttaaacctctcgatgacagattcgcctctgcgctgaccgccctgaatgatatggggaagatccgcaaagacattcaacagtgggaacccagccggggatggaacgattggacacaggtgcccttttgctcccaccacttccatgagctcatcatgaaggacggcagagtcctggtggtgccttgtcgcaatcaggatgaacttattgggcgggctagaatctctcaaggagccggctggagcctgcgcgagaccgcttgcctcgggaaatcctacgcccagatgtggagcctgatgtattttcaccggagagaccttcgcctggcggccaacgctatctgttctgccgttccgtcccattgggtgcccacaagccggaccacatggtctattcacgctacccacgagtggatgacgacagaagatatgctcaccgtctggaatagagtgtggatccaggagaacccttggatggaagacaagacccccgttgagtcctgggaagagattccttacctgggcaagcgcgaggatcagtggtgcggaagcctgatcggcctcacatcccgggccacctgggctaaaaatattcaaacagccatcaaccaggtgagatctctgattgggaatgaagagtatacggactacatgcccagcatgaagcggttcagacgcgaagaggaagaggcgggagtcctttggtga

SEQ ID NO: 20183 - RNA, 9876 nt, synthetic construct
  misc_feature 1..9876: note = derived and/or modified CDS sequence (opt5) from DENV-2__KJ830750__SS-prME
  source 1..9876: mol_type = other RNA
accgccggcgtgatcattatgctgatccccaccgctatggccttccacctcacgaccagaaacggggagcctcatatgattgtcagcaagcaggaaaaaggaaagtccctgctttttaaaaccgaggacggcgttaatatgtgcaccctgatggcgatggatctcggggaactgtgtgaggacacaatcacctacaactgcccccttctgcggcaaaatgaacccgaggatattgactgttggtgcaactctacaagcacctgggtgacgtatggaacctgtacagctaccggcgagcaccgcagagaaaagcggtccgtggccctcgtccctcatgtggggatgggactggagacacgcaccgaaacgtggatgtctagcgagggcgcctggaaacacgctcagagaatcgagacatggatcctgcggcatcccggcttcaccattatggccgctatcctcgcctacacaattgggaccacctattttcagcgcgttctgatcttcattcttctgacagcggtggccccttccatgacgatgagatgcatcggaatttctaatcgggattttgtcgaaggcgtgagcgggggatcctgggttgacatcgtgctcgagcacggcagctgtgtcaccacaatggctaagaacaagcccaccctggatttcgaacttatcaaaacagaggccaagcagcctgctaccctgcgcaaatactgcattgaagccaagctcacgaatacaaccaccgcgtctagatgtccgacacaaggggagccctccctgaacgaggaacaggacaaacggtttgtgtgcaagcacagcatggtggatcgcggatggggcaatggctgtgggctgttcggaaagggcgggatcgtgacatgcgccatgtttacatgcaaaaagaacatggagggaaaaattgttcagcctgaaaatctcgagtatacgatcgtggtgacaccccattctggcgaagagaacgctgtcgggaatgacacaggaaagcacggcaaagagattaaggtgacccctcagtccagcatcacagaagccgagctgaccggctacgggacggttaccatggaatgttctcccagaacaggacttgatttcaacgagatggtgctgctccaaatggaaaataaggcttggctggtccatcggcagtggtttcttgacctgccgctcccttggctgcccggcgccgatatccaggggtccaactggattcagaaggagaccctggtgacattcaagaaccctcacgccaaaaagcaagacgttgtggtcctcggaagccaggagggcgctatgcacaccgcgctgacgggggccacagaaatccagatgtcctctggcaatcttctgtttaccggacatctcaaatgccgcctgagaatggacaaacttcaactgaaaggcatgagctattccatgtgtacagggaagttcaaggtggtcaaagagattgctgaaacccagcacggaaccatcgtggttcgggtgcagtacgagggcgatgggagcccctgcaagattcccttcgagatcatggacctcgagaagagacatgtcctgggacgcctgatcacagtgaaccctattgttacgggcaaggattctccggtgaatatcgaggccgaacccccttttggggactcctacattatcattggcgtcgagcccggacagctcaaactgagctggttcaagaagggctctagcatcgggcaaatgtttgaaaccacaatgcggggagccaaaagaatggctattcttggcgataccgcctgggacttcgggtccctgggaggcgtgtttacatctatcgggaaggcgctccaccaggtgttcggcgctatctatggagccgcctttagcggcgtttcctggaccatgaaaattctgatcggggtcgtgattacgtggatcggaatgaacagccgctctacatccctgagcgtgtctcttgtcctcgtgggcgttgtgaccctgtacctgggggtcatggtgcaggctgattccggatgtgttgtgagctggaagaataaagagctcaagtgcggctccgggattttcatcaccgacaacgtccatacatggaccgagcagtataagtttcaacctgaatctcccagcaaactggcctccgctatccagaaggcccacgaggaaggcatttgtggaatccggtctgtgacaagacttgagaatctgatgtggaaacagattacgccggaactcaaccacatcctgagcgagaatgaggttaagctgtccattatgaccggcgatatcaaagggatcatgcaggcgggaaagcgcagccttcggcctcaacccacagaactcaaatactcttggaagacctggggcaaggccaaaatgctgtccacagagcctcataaccagaccttcctgattgacgggcccgaaacggctgagtgccctaataccaacagagcctggaatagcctcgaagtggaggattatggatttggcgtcttcacaaccaacatctggctgaaacttaaagagcgccaggacgtgtcttgtgactccaagctgatgagcgctgccattaaagataatcgggcggtgcacgccgacatgggctactggatcgaatctgctctcaacgatacatggaagattgagaaggccagctttatcgaagtcaaatcctgccattggcccaagagccacaccctgtggtctaacggggttctggagtccgagatgatcattccgaaaaatttcgctggacctgtgagccagcacaactatagacccggctaccatacacaaaccgccgggccctggcaccttggaaagctcgaaatggacttcgatttttgtgagggcacgacagtggtcgtgaccgaagactgcgggaatcgcggaccttccctgcggaccacaaccgcctctggcaaactgatcacggagtggtgctgtagaagctgcacactcccgcccctgcggtaccgcggcgaagatgggtgttggtatggaatggagattagacctcttaaggagaaggaagagaacctggttaattccctcgtgaccgctggccatgggcagatcgacaacttctctctgggagtcctgggcatggcgctttttctcgaagagatgctgcggacaagagtggggaccaaacacgccgttctgctcgtggctgtcagcttcatgacactgattaccggaaatatgtcctttcgcgatcttggccgggtgatggttatggtgggcgccgccatgacggacgatatcgggatgggagtcacctacctggctctcctggccgcgttcaaggtgagacccacatttgctgccggcctgcttctgcgcaaactcacctctaaggaactgatgatgacaaccattgggatcgtgctcctgagccagtccacgacacctgagagcatccttgagctgaccgacgccctcgctctgggaatgatgattctgaaaatcgtcagaaacatggaaaagtatcaacttgccgttacaattatggcgatcctgtgcgtgcccaatgctgtgattctccagaacgcctggaaggtctcttgtaccatcctggccgctgtgtccgttagccctctcctgcttacctcttcccagcagaaagccgattggatccccctggctctcacaattaagggcctgaatccgacggccatcttcctgaccacacttagccggaccaacaaaaagcgctcttggcctctgaatgaggcgattatggccgtggggatggtctccatcctcgctagctccctgctcaaaaacgacattcccatgacaggacctctggtggccggcggccttctgaccgtttgctacgtgctgacggggagaagcgctgacctcgaactggagaaggccgccgatgtccggtgggaagaccaagctgagatctctggaagctcccccatcctttctattacaatcagcgaggatggctccatgtctattaaaaatgaagaggaagaacagaccctgaccatcctcattcgcacagggctgctcgtgatcagcggactgtttccggtctccattcctatcaccgcggccgcttggtatctttgggaggtgaagaagcagagagccggcgttctgtgggacgtgccctctcctccgcccgtcgggaaagccgaactggaggatggagcttaccggatcaagcagaaaggcattctcggctatagccaaatcggggccggagtgtacaaggaaggcacattccatacgatgtggcacgttacccgcggggcggtgctgatgcacaaaggaaagagaattgagccttcctgggctgacgtccggaaggatcttatcagctacggcgggggatggaaactggaaggcgagtggaaggagggcgaagaggtccaggtgctcgccctggaaccggggaaaaacccccgcgccgttcagacaaagcctggactctttaaaaccaacacaggcaccattggggctgtctctctggacttctcccccggaacgagcggctctcctatcgtggataagaaggggaaagtggtcggactttatggcaatggcgtggttaccagatccgggacatacgtgagcgccatcgcgcagaccgagaagtccattgaagacaaccccgagatcgaggatgacatttttcggaaaaagagactgacaatcatggatctgcatcctggagctggcaaaaccaagcgctatctcccggccattgtccgggaagccatcaagagagggctgcgcacacttatcctggctcccacgcgggtggttgccgctgagatggaagaggccctcagaggactgcctattcgctaccaaacccccgcgatccgggccgaacacacaggcagagagattgtggacctcatgtgtcatgctaccttcaccatgcgcctgctttctcctgtccgggtgcccaattataacctgatcattatggacgaggcccacttcacagatccggctagcatcgccgccagagggtacatttccacgcgggttgaaatgggcgaggctgcgggaatctttatgaccgccacacctcccggcagccgcgaccccttccctcagtctaatgctcccatcatggatgaagagagagagattcctgaacggtcctggaacagcgggcatgagtgggtgaccgactttaaaggaaagacagtctggttcgtgccgtctatcaaagccggcaatgatattgccgcttgcctgcgcaagaacgggaaaaaggtgatccagctcagcagaaagacctttgactccgaatatattaaaacgcggacaaatgattgggacttcgtcgttaccaccgatatctctgagatgggagccaactttaaggcggaaagagtgatcgacccccgccggtgtatgaaacctgtgattctgacagatggcgaggagagagtcatccttgctgggcccatgcctgtgacccacagctccgccgcccaacgccggggcagaattggacgcaatcccaagaacgaaaatgaccagtacatctacatgggcgagccgctggaaaacgacgaggattgcgctcactggaaagaagccaagatgctcctggacaatattaacacacctgaggggatcatcccctctatgttcgagcctgaacgggagaaagttgatgcgattgacggagaatatagactgcgcggcgaggccagaaagacctttgtggatctcatgcggcgcggggaccttcccgtctggctggcttacagagtggccgctgaaggaatcaactatgccgatcggcgctggtgtttcgacggcattaagaataaccagatcctggaggagaatgttgaagtggagatttggacgaaagaaggggagagaaagaaactcaagcctcggtggctggatgctagaatctacagcgacccccttgccctgaaagagtttaaggagttcgcggccggccgcaagtccctcacactgaacctgattaccgagatgggacggctcccgacattcatgacccagaaagctagaaatgcccttgataacctggctgtcctgcatacggccgaagccggcgggcgcgcttataatcacgcgctcagcgagctgcctgaaacccttgagacactgctcctgctgaccctccttgccacagtgaccggaggcatctttctgttcctgatgtctgggaagggaatcggcaaaatgacactcggcatgtgctgcattatcaccgcttccattctgctttggtacgcccaaatccagccccattggattgccgctagcatcatcctggagtttttcctcattgtcctgctgatccccgaacctgagaagcagcggacgccgcaggacaaccaactcacatatgtggttattgccatccttaccgtggtggcggccaccatggctaatgaaatggggtttctggagaaaacaaagaaggatttcggactgggctccattgccatccagcagcccgaatctaacatcctcgacattgacctgagacctgctagcgcctggaccctttacgcggtcgccacaacgtttatcacccccatgctgcggcactccattgaaaattctagcgttaacgtgtccctcacagctatcgccaatcaggctaccgtgctgatggggctgggaaaaggctggcctctcagcaagatggatattggggtcccccttctggccatcggatgttactctcaagtgaaccctattacactgaccgctgccctcctgcttctggttgcgcactatgccatcatcggcccgggcctccaggctaaagccacgcgcgaggctcagaagagagccgccgcggggattatgaaaaatcccaccgtggacggagtcacagtgatcgatctggaccctattccctacgatcctaagttcgaaaagcagctgggccaagtcatgctccttgtgctgtgcgttacccaggtgctgatgatgcggacaacctgggctctctgtgaggccctgacgcttgctacagggcccatctccaccctgtgggaaggaaacccgggccgcttttggaatacaaccattgccgtcagcatggccaacatcttcagagggtcttatctcgctggagccggcctgctgttttccatcatgaaaaacaccacaaatacgcggcgcggcaccgggaacacaggagagaccctcggcgaaaagtggaaaaatagacttaacagcctggggaagtctgagttccagatttacaaacggagcggaatccaagaggtggaccgcacactggcgaaggaaggcattaaaagaggggagaccgatcatcacgccgtttcccggggatctgctaagctcagatggtttgtggaacgcaatctggtcacgcctgagggcaaggtggtggaccttggctgcgggcggggaggctggagctattactgtgggggactgaaaaacgttagagaggtcaagggcctcacaaaagggggacccggccatgaggaacccatccctatgtccacctatggctggaatctggtgcgcctgcagagcggggtggatgtcttcttcacaccccctgaaaagtgcgacaccctcctttgtgatattggagagtcctctccgaaccccaccgttgaagccggccggacactgagagtgctgaatctcgtggagaactggctgaataacaatacgcagttttgcatcaaagtccttaacccttacatgcccagcgtgatcgagaagatggaaaccctgcagcgcaagtacgggggagctctcgttcggaatcctctgtccagaaactctacacacgagatgtattgggtgagcaacgcctccggcaatattgtctctagcgtgaacatgatctcccgcatgctgattaatcggttcaccatgagacataaaaaggcgacatacgaacccgacgttgatctcgggagcggaacccgcaacatcggcattgagtctgaaacgccgaatcttgacatcatcggcaaacggattgagaagatcaaacaagagcacgaaacctcctggcactatgaccaggatcatccttacaagacatgggcctatcacgggagctacgagaccaagcagacaggatctgcttccagcatggtgaacggcgtcgtgagactgctgaccaaaccctgggacgtgattcctatggtcacacagatggccatgaccgatacgacaccctttgggcaacagcgcgttttcaaggaaaaagtggacaccagaacccaggagcctaaggaaggaaccaagaagctcatgaagatcacggctgagtggctgtggaaagagcttggcaagaaaaagacaccccggatgtgtacacgcgaagagtttgccagaaaagtgcggtctaatgctgccctgggggcgattttcaccgatgaaaacaagtggaaatccgccagagaggctgtcgaggacagccggttttgggaactcgtggataaggagcgcaatctgcatctggaaggaaagtgcgagacatgtgtttataacatgatgggcaaaagagaaaagaaaatcggcgagttcgggaaggccaaaggatcccgggctatttggtacatgtggctcggcgcccgctttctggagttcgaagcccttgggtttctgaatgaggaccactggttcagcagagaaaactctctcagcggagtggagggcgaagggctgcacaaacttggctacatcctgcgggaggtctccaagaaagagggaggcgcgatgtatgctgatgacaccgccgggtgggatacacgcatcaccctcgaagacctgaagaatgaggaaatggtgacgaaccatatggagggagaacacaaaaagctggccgaggctatttttaaactcacctaccagaataaggttgtgagagtccaacggccgacacctcgcggcaccgtgatggacatcatttctagacgggatcagcgcgggagcggacaggttggcacatatgggctgaacaccttcacgaacatgggcgcccaacttatcagacagatggagggagaaggcgtgttcaaggggattcagcatctgacagctaccgaggaagtcgccgtgcaggactggctcgcgcgggtcggacgcgagagactgtcccggatggccatctctggcgatgactgcgtggttaaaccccttgatgacagatttgctagcgccctgacagctctcaatgatatggggaaggtgcgcaaagacatccaacagtgggagccctcccggggatggaacgattggacccaggtccctttctgctctcaccattttcacgaactgattatgaaggacggcagagtgctggtggttccgtgtcgcaatcaggatgagctcatcgggcgggccagaattagccaaggcgcgggatggtccctgcgcgaaacggcctgccttggcaaaagctacgctcagatgtggtctctgatgtatttccaccggagagacctccgcctggccgctaacgccatctgttccgctgtgcccagccattgggtccctacctctcggacaacctggtccattcacgccgggcatgagtggatgacaaccgaagatatgcttacagtgtggaatagagtttggatccaggagaacccctggatggaggacaagacccctgtggaaagctgggaggaaatcccctacctgggaaagcgcgaggaccagtggtgcggctccctcattgggctgacgtctcgggcgacatgggccagaaatatccaaaccgctattaaccaggtccggagcctgatcggatccgaagagtataccgattacatgcctagcatgaaaagatttcgccgggaggaagaggaagccggcgtgctctggtga

SEQ ID NO: 20184 - RNA, 9876 nt, synthetic construct
  misc_feature 1..9876: note = derived and/or modified CDS sequence (opt5) from DENV-2__FM210231__SS-prME
  source 1..9876: mol_type = other RNA
agcgccggcatgatcattatgctgatccccaccgtgatggctttccacctgacaacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtggtgctgcagaatgcttggaaggtctcctgtaccatcctcgccgtggtttctgtgagccccctgcttctgacctccagccagcagaagaccgactggattcctctcgccctgacgatcaagggactgaaccccaccgctattttccttacaaccctgtctcgcacaaataaaaagagatcctggccgctcaacgaggccatcatggctgtcggcatggtgagcatcctggcctcttccctcctgaagaatgacattcctatgaccgggccccttgttgcgggaggcctgctgacggtgtgctatgtcctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccattctgatcagaacaggcctcctggtcatctccgggctttttcccatttctatcccgattacggctgccgcctggtacctgtgggaggtgaaaaagcagcgggctggagttctgtgggatgtgccttctccccctcccatgggcaaagcggaactcgaggacggggcctatcgcatcaagcaaaagggcattctgggatactcccagatcggcgctggggtctacaaagaaggaaccttccacacaatgtggcatgtgaccagaggcgccgttcttatgcacaaggggaaacggatcgagccctcctgggccgatgtgaagaaagacctgattagctatggaggcgggtggaagctcgagggagaatggaaggagggcgaagaggtccaggtgctggctctcgaacctggcaaaaatccgcgcgccgtgcagacaaagcccgggctgtttaaaaccaacacgggaaccatcggcgcggtttcccttgatttctctcctgggacaagcggatcccccattatcgacaagaaaggcaaggtcgtggggctgtacggaaacggcgtggtcaccagaagcggcgcttatgtgtctgccattgcccaaacagagaagtccatcgaggataatcctgaaatcgaggacgatatttttcggaaacgcagactgaccatcatggacctccaccccggggctggaaagacaaaacggtacctgcctgccattgttagagaagcgatcaagcgcggccttcggacgctgattctcgctccgaccagagtggtcgccgccgagatggaagaggctctgcgcgggctccccatccggtatcagacccctgccattaaagctgagcataccggaagagaaatcgtggacctgatgtgtcacgccaccttcacaatgcgccttctgagccccgttcgggtgcctaactacaatctgatcattatggatgaggcgcatttcacggaccccgcctctatcgctgccagaggctatatttccacccgcgtcgaaatgggggaggctgccggcatctttatgacagccaccccgcctggaagccgggatcccttcccccagtccaacgctcctattatcgacgaggaaagagagatccccgaacggtcttggaatagcggccacgagtgggtgacagattttaaggggaagaccgtttggttcgtgccttccattaaagcgggaaacgacatcgccgcttgcctccgcaagaatggcaaaaaggtcattcaactgagcagaaaaacgtttgattctgaatacgtgaagacacggaccaacgactgggatttcgtggtcaccacagacatctccgagatgggggccaattttaaagccgagcgcgttattgatccgagacggtgtatgaagcccgtgatccttaccgacggagaagagagagtgatcctggctggccctatgcccgtcacacatagctctgccgcgcagcgccgggggagaattggccgcaaccctaagaatgaaaacgaccagtacatctatatgggagagcccctcgaaaatgatgaggactgcgctcactggaaagaggccaagatgctgctggataacattaataccccggaaggcatcattcctagcatgttcgagcccgaacgggagaaagtggacgccatcgatggggaatacagactccgcggagaggctcggaagacgtttgttgaccttatgagacgcggcgatctgcctgtgtggctggcctataaagtcgcggccgaggggattaactacgctgacagacggtggtgtttcgatggaatcaagaacaatcagatcctcgaagagaacgtggaagttgagatttggacaaaggagggcgaacgcaaaaagctgaaacccagatggcttgacgcccggatctattccgatcctctggctctcaaggagtttaaagagttcgccgctgggcgcaagtctctgaccctgaatctcattacagagatgggcagacttcccaccttcatgacgcaaaagacccgggacgccctggataacctggcggtgctccacacagccgaagctggaggcagagcctacaatcatgctctgagcgagcttccggagaccctggaaacactcctgctgctcacccttctggccacagtcaccgggggaatctttctgttcctcatgtccggccgcgggattggaaaaatgacgctgggcatgtgctgcatcatcacagcctctattcttctgtggtatgctcagatccagcctcactggattgcggccagcatcattctcgagtttttcctgatcgtgctgctcatccccgaacccgagaagcagcggacccctcaagacaaccagcttacctacgtcgtgattgctatcctgacagttgtggccgccaccatggctaatgaaatgggctttctggagaaaacaaagaaagacctcgggctgggatccattgtgacgcagcagccggagagcaacatccttgatattgacctgagacccgcctctgcgtggaccctctacgccgtcgctacaaccttcgttacacctatgctgcgccattccatcgaaaatagctccgtgaacgtgtctctgaccgccattgctaatcaagccacggtcctcatgggccttgggaagggatggcccctgagcaagatggatatcggcgtgcctctgctcgcgatcgggtgttattcccaggttaaccccattaccctgacagccgcccttctgctcctggtggcccactacgctatcattggacctggcctgcaggccaaagctacccgggaggcccagaagagagcggccgctggcatcatgaaaaatccgacagtcgacgggattaccgtgatcgatctcgaccccatcccttatgatcccaagtttgaaaaacaacttggacaggtcatgctgctgattctctgcgtgacgcaggttctgatgatgcggacaacctgggccctttgtgaggctctgacactcgccaccggccctatctctaccctgtgggaagggaaccccggacgcttctggaatacaacgattgccgtgagcatggcgaacatctttagaggctcctacctggctggggccggactccttttcagcattatgaagaataccacaaacacccggcgcggcacaggcaacatcggggagaccctgggagagaaatggaagtctagactgaatgctctcggcaagtccgaatttcaaatctataaaaagagcgggattcaggaggtcgaccggacgctggccaaagaaggaatcaagcgcggcgagacagatcaccatgccgtgtctagagggtccgctaaacttcggtggttcgttgagcgcaacatggtgaccccggaaggaaaggtcgtggacctgggctgcggcagagggggatggagctactattgtggcgggctcaagtctgtgcgggaggttaaaggactgaccaagggcgggcctggacacgaagaacccattcccatgagcacatacggctggaatctggtcagactccagtccggcgtggatgtgtttttcatccctcccgaaaaatgcgacacccttctgtgtgatattggggagtctagccctaacccgacagtcgaggccggacgcacgctgcgggttctcaatctggtggaaaactggcttaataacaatacccagttctgcatcaaggtgctgaacccctacatgccttccgtcatcgagaaaatggaagcgctccaaagaaagtatggcggggccctggtgcgcaatcccctgagccggaactccacacatgagatgtactgggtttctaatgctagcggaaacattgtgtcctctgtcaatatgatcagcagaatgctcattaaccgctttaccatgcggcacaagaaagccacatatgaacctgacgtggaccttggctccgggaccagaaacatcggaattgagtctgagatccccaatctggatattatcggcaagcgcatcgagaaaattaagcaggagcatgaaacgagctggcactacgaccaggatcacccgtataaaacctgggcttaccatggctcctatgagacaaagcagaccgggagcgcctcttccatggttaacggagtggtccggctgctcacaaagccttgggacgtgctgcccaccgtgacacaaatggcgatgaccgatacgacacctttcggccagcagagagtctttaaagaaaaggttgacacccgcacccaggagcccaaagaggggacaaagaaacttatgaagatcacggccgaatggctgtggaaagagctcggaaagaagaaaacccctcggatgtgtacaagagaagagttcacccgcaaggtgagaagcaatgctgccctgggcgctatttttacagatgagaacaaatggaagtctgcccgggaagctgtggaggactcccgcttctgggaactggtcgataaagagagaaatctccacctggaagggaagtgcgagacctgtgtgtacaacatgatgggaaagcgggagaagaaacttggcgaatttggcaaagccaaagggagcagagcgatctggtacatgtggctgggagcccggttcctcgagtttgaagctctgggcttccttaatgaggaccattggttttctcgcgaaaactccctgagcggggttgagggagagggcctccacaaactggggtatattctgagagatgtgtccaagaaggaaggcggagccatgtacgctgacgacacagccggctgggatacccggatcacgctcgaggacctgaaaaatgaagagatggtcaccaaccacatggaaggggagcataagaaacttgccgaggcgatcttcaagctgacatatcaaaataaagtggttcgcgtgcagagacccaccccgcggggaacagtcatggatattatcagccgcagagaccagcggggctctgggcaagtgggaacctacggcctcaacacgtttacaaatatggaagctcagctgattcgccagatggagggggaaggcgttttcaagaacatccagcaccttaccgtgacagaggaggtcgccgtgcaaaattggctggccagagtcggacgggaacgcctcagcagaatggctatttccggcgatgactgcgtggttaagcctctggatgaccggttcgccaacgctctgaccgccctcaacgatatggggaaaatccgcaaggacatccagcagtgggagccctctaaaggatggaatgattggacgcaggtccccttttgcagccatcacttccatgaactgattatgaaggacggcagagtccttgtggtgccttgtcggaaccaagatgagctgatcgggagagcgcgcatttcccagggagccggctggtctctccgggaaaccgcttgcctggggaaaagctatgcccagatgtggtcccttatgtactttcacagacgcgacctgcggctcgctgccaatgcgatctgttctgccgttccgagccactgggtgcccacatccagaaccacatggagcattcatgctaagcacgagtggatgaccacagaggacatgctgaccgtctggaaccgcgtgtggatccgggaaaatccttggatggaggataagacgcccgttgaatcttgggaggaaattccttatctgggcaaaagagaggaccagtggtgcggatccctcatcggcctgacaagccgcgccacctgggctaagaacatccaagccgctattaatcaggtgcggtctcttatcgggaacgaggaatacaccgattacatgccctccatgaaaagattccgccgggaggaagaggaagccggagtcctgtggtga

SEQ ID NO: 20185 - RNA, 9876 nt, synthetic construct
  misc_feature 1..9876: note = derived and/or modified CDS sequence (opt5) from DENV-2__FM210239__SS-prME
  source 1..9876: mol_type = other RNA
accgccggcgtgatcattatgctgatccccaccgctatggccttccacctcacgaccagaaacggggaacctcatatgattgtcggacggcaggaaaagggcaagagcctgctttttaagaccgaggacggggttaatatgtgcaccctgatggcgatcgatctcggagaactgtgtgaggacacaattacctacaagtgcccccttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacctgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtgacggtcagctttgtgaccctgattacaggaaacatgtccttccgggaccttggcagagttatggtgatggtcggcgccgccatgaccgatgacatcgggatgggagtgacatacctggctctcctggccgcgtttaaggttcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtcgggatggttagcatcctggcttcttccctcctgaaaaacgacattcccatgacgggacctctcgtggccggcggcctgcttacagtgtgctacgtcctgaccgggcggagcgccgatctggaactcgagcgcgctaccgacgtgaagtgggaggatcaagcggaaatctccggaagctctcccattctgagcatcacaattgccgaggacggctccatgtctatcaaaaatgaagaggaggaacagacccttacaatcctgattagaacggggctcctggttatcagcggactcttcccggtgtccattcctatcaccgctgccgcctggtatctgtgggaggtcaagaagcagcgggctggcgtgctttgggatgttccctctcctccgcccgtggggaaagccgaactggaggacggagcgtaccgcattaagcagaaaggcatcctgggctatagccaaatcggggctggagtctacaaggaaggcacatttcacaccatgtggcacgtgacaagaggggccgtcctcatgcatcggggaaaacgcattgagccttcctgggccgatgtgaagaaggacctgatctcttacggcgggggatggaaacttgagggcgaatggaaggagggcgaagaggttcaggtgctggctctcgaaccggggaaaaaccccagagccgtccagaccaagcctggactgttcaaaacgaataccggcacaattggggcggtgagcctcgatttttcccccggaaccagcggctctcctatcgttgaccggaaggggaaggtggtcggactgtatggcaacggcgtggtgacaagatccggggcttacgttagcgccattgcccagaccgagaaatctatcgaggataatcccgaaatcgaggacgatattttccgcaagaaacggcttacaatcatggacctgcaccctggagctggcaagacgaaaagatatctgccggccattgtccgcgaagctatcaagcgggggctcagaaccctgattcttgcccccacacgcgtggtggcggccgagatggaagaggctctgcggggactccctatcagataccaaacccccgccattcgcgctgagcataccggccgggaaatcgtcgacctgatgtgtcacgccacattcacgatgagactcctgtcccctgtgcgggttcccaactataaccttatcattatggatgaggcccattttaccgacccggctagcatcgcggcccgcgggtacatttccacaagagtggaaatgggcgaggctgccggaatcttcatgaccgccacacctcccggctctcgggatccctttcctcagagcaatgctcccattatggacgaggaacgcgagatccctgaaagatcctggaacagcgggcacgagtgggtcaccgatttcaagggaaaaacggtgtggtttgttccgtctatcaaggccggcaatgacattgcggcttgcctgcggaaaaacgggaagaaagtgatccagctgtccagaaagacattcgatagcgaatatgtcaagacccgcaccaatgactgggattttgtggttacaaccgacatttctgagatgggagccaacttcaaagccgagcgggtgatcgatcccagacgctgtatgaagcctgtcattctcacagacggcgaagaacgggtgatcctggctgggcccatgcctgtgacccacagctccgccgcgcaaagacgcggccggatcggaagaaatcccaaaaacgaaaatgaccagtacatttacatgggcgagccgcttgaaaacgatgaggactgcgcccattggaaggaggctaaaatgctgctcgataatatcaacacgcctgaagggattatcccctctatgtttgagcctgaacgcgagaaggtcgacgccattgatggagaatatagactgcggggcgaggctcgcagaacattcgttgacctgatgcggcgcggggatctccccgtgtggcttgcctacagagtggctgccgagggaatcaattatgcggaccggagatggtgttttgatggcgtcaaaaacaatcagattctggaagagaacgtggaagttgagatctggaccaaggagggggaacgcaagaaactgaagcctcggtggctcgacgccagaatctacagcgatcccctggctcttaaagagttcaaggagttcgccgctggccgcaaatccctgacactcaacctgattaccgagatgggacggctgccgacgtttatgacccagaaggccagagacgccctcgataatcttgctgtgctgcacacagcggaagccggcgggcgggcttataaccatgccctgtctgagctccctgagaccctggaaacacttctgctcctgaccctgctcgccacagtcaccggaggcatcttcctttttctgatgagcgggaagggagtgggcaaaatgacgctgggcatgtgctgcattatcacagcttccattctcctgtggtacgcccaaatccagccccactggatcgcggccagcattatccttgagttctttctgattgttctcctgatccccgaacctgagaagcagcgcaccccgcaggacaatcaactgacctatgtggtcattgctatcctcacagtggtcgccgctaccatggccaacgaaatggggttccttgagaaaacaaagaaagacctgggactgggctctatcgcgacgcaggagcccgaatccaatattctcgatatcgacctgagacctgccagcgcttggaccctttacgccgtggctacaacctttgttacacccatgctgcggcactccattgagaactctagcgtgaatgtgtccctcaccgccatcgctaaccaggccacggtcctgatggggctgggaaagggctggcctctctctaagatggatattggggttccccttctggcgatcggatgttacagccaggtgaatcctattaccctgacagccgctctcctgcttctggtggcccattatgctatcatcggcccgggcctccaagccaaagccacccgcgaagcgcagaagagagctgccgctgggattatgaaaaaccccacagtcgacggagtgaccgttatcgatctggaccctattccctacgatcctaagttcgagaaacagctgggccaggtgatgctccttatcctgtgcgtcacgcaagtgctgatgatgcggacaacctgggccctctgtgaagccctgacacttgctaccgggcccatttccaccctgtgggagggaaatccgggccgcttttggaacacaacgatcgccgtcagcatggcgaatatcttcagagggtcttatctcgccggagctggcctgctgttttccattatgaagaacaccacaaatacccggcgcggcacagggaacatcggagagaccctcggcgaaaagtggaaaagcagacttaatgccctggggaagtctgagttccagatttacaaaaagtccggaatccaggaagtggaccggacgctggctaaagagggcattaagagaggggagacagatcaccatgccgttagccgcggatctgcgaaactccggtggtttgtggaaagaaacatggtcacccctgagggcaaggtggttgacctgggctgcgggcgcggaggctggagctattactgtgggggacttaaggatgtgcgggaagtcaaaggcctgaccaaagggggacccggccacgaggaacccatccctatgtccacatatggctggaacctcgtgagactgcaatctggggtggacgttttcttcacaccccctgagaaatgcgataccctgctctgtgacatcggagagagctccccgaatcccacgattgaagccggccgcacccttcgggtcctgagcctggtggagaactggctcaataacgacacacagttttgcatcaaggtgctgaatccttacatgccctccgtcattgagaagatggagacccttcagagaaagtacgggggagctctggttcgcaaccctctctctcggaatagcacacatgaaatgtattgggtgtccaacgccaccggcaatatcgtgtctagcgtcaacatgatttccagaatgctgatcaatcgcttcacgatgaagcacaaaaaggctacctacgagcccgatgtggacctggggtctggaacacggaacatcggcattgagagcgaaatcccgaatctcgatattatcggcaaaagaattgagaagatcaaacaggaacacgagacctcctggcattatgaccaagatcacccttacaagacatgggcctatcatgggagctacgaaaccaagcagacaggatctgcttccagcatggttaacggcgtggtccgccttctgaccaaaccctgggacgtggttcctatggtgacgcagatggccatgacagataccaccccctttgggcagcaaagagtcttcaaggagaaagtggacacacggacgcaggagcctaaggaaggaaccaaaaagctgatgaagattacagcggagtggctctggaaagaactgggcaagaaaaagacaccccgcatgtgtacaagagaggagtttacccggaaagtgagatctaatgccgctcttggggccatcttcacagatgaaaacaagtggaaatccgctcgggaggccgtcgaagacagccgcttttgggagctggttgataaggaaagaaacctccacctggagggaaagtgcgagacctgtgtgtataatatgatgggcaaacgggaaaagaaactgggcgagttcgggaaggccaaaggatctcgcgcgatctggtacatgtggctcggcgctagatttctggagttcgaggcccttgggtttctgaacgaagaccactggttctcccgggagaatagcctctccggagtggagggcgaagggctgcataaacttggctacattctgcgcgacgtcagcaagaaagagggaggcgccatgtatgctgatgacacggccgggtgggataccagaatcacactcgaagacctgaagaacgaggaaatggtgaccaatcacatggagggagagcataaaaagctggctgaagccatttttaaactcacataccagaacaaggttgtgcgggtccagcgcccgacccctagaggcacggtgatggatatcatttctcggcgcgaccaaagagggagcggacaggttggcacatatgggctgaataccttcacaaacatggaggcgcagcttatccggcaaatggaaggcgagggagtgttcaagtccatccagcgcctgaccgtcacggaggaaattgccgtgcagaattggctcgctagagttggccgggagagactgtctcgcatggccatcagcggggatgactgcgtggtcaaaccccttgatgaccggtttgcttccgccctgaccgcgctcaacgatatgggaaaggtgagaaaagacattcagcaatgggaaccctctcgcggctggaatgattggacacaggtccctttctgcagccaccattttcacgagctgatcatgaaggacgggcgggtgctggttgtgccgtgtagaaaccaggacgaactcattggacgcgcccggatctcccagggcgctgggtggtctctgaaagagaccgcctgccttggcaagagctacgctcaaatgtggtccctgatgtatttccacagacgcgatctccggctggccgctaatgccatctgtagcgcggtcccctctcattgggtgcctacatccagaaccacatggagcattcacgccaagcatgagtggatgaccacggaagacatgcttacagtgtggaaccgcgtttggatccaggagaatccctggatggaagataaaacccctgtggagtcttgggaagaggtcccctacctgggaaagcgggaggaccagtggtgcggctccctcattgggctgaccagcagagctacatgggccaaaaacatccagaccgccattaaccaagtgcggtccctgatcggaaatgaagagtatacagattacatgccttctatgaagagatttcgccgggaagaggaagaggctggcgttctctggtga

SEQ ID NO: 20186 - RNA, 9876 nt, synthetic construct
  misc_feature 1..9876: note = derived and/or modified CDS sequence (opt5) from DENV-2__FM210232__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaggcttgcgggaaccggggaccttctctgagaaccacgacagcgtccggcaaactgatcaccgaatggtgctgtcggagctgcacactcccgcccctgcgctacagaggcgaggatgggtgttggtatggaatggaaattcggcctcttaaggagaaggaagagaatctggtgaactccctcgtcaccgccggccacgggcagatcgacaatttttctctgggagttctgggcatggctcttttcctcgaagagatgctgagaacacgcgtggggaccaaacatgccatcctgctcgtgacggtcagctttgtgaccctgattacaggaaacatgtccttccgggatcttggcagagttatggtgatggtcggcgccgctatgaccgacgatatcgggatgggagtgacatacctggccctcctggcggcttttaaggttcgccccaccttcgccgccggcctgcttctgagaaaactcacgtctaaggagctgatgatggctacaattgggatcgccctcctgagccagtccaccattcctgaaacaatccttgagctgaccgacgcgctcgctctgggaatgatggtgctgaaaatcgtccggaatatggaaaagtatcaacttgccgtgaccattatggccatctcttgcgttcccaacgctgtgattctgcagaatgcctggaaggtcagctgtacaatcctcgctgccgtgtccgtgagccctctgctcctgacgtcttcccagcagaaagcggattggattccccttgccctgaccatcaagggcctcaacccgacagctatctttctgaccacactgagccgcacctctaaaaagagatcctggcctcttaatgaggccattatggctgtcgggatggttagcatcctggcctcttccctcctgaaaaacgacattcccatgacgggacctctcgtggccggcggcctgcttacagtgtgctacgtcctgaccgggcggagcgctgacctggaactcgagcgcgcgaccgatgtgaagtgggaggaccaagccgaaatctccggaagctctcccattctgagcatcacaattgctgaggatggctccatgtctatcaaaaatgaagaggaggaacagacccttacaatcctgattagaacggggctcctggttatcagcggactcttcccggtgtccattcctatcaccgccgccgcttggtatctgtgggaggtcaagaagcagcgggccggcgtgctttgggacgttccctctcctccgcccgtggggaaagcggaactggaggatggagcttaccgcattaagcagaaaggcatcctgggctatagccaaatcggggccggagtctacaaggaaggcacatttcacaccatgtggcacgtgacaagaggggccgtcctcatgcatcggggaaaacgcattgagccttcctgggctgacgtgaagaaggatctgatctcttacggcgggggatggaaacttgagggcgaatggaaggagggcgaagaggttcaggtgctggccctcgaaccggggaaaaaccccagagcggtccagaccaagcctggactgttcaaaacgaataccggcacaattggggctgtgagcctcgacttttcccccggaaccagcggctctcctatcgttgatcggaaggggaaggtggtcggactgtatggcaacggcgtggtgacaagatccggggcctacgttagcgccattgctcagaccgagaaatctatcgaggacaatcccgaaatcgaggatgacattttccgcaagaaacggcttacaatcatggatctgcaccctggagccggcaagacgaaaagatatctgccggctattgtccgcgaagccatcaagcgggggctcagaaccctgattcttgcgcccacacgcgtggtggccgctgagatggaagaggccctgcggggactccctatcagataccaaacccccgctattcgcgccgagcataccggccgggaaatcgtcgacctgatgtgtcacgccacattcacgatgagactcctgtcccctgtgcgggttcccaactataaccttatcattatggacgaggctcattttaccgatccggcgagcatcgccgctcgcgggtacatttccacaagagtggaaatgggcgaggccgccggaatcttcatgaccgctacacctcccggctctcgggacccctttcctcagagcaatgcccccattatggatgaggaacgcgagatccctgaaagatcctggaacagcgggcacgagtgggtcaccgacttcaagggaaaaacggtgtggtttgttccgtctatcaaggcgggcaatgatattgctgcctgcctgcggaaaaacgggaagaaagtgatccagctgtccagaaagacattcgacagcgaatatgtcaagacccgcaccaatgattgggactttgtggttacaaccgatatttctgagatgggagccaacttcaaagctgagcgggtgatcgaccccagacgctgtatgaagcctgtcattctcacagatggcgaagaacgggtgatcctggccgggcccatgcctgtgacccacagctccgcggcccaaagacgcggccggatcggaagaaatcccaaaaacgaaaatgaccagtacatttacatgggcgagccgcttgaaaacgacgaggattgcgctcattggaaggaggccaaaatgctgctcgacaatatcaacacgcctgaagggattatcccctctatgtttgagcctgaacgcgagaaggtcgatgctattgacggagaatatagactgcggggcgaggcccgcaaaacattcgttgatctgatgagaagaggggacctccccgtgtggcttgcttaccgcgtggccgcggagggaatcaattatgccgatagacggtggtgttttgacggcgtcaagaacaatcagattctggaagagaacgtggaagttgagatctggaccaaggagggggaacgcaagaagctgaaacctcgctggctcgatgctcggatctacagcgaccccctggcccttaaggagttcaaagagttcgctgccggcagaaagtccctgacactcaacctgattaccgagatgggacgcctgccgacgtttatgacccagaaggcccgggatgctctcgacaatcttgcggtgctgcacacagccgaagctggcgggagagcctataaccatgccctgtctgagctccctgagaccctggaaacacttctgctcctgaccctgctcgctacagtcaccggaggcatcttcctttttctgatgagcgggaaaggagtgggcaagatgacgctgggcatgtgctgcattatcacagcctccattctcctgtggtacgcgcaaatccagccccactggatcgccgctagcattatccttgagttctttctgattgttctcctgatccccgaacctgagaaacagcggaccccgcaggataatcaactgacctatgtggtcattgccatcctcacagtggtcgctgccaccatggcgaacgaaatggggttccttgagaagaccaagaaggacctgggactgggctctatcgccacgcaggagcccgaatccaatattctcgacatcgatctgcgccctgctagcgcctggaccctttacgctgtggccacaacctttgttacacccatgctgagacactccattgagaactctagcgtgaatgtgtccctcaccgctatcgccaaccaggcgacggtcctgatggggctgggaaagggctggcctctctctaaaatggacattggggttccccttctggccatcggatgttacagccaggtgaatcctattaccctgacagctgccctcctgcttctggtggctcattatgccatcatcggcccgggcctccaagccaaggcgacccgggaagctcagaaacgcgccgctgccgggattatgaagaaccccacagtcgatggagtgaccgttatcgacctggatcctattccctacgaccctaaattcgagaagcagctgggccaggtgatgctccttatcctgtgcgtcacgcaagtgctgatgatgagaacaacctgggccctctgtgaagctctgacacttgccaccgggcccatttccaccctgtgggagggaaatccgggccggttttggaacacaacgatcgcggtcagcatggccaatatcttccgcgggtcttatctcgctggagccggcctgctgttttccattatgaagaacaccacaaataccagacggggcacagggaacatcggagagaccctcggcgaaaaatggaaaagccgccttaatgctctggggaaatctgagttccagatttacaagaaatccggaatccaggaagtggatagaacgctggccaaggagggcattaaaagaggggaaacagaccaccatgcggttagcagaggatctgccaagctccgctggtttgtggaacggaacatggtcacccctgagggcaaggtggttgatctgggctgcgggagaggaggctggagctattactgtgggggacttaaagacgtgcgcgaagtcaagggcctgaccaaagggggacccggccacgaggaacccatccctatgtccacatatggctggaacctcgtgcggctgcaatctggggtggatgttttcttcacaccccctgagaagtgcgacaccctgctctgtgatatcggagagagctccccgaatcccacgattgaagctggcagaacccttcgcgtcctgagcctggtggagaactggctcaataacgacacacagttttgcatcaaagtgctgaatccttacatgccctccgtcattgaaaagatggagacccttcagcggaagtacgggggagccctggttagaaaccctctctctcgcaatagcacacatgaaatgtattgggtgtccaacgctaccggcaatatcgtgtctagcgtcaacatgatttcccggatgctgatcaatagattcacgatgaaacacaagaaagccacctacgagcccgacgtggatctggggtctggaacacgcaacatcggcattgagagcgaaatcccgaatctcgacattatcggcaagcggattgagaaaatcaagcaggaacacgagacctcctggcattatgatcaagaccacccttacaagacatgggcttatcatgggagctacgaaaccaaacagacaggatctgcctccagcatggttaacggcgtggtcagacttctgaccaagccctgggatgtggttcctatggtgacgcagatggcgatgacagacaccaccccctttgggcagcaacgcgtcttcaaagagaaggtggatacaagaacgcaggagcctaaagaaggaaccaagaagctgatgaaaattacagccgagtggctctggaaggaactgggcaaaaagaaaacaccccggatgtgtacacgcgaggagtttaccagaaaggtgcggtctaatgctgcccttggggctatcttcacagacgaaaacaaatggaagtccgccagagaggccgtcgaagatagccggttttgggagctggttgacaaggaacgcaacctccacctggagggaaaatgcgagacctgtgtgtataatatgatgggcaagagagagaagaagctgggcgagttcgggaaagcgaagggatctcgggctatctggtacatgtggctcggcgcccgctttctggagttcgaggcccttgggtttctgaacgaagatcactggttctccagagagaatagcctctccggagtggagggcgaagggctgcataaacttggctacattctgcgggacgtcagcaaaaaggagggaggcgctatgtatgccgacgatacggctgggtgggacacccgcatcacactcgaagatctgaaaaacgaggaaatggtgaccaatcacatggagggagagcataagaaactggccgaagcgatttttaagctcacataccagaacaaggttgtgagagtccagcggccgacccctcgcggcacggtgatggacatcatttctagacgggatcaacgcgggagcggacaggttggcacatatgggctgaataccttcacaaacatggaggcccagcttatcagacaaatggaaggcgagggagtgttcaaatccatccagcacctgaccgtcacggaggaaattgctgtgcagaattggctcgcccgggttggccgcgagagactgtctcggatggctatcagcggggacgattgcgtggtcaagccccttgacgatagatttgcctccgcgctgaccgccctcaacgacatgggaaaagtgcgcaaggatattcagcaatgggaaccctctcggggctggaatgactggacacaggtccctttctgcagccatcactttcacgagctgatcatgaaagatgggagagtgctggttgtgccgtgtcgcaaccaggacgaactcattggacgggctagaatctcccagggcgccgggtggtctctgaaggagaccgcttgccttggcaagagctacgcccaaatgtggtccctgatgtatttccatcgccgggacctcagactggctgccaatgcgatctgtagcgccgtcccctctcactgggtgcctacatcccgcaccacatggagcattcatgctaaacacgagtggatgaccacggaagatatgcttacagtgtggaaccgggtttggatccaggagaatccctggatggaagacaagacccctgtggagtcttgggaagaggtcccctacctgggaaaaagagaggatcagtggtgcggctccctcattgggctgaccagccgcgccacatgggccaagaacatccagaccgctattaaccaagtgcggtccctgatcggaaatgaagagtatacagactacatgccttctatgaaaagatttcggagagaagaggaagaggccggcgttctctggtga

SEQ ID NO: 20187 - RNA, 9876 nt, synthetic construct
  misc_feature 1..9876: note = derived and/or modified CDS sequence (opt5) from DENV-2__FM210233__SS-prME
  source 1..9876: mol_type = other RNA
agcgccggaatgatcattatgctgatccccaccgtgatggctttccacctgacgacgagaaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatccgcggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatggagtctgccctcaacgatacctggaaaatcgagaaggcttccttcattgaagtgaaaaattgccactggcctaagagccatacactgtggtctaacggcgtcctggagagcgaaatgatcattcccaaaaaccttgccgggccggtgtcccaacacaattacagacctggataccacacccagatcgctggcccctggcatctcgggaagctggagatggacttcgatttttgtgacggaacgacagtgattgtcaccgaagattgcggcaaccgcgggcccagcctgcggaccacaaccgcctctggaaagctcatcacggagtggtgctgtagatcctgcacactgcctccgcttcggtatcgcggcgaggacggctgttggtacgggatggaaattagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttatcaccgggaacatgagctttaaggacctgggacgcgtggttgtgatggtcggcgctacgatggccgatgacattggcatgggggtgacctatctcgccctgctggctgccttcaaagttcggcctacatttgcggctggacttctgctcagaaagctgacctccaaggagctcatgatgacaaccatcggcattgtgctgctttctcaaagcacgatccccgaaacagtcctggagctcaccgatgccctggccctggggatgatggtgcttaaaattgtgcgcaatatggaaaagtaccagctggctgtcacaatcatggccatcctctgcgttcctaacgcggtgattctgcagaatgcttggaaagtgtcctgtaccatcctcgccgtcgtgtctgttagccccctgcttctgacctccagccagcaaaagacagactggattcctctcgccctgacgatcaaaggactgaaccccaccgctattttccttacaaccctgtctagaacaaataagaaacggtcctggccgctcaacgaggccatcatggctgtgggcatggtcagcatcctggcctcttccctcctgaagaatgacattcctatgaccgggccccttgtggcgggaggcctgctgacggtttgctatgtgctcacaggccgcagcgccgatctggaacttgagagagctaccgacgtcaagtgggaggatcaggccgaaatctctgggtccagccctattctgtccatcaccattagcgaggacggatctatgagcatcaaaaacgaagaggaggaacagacactcaccattctgatccggacaggcctcctggtgatctccgggctttttcccatttctatcccgattacggctgccgcctggtacctgtgggaggtcaagaaacagcgcgctggagtgctgtgggatgttccttctccccctcccatgggcaaggcggaactcgaggacggggcctatagaatcaaacaaaagggcattctgggatactcccagatcggcgctggggtgtacaaggaaggaaccttccacacaatgtggcatgtcacccggggcgccgtgcttatgcacaaagggaagcgcatcgagccctcctgggccgatgttaaaaaggacctgattagctatggaggcgggtggaaactcgagggagaatggaaggagggcgaagaggtgcaggtcctggctctcgaacctggcaagaatccgagagccgtgcagacaaaacccgggctgtttaagaccaacacgggaaccatcggcgcggtgtcccttgatttctctcctgggacaagcggatcccccattatcgacaaaaagggcaaagttgtcgggctgtacggaaacggcgtggtgacccggagcggcgcttatgtctctgccattgcccaaacagagaagtccatcgaggataatcctgaaatcgaggacgatatttttcgcaagagacggctgaccatcatggacctccaccccggggctggaaaaacaaagagatacctgcctgccattgtgcgcgaagcgatcaaacggggccttagaacgctgattctcgctccgacccgcgttgtggccgccgagatggaagaggctctgcgggggctccccatcagatatcagacccctgccattcgcgctgagcataccggacgggaaatcgtcgacctgatgtgtcacgccaccttcacaatgagacttctgagccccgtgcgcgttcctaactacaatctgatcattatggatgaggcgcatttcacggaccccgcctctatcgctgcccggggctatatttccaccagagtggaaatgggggaggctgccggcatctttatgacagccaccccgcctggaagccgggatcccttcccccagtccaacgctcctattatcgacgaggaacgcgagatccccgaaagatcttggaatagcggccacgagtgggtcacagattttaaggggaaaaccgtgtggttcgttccttccattaaggcgggaaacgacatcgccgcttgcctccggaagaatggcaaaaaggtgattcaactgagccgcaaaacgtttgattctgaatacgtcaagacaagaaccaacgactgggatttcgtggtgaccacagacatctccgagatgggggccaattttaaagccgagcgggtcattgatccgagacgctgtatgaagcccgttatccttaccgacggagaggaacgggtgatcctggctggccctatgcccgtgacacatagctctgccgcgcagagacgcgggcggattggcagaaaccctaaaaatgaaaacgaccagtacatctatatgggagagcccctcgaaaatgatgaggactgcgctcactggaaggaggccaagatgctgctggataacattaataccccggaaggcatcattcctagcatgttcgagcccgaacgcgagaaagtcgacgccatcgatggggaataccggctcagaggagaggctcgcaagacgtttgtggaccttatgagacggggcgatctgcctgtttggctggcctataaagtggcggccgaggggattaactacgctgaccgcagatggtgtttcgatggaatcaagaacaatcagatcctcgaagagaacgtcgaagtggagatttggacaaaagagggcgaacggaagaagctgaaaccccgctggcttgacgccagaatctattccgatcctctggctctcaaggagtttaaagagttcgccgctgggcggaagtctctgaccctgaatctcattacagagatgggcagacttcccaccttcatgacgcagaagacccgcgacgccctggataacctggcggttctccacacagccgaagctggaggccgggcctacaatcatgctctgagcgagcttccggagaccctggaaacactcctgctgctcacccttctggccacagtgaccgggggaatctttctgttcctcatgtccggcagagggattggaaagatgacgctgggcatgtgctgcatcatcacagcctctattcttctgtggtatgctcagatccagcctcactggattgcggccagcatcattctcgagtttttcctgatcgtcctgctcatccccgaacccgagaagcagcgcacccctcaagacaaccagcttacctacgtggtcattgctatcctgacagtggttgccgccaccatggctaatgaaatgggctttctggagaaaacaaagcgggacctcgggctgggatccattgccacgcagcagccggagagcaacatccttgatattgacctgagacccgcgtctgcctggaccctctacgctgtggccacaaccttcgtgacacctatgctgcggcattccatcgaaaatagctccgtcaacgtttctctgaccgctattgccaatcaagcgacggtgctcatgggccttgggaaaggatggcccctgagcaagatggatatcggcgtgcctctgctcgccatcgggtgttattcccaggtcaaccccattaccctgacagctgcccttctgctcctggtggctcactacgccatcattggacctggcctgcaggctaaagccacccgcgaggcgcagaagagagccgctgccggcatcatgaagaatccgacagttgacgggattaccgtgatcgatctcgaccccatcccttatgatcccaaatttgaaaagcaacttggacaggtcatgctgctgattctctgcgtgacgcaggtcctgatgatgcggacaacctgggctctttgtgaggccctgacactcgccaccggccctatctctaccctgtgggaagggaaccccggacgcttctggaatacaacgattgcggtgagcatggctaacatctttagaggctcctacctggccggggctggactccttttcagcattatgaaaaataccacaaacacccggcgcggcacaggcaacatcggggagaccctgggagagaagtggaaatctagactgaatgccctcggcaagtccgaatttcaaatctataaaaagagcgggattcaggaggttgaccggacgctggccaaggaaggaatcaaacgcggcgagacagatcaccatgctgtgtctagagggtccgccaaacttcggtggttcgtcgagagaaacatggtgaccccggaaggaaaagttgtggacctgggctgcggccgcgggggatggagctactattgtggcgggctcaagaatgtccgggaggtgaaaggactgaccaagggcgggcctggacacgaagaacccattcccatgtctacatacggctggaacctggtgagactccagagcggcgttgatgtctttttcatccctcccgaaaagtgcgacacccttctgtgtgatattggggagtcctctcctaatccgacagtggaggcgggacgcacgctgcgggtgctcaacctggtcgaaaattggcttaacaataacacccagttctgcatcaaagttctgaatccctacatgcctagcgtgatcgagaagatggaagccctccaaagaaaatatggcggggctctggtgcgcaaccccctgtcccggaatagcacacatgagatgtactgggtctccaacgcctctggaaatattgtgagctccgttaacatgatctctagaatgctcattaaccgctttaccatgcggcacaagaaagctacatatgaacctgacgtggaccttggcagcgggaccagaaatatcggaattgagtccgagatccccaacctggatattatcggcaagcgcatcgaaaagattaaacaggagcatgaaacgtcttggcactacgaccaggatcacccgtataagacctgggcctaccatggcagctatgagacaaaacagaccgggtccgcgagctctatggtcaatggagtggttcggctgctcacaaagccttgggacgtgctgcccaccgtcacacaaatggccatgaccgatacgacacctttcggccagcagagagtgtttaaagaaaaggtggacacccgcacccaggagcccaaggaggggaccaagaaacttatgaaaatcacggctgaatggctgtggaaggagctcggcaagaagaaaacccctagaatgtgtacacgggaagagttcacccgcaaggtcagatccaacgccgctctgggcgccatttttacagatgagaataagtggaaaagcgctcgggaagccgttgaggactctagattctgggaactggtggataaggagcggaacctccacctggaagggaaatgcgagacctgtgtgtacaatatgatgggaaagcgcgagaagaaacttggcgaatttggcaaagcgaaagggtccagagccatctggtacatgtggctgggagctcggttcctcgagtttgaagccctgggcttccttaacgaggaccattggtttagccgcgaaaattctctgtccggggtcgagggagagggcctccacaagctggggtatattctgagagatgtgagcaaaaaggaaggcggagctatgtacgccgacgacacagccggctgggatacccggatcacgctcgaggacctgaaaaacgaagagatggttaccaatcacatggaaggggagcataagaaacttgcggaggctatcttcaaactgacatatcaaaacaaggtggtccgcgtgcagagacccaccccgcggggaacagttatggatattatctcccgcagagaccagcggggcagcgggcaagtgggaacctacggcctcaatacgtttacaaacatggaagcccagctgattcgccagatggagggggaaggcgtcttcaaaaatatccagcaccttaccgtgacagaggaggttgccgtgcataactggctggctagagtcggacgggaacgcctctctagaatggccattagcggcgatgactgcgtggtcaagcctctggatgaccggttcgctaacgccctgaccgcgctcaatgatatggggaaaatcagaaaggacatccaacagtgggagccctccaagggatggaacgattggacacaggtgcccttttgctctcaccatttccacgaactgattatgaaagacggccgcgttcttgtggtcccttgtcggaatcaggatgagctgatcgggagagcccgcattagccaaggagctggctggtccctccgggaaaccgcctgcctggggaagtcttatgctcagatgtggagccttatgtactttcacagacgcgacctgcggctcgccgcgaacgccatctgttccgctgtgccgtctcattgggtgcccacaagcagaaccacatggtccattcacgccaaacatgagtggatgaccacagaggacatgctgaccgtttggaatcgcgtgtggatccgggaaaacccttggatggaggataagacgcccgtcgaaagctgggaggaaattccttatctgggcaaaagagaggaccagtggtgcggatctctcatcggcctgacatcccgcgctacctgggccaagaatatccaggctgccattaaccaagtgcggagccttatcgggaatgaggaatacaccgattacatgccctctatgaagagattccggagagaggaagaggaagcgggagttctgtggtga

SEQ ID NO: 20188 - RNA, 9876 nt, synthetic construct
  misc_feature 1..9876: note = derived and/or modified CDS sequence (opt5) from DENV-2__FM210241__SS-prME
  source 1..9876: mol_type = other RNA
accgccggagtgatcattatgctgatccccacagctatggccttccacctcacgacccggaatggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccatcaccgaggctgaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggattcagaaggagaccctggttacgttcaagaaccctcatgccaaaaagcaagacgtggtcgtgctcggctcccaggaaggggccatgcacacagctctgaccggcgcgacagagatccagatgagctccggaaatcttctgtttaccggccatctcaaatgcagactgcggatggataaacttcaactgaaagggatgtcttacagcatgtgtaccggaaagttcaagattgttaaagaaatcgccgagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggctgaacccccttttggggattcttacattatcatcggcgtggagcccggacagctcaaactgaattggttcaagaagggctccagcattgggcaaatgtttgagaccacaatgagaggagccaaacgcatggccatccttggcgacaccgcttgggatttcgggtctctgggaggcgtctttacgagcattgggaaggccctccaccaggtgttcggcgcgatctacggagctgccttttccggcgtttcttggacaatgaaaattctgatcggggccatcattacctggatcggaatgaacagccggtccaccagcctgtctgtgtcccttgtcctcgtgggcgtgattacactgtatctgggggctatggttcaggccgacagcggatgtgtcgtgtcttggaagaataaagaactcaagtgcggctccgggatcttcattaccgataacgtgcacacatggacggagcagtacaagtttcaacctgaaagcccctccaaactggcttctgccatccagaaggcgcatgaggaaggcatctgtggaattagaagcgtcacccgccttgagaatctgatgtggaaacagatcacaccggagctcaaccacattctgtccgaaaatgaggtgaagctgaccatcatgacaggcgacattaaagggatcatgcaggccggaaagcggtctcttagacctcaacccaccgaactcaaatatagctggaagacgtggggcaaggctaaaatgctgtccaccgagagccataaccagacattcctgatcgatgggcctgaaaccgccgagtgccccaatacaaaccgcgcttggaactctctcgaggttgaagactacggatttggcgtgttcaccacaaacatttggctgaaacttcgggagaaacaggacgtcttttgtgattccaagctgatgagcgccgcgatcaaagacaatagagccgtgcacgctgatatgggctattggattgaatctgccctcaacgacacctggaagatggagaaggcttccttcatcgaggttaaaagctgccactggcctaagtctcatacgctgtggagcaatggggtgctggaatccgagatgattatccccaagagcttcgccggaccggtctctcagcacaactaccgccctggctattacacacaaaccgccgggccctggcatcttggaaagctcgaaatggattttgacttctgtgagggcaccacagtggttgtgaccgaagattgcgggaaccggggaccctccctgagaacgacaaccgctagcggcaaactgattacagagtggtgctgtcggtcctgcaccctccctccgctgcgctacagaggcgaggacgggtgttggtatggaatggaaatccggccccttaaggagaaggaagagaatctggtcaactctctcgtgacagcgggccacgggcagatcgataattttagcctgggagtgctgggcatggcccttttcctcgaagagatgctgagaacccgcgtcgggacgaaacatgctattctgctcgttgccgtgtcctttgtgaccctgatcacaggaaacatgtctttccgggaccttggcagagtcatggtgatggttggcgccaccatgacagatgacattgggatgggagtgacctacctggctctcctggccgcgtttaaggtccgccctacgttcgctgccggcctgcttctgagaaaactcacaagcaaggagctgatgatggccaccatcgggattgctctcctgtcccagtctacaatccccgaaaccatccttgagctgaccgatgccctcgcgctgggaatgatggtgctgaaaattgttcggaatatggaaaagtatcaacttgctgtgacaatcatggccattagctgcgtccctaacgccgtgatcctgcagaatgcttggaaggtttcctgtacgattctcgccgctgtgagcgtctctcccctgctcctgacctccagccagcagaaagccgactggatccctcttgcgctgacaatcaagggcctcaaccccaccgccatttttctgacaaccctgtctcgcacgtccaaaaagagaagctggccgcttaatgaggctatcatggccgtggggatggtgtctattctggcttccagcctcctgaaaaacgacatccctatgacaggacccctcgtcgccggcggcctgcttaccgtttgctacgtgctgaccgggcggtccgccgatctggaactcgagcgcgctacagacgtgaagtgggaggatcaagcggaaattagcggatctagccctatcctgtccattaccatctctgaggacggcagcatgtccatcaaaaatgaagaggaggaacagacacttacgattctgatcagaaccgggctcctggtcatttctggactcttccccgtgagcatcccgattacagccgctgcctggtatctgtgggaggttaagaagcagcgggccggcgtgctttgggatgtcccttctccccctcccgtggggaaagctgaactggaggacggagcctaccgcatcaagcagaaaggcatcctgggctatagccaaattggggcgggagtttacaaggaaggcacctttcacacaatgtggcacgtgaccagaggggctgtcctcatgcatcggggaaaacgcatcgagcccagctgggccgatgtgaagaaggacctgatttcctacggcgggggatggaaacttgagggcgaatggaaggagggcgaagaggtccaggtgctggccctcgaacctgggaaaaacccgagagctgttcagacgaagcccggactgttcaaaaccaatacaggcaccatcggggccgtgagcctcgatttttctcctggaacatccggcagccccattgtcgaccggaaggggaaggtggttggactgtatggcaacggcgtggtcaccagatctggggcgtacgtgtccgctatcgcccagacagagaaaagcatcgaggataatcctgaaattgaggacgatatcttccgcaagaaacggcttacgattatggacctgcaccccggagccggcaagaccaaaagatatctgcctgctatcgtgcgcgaagccattaagcgggggctcagaacactgatccttgctccgacccgcgttgtcgccgcggagatggaagaggccctgcggggactccccattagataccaaacccctgctatccgcgccgagcatacaggccgggaaatcgtggacctgatgtgtcacgctacgttcaccatgagactcctgtcccccgtgcgggtccctaactataaccttattatcatggatgaggcccattttacagaccccgcctctattgctgcgcgcgggtacatcagcaccagagtggaaatgggcgaggccgctggaattttcatgacagccaccccgcctggctcccgggatccctttccccagagcaatgcccctatcatcgacgaggaacgcgagattcccgaaagatcttggaactccgggcacgagtgggttacggatttcaagggaaaaacagtgtggtttgtccctagcatcaaggctggcaatgacattgccgcgtgcctgcggaaaaacgggaagaaagtgatccagctgtctagaaagaccttcgatagcgaatatgttaagacccgcacaaatgactgggattttgtggtcaccacagacatttccgagatgggagctaacttcaaagccgagcgggtgatcgatccgagacgctgtatgaagcccgttatcctcaccgacggcgaagaacgggtgattctggccgggcctatgcccgtcacgcactctagcgctgcccaaagacgcggccggatcggaagaaatcctaaaaacgaaaatgaccagtacatttacatgggcgagccccttgaaaacgatgaggactgcgcgcattggaaggaggccaaaatgctgctcgataatatcaacacaccggaagggattatcccttccatgtttgagcccgaacgcgagaaggtggacgctattgatggagaatatagactgcggggcgaggcccgcaaaaccttcgtggacctgatgagaagaggggatctccctgtctggcttgcttaccgcgttgccgctgagggaatcaattatgccgacagacggtggtgttttgatggcgtgaagaacaatcagatcctggaagagaacgtggaagtcgagatttggacaaaggagggggaacgcaagaagctgaaaccccgctggctcgacgcgcggatctactctgatcctctggcccttaaggagttcaaagagttcgctgccggcagaaagagcctgaccctcaacctgattacggagatgggacgcctgcccacctttatgacacagaaggctcgggacgccctcgataatcttgccgtgctgcacaccgctgaagcgggcgggagagcctataaccatgctctgtccgagctcccggagacactggaaacccttctgctcctgacactgctcgccaccgttacgggaggcatcttcctttttctgatgagcgggaaaggagtgggcaagatgacactgggcatgtgctgcattatcaccgcctctatcctcctgtggtacgctcaaattcagcctcactggatcgccgcgtccattatccttgagttctttctgattgtcctcctgatccccgaacccgagaaacagcggacccctcaggacaatcaactgacatatgtggttatcgccattctcaccgtggtcgctgccacaatggctaacgaaatggggttccttgagaagacgaaaaaggacctgggactgggcagcatcgccacccaggagccggaatccaatattctcgatatcgacctgcgccccgcgtctgcctggacactttacgctgtggccaccacatttgtcacccctatgctgagacacagcattgagaactcctctgtgaatgttagcctcacggctatcgccaaccaggctaccgtgctgatggggctgggaaagggctggcccctctccaaaatggatattggggtgcctcttctggccatcggatgttacagccaggtcaatcccatcacactgaccgcggccctcctgtctcttattgctcattatgccatcattggccctggcctgcaagctaaggccacacgggaagcccagaaacgcgcggctgccgggatcatgaagaacccgaccgttgacggaattacggtgatcgatctcgaccccatcccttacgatcccaaattcgagaagcagctgggccaggtgatgctgctcattctttgcgtcacacaagtgctgatgatgagaaccacatgggctctgtgtgaagccctcaccctggccaccgggcctatctccacactttgggagggaaatcccggccggttttggaacacgaccattgctgttagcatggccaatatcttccgcgggtcttatctggcgggagccggcctcctgttttccattatgaagaacacaaccaatacaagacggggcaccgggaacatcggagagacgctgggcgaaaaatggaagtcccgcctcaatgctcttgggaaatctgagttccagatctacaagaaaagcggcattcaggaagtggacagaacactggccaaggagggcatcaaaagaggggaaaccgatcaccatgctgtctccagaggatctgccaagctgcgctggtttgtggaacggaacatggtcaccccggagggcaaggtggttgacctcggctgcgggagaggaggctggagctattactgtgggggactgaaaaacgtgcgcgaagtcaagggccttacaaaagggggacctggccacgaggaacccattcccatgtccacctatggctggaatctggtgcggctccaaagcggggttgatgtgttcttcacacctcccgagaagtgcgacacgctgctgtgtgatatcggagagtcctctcctaacccgaccattgaagcgggcagaacactccgcgtccttagcctggtggagaattggctgaacaatgacacccagttttgcatcaaagtgctcaacccctacatgccttccgttatcgaaaagatggagacactgcagcggaagtacgggggagcccttgtcagaaatcccctgtctcgcaacagcacccatgaaatgtattgggtgtccaatgctacgggcaacattgtgtctagcgtcaatatgatctcccggatgctcattaacagattcaccatgaaacacaagaaagccacatacgagcctgacgttgatctggggagcggaacccgcaatatcggcattgagtctgaaatccccaacctggacattatcggcaagcggatcgagaaaattaagcaggaacacgagacatcctggcattatgatcaagaccacccgtacaagacctgggcttatcatgggagctacgaaacaaaacagaccggatctgcctccagcatggtgaatggcgtggtcagactccttacgaagccttgggatgtggttcccatggtgacacagatggctatgaccgacaccacaccttttgggcagcaacgcgtcttcaaagagaaggtggatacgagaacccaggagcccaaagaaggaacaaagaagctgatgaaaatcaccgccgagtggctgtggaaggaactcggcaaaaagaaaacacctcggatgtgtacccgcgaggagtttacaagaaaggttcggtctaacgcggccctgggggctattttcaccgacgaaaacaaatggaagtccgccagagaggctgtggaagatagccggttttgggagcttgtcgacaaggaacgcaatctgcacctcgagggaaaatgcgagacgtgtgtgtataacatgatgggcaagagagagaagaagctgggcgagttcgggaaagccaagggatcccgggccatctggtacatgtggctgggcgcgcgctttctcgagttcgaggctctggggtttcttaatgaagatcactggttcagcagagagaactctctgagcggagtggagggcgaagggctccataagctgggctacattcttcgggacgtctccaaaaaggagggaggcgccatgtatgccgacgataccgctgggtgggacacacgcatcaccctggaagatctcaaaaatgaggaaatggttacaaaccacatggagggagagcataagagactggccgaagctatctttaaactgacctaccagaataaggtggtgcgggtccagcgccccacgccgagaggcacagtgatggacattatctctcggcgcgatcaaagagggagcggacaggttggcacctatgggctcaacacattcaccaatatggaggcccagttcattcggcaaatggaaggcgagggaatctttaagtccattcagcacctgacggtgaccgaggaaatcgcggtccagaactggcttgcccgcgtgggcagagagcggctgtctagaatggctatcagcggggacgattgcgttgtgaaacctctcgacgatcgcttcgcctccgctctgacagcccttaatgacatgggaaaggtccggaaagatattcagcaatgggaaccctctaagggctggaacgactggacccaggtgcccttttgcagccatcacttccacgagctgatcatgaaagatgggagagttctcgtggtcccttgtcgcaatcaggacgaactgattggacgggcgagaatctcccagggcgccgggtggagcctgaaggagacagcttgcctcggcaagtcttacgcccaaatgtggtccctgatgtattttcatcgccgggaccttagactggctgccaacgctatttgtagcgccgtgccgtctcactgggtccccacctcccgcacaacctggagcatccatgcgaaacacgagtggatgacgacagaagatatgctcaccgtgtggaatcgggtttggattcaggagaacccttggatggaagacaagacccccgtggagtcctgggaagaggtcccttacctgggaaaaagagaggatcagtggtgcggctctcttatcgggctgacaagccgcgccacctgggctaagaacatccagacagccattaatcaagtgcggtccctcatcggaaacgaagagtatacggactacatgcccagcatgaaaagattccggagagaagaggaagaggccggcgtgctgtggtga

SEQ ID NO: 20189 - RNA, 9876 nt, synthetic construct
  misc_feature 1..9876: note = derived and/or modified CDS sequence (opt5) from DENV-2__FM210242__SS-prME
  source 1..9876: mol_type = other RNA
agcgccggcatgatcattatgctgatccccaccgtgatggctttccacctgacaacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtggtgctgcagaatgcttggaaggtctcctgtaccatcctcgccgtggtttctgtgagccccctgcttctgacctccagccagcagaagaccgactggattcctctcgccctgacgatcaagggactgaaccccaccgctattttccttacaaccctgtctcgcacaaataaaaagagatcctggccgctcaacgaggccatcatggctgtcggcatggtgagcatcctggcctcttccctcctgaagaatgacattcctatgaccgggccccttgttgcgggaggcctgctgacggtgtgctatgtcctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccattctgatcagaacaggcctcctggtcatctccgggctttttcccatttctatcccgattacggctgccgcctggtacctgtgggaggtgaaaaagcagcgggctggagttctgtgggatgtgccttctccccctcccatgggcaaagcggaactcgaggacggggcctatcgcatcaagcaaaagggcattctgggatactcccagatcggcgctggggtctacaaagaaggaaccttccacacaatgtggcatgtgaccagaggcgccgttcttatgcacaaggggaaacggatcgagccctcctgggccgatgtgaagaaagacctgattagctatggaggcgggtggaagctcgagggagaatggaaggagggcgaagaggtccaggtgctggctctcgaacctggcaaaaatccgcgcgccgtgcagacaaagcccgggctgtttaaaaccaacacgggaaccatcggcgcggtttcccttgatttctctcctgggacaagcggatcccccattatcgacaagaaaggcaaggtcgtggggctgtacggaaacggcgtggtcaccagaagcggcgcttatgtgtctgccattgcccaaacagagaagtccatcgaggataatcctgaaatcgaggacgatatttttcggaaacgcagactgaccatcatggacctccaccccggggctggaaagacaaaacggtacctgcctgccattgttagagaagcgatcaagcgcggccttcggacgctgattctcgctccgaccagagtggtcgccgccgagatggaagaggctctgcgcgggctccccatccggtatcagacccctgccattaaagctgagcataccggaagagaaatcgtggacctgatgtgtcacgccaccttcacaatgcgccttctgagccccgttcgggtgcctaactacaatctgatcattatggatgaggcgcatttcacggaccccgcctctatcgctgccagaggctatatttccacccgcgtcgaaatgggggaggctgccggcatctttatgacagccaccccgcctggaagccgggatcccttcccccagtccaacgctcctattatcgacgaggaaagagagatccccgaacggtcttggaatagcggccacgagtgggtgacagattttaaggggaagaccgtttggttcgtgccttccattaaagcgggaaacgacatcgccgcttgcctccgcaagaatggcaaaaaggtcattcaactgagcagaaaaacgtttgattctgaatacgtgaagacacggaccaacgactgggatttcgtggtcaccacagacatctccgagatgggggccaattttaaagccgagcgcgttattgatccgagacggtgtatgaagcccgtgatccttaccgacggagaagagagagtgatcctggctggccctatgcccgtcacacatagctctgccgcgcagcgccgggggagaattggccgcaaccctaagaatgaaaacgaccagtacatctatatgggagagcccctcgaaaatgatgaggactgcgctcactggaaagaggccaagatgctgctggataacattaataccccggaaggcatcattcctagcatgttcgagcccgaacgggagaaagtggacgccatcgatggggaatacagactccgcggagaggctcggaagacgtttgttgaccttatgagacgcggcgatctgcctgtgtggctggcctataaagtcgcggccgaggggattaactacgctgacagacggtggtgtttcgatggaatcaagaacaatcagatcctcgaagagaacgtggaagttgagatttggacaaaggagggcgaacgcaaaaagctgaaacccagatggcttgacgcccggatctattccgatcctctggctctcaaggagtttaaagagttcgccgctgggcgcaagtctctgaccctgaatctcattacagagatgggcagacttcccaccttcatgacgcaaaagacccgggacgccctggataacctggcggtgctccacacagccgaagctggaggcagagcctacaatcatgctctgagcgagcttccggagaccctggaaacactcctgctgctcacccttctggccacagtcaccgggggaatctttctgttcctcatgtccggccgcgggattggaaaaatgacgctgggcatgtgctgcatcatcacagcctctattcttctgtggtatgctcagatccagcctcactggattgcggccagcatcattctcgagtttttcctgatcgtgctgctcatccccgaacccgagaagcagcggacccctcaagacaaccagcttacctacgtcgtgattgctatcctgacagttgtggccgccaccatggctaatgaaatgggctttctggagaaaacaaagaaagacctcgggctgggatccattgccacgcagcagccggagagcaacatccttgatattgacctgagacccgcgtctgcctggaccctctacgctgtggccacaaccttcgtcacacctatgctgcgccattccatcgaaaatagctccgttaacgtgtctctgaccgctattgccaatcaagcgacggtgctcatgggccttgggaagggatggcccctgagcaagatggatatcggcgtccctctgctcgccatcgggtgttattcccaggtgaaccccattaccctgacagctgcccttctgctcctggttgctcactacgccatcattggacctggcctgcaggctaaagccacccgggaggcgcagaagagagccgctgccggcatcatgaaaaatccgacagtggacgggattaccgtcatcgatctcgaccccatcccttatgatcccaagtttgaaaaacaacttggacaggtgatgctgctgattctctgcgtcacgcaggtcctgatgatgcggacaacctgggctctttgtgaggccctgacactcgccaccggccctatctctaccctgtgggaagggaaccccggacgcttctggaatacaacgattgcggttagcatggctaacatctttagaggctcctacctggccggggctggactccttttcagcattatgaagaataccacaaacacccggcgcggcacaggcaacatcggggagaccctgggagagaaatggaagtctagactgaatgccctcggcaagtccgaatttcaaatctataaaaagagcgggattcaggaggtggaccggacgctggccaaagaaggaatcaagcgcggcgagacagatcaccatgctgtctctagagggtccgccaaacttcggtggttcgtggagcgcaacatggttaccccggaaggaaaggtggtcgacctgggctgcggcagagggggatggagctactattgtggcgggctcaagtctgtgcgggaggtgaaaggactgaccaagggcgggcctggacacgaagaacccattcccatgagcacatacggctggaatctggttagactccagtccggcgtcgatgtgtttttcatccctcccgaaaaatgcgacacccttctgtgtgatattggggagtctagccctaacccgacagtggaggcgggacgcacgctgcgggtcctcaatctggttgaaaactggcttaataacaatacccagttctgcatcaaggtgctgaacccctacatgccttccgtgatcgagaaaatggaagccctccaaagaaagtatggcggggctctggtccgcaatcccctgagccggaactccacacatgagatgtactgggtgtctaatgccagcggaaacattgtttcctctgtgaatatgatcagcagaatgctcattaaccgctttaccatgcggcacaagaaagctacatatgaacctgacgtcgaccttggctccgggaccagaaacatcggaattgagtctgagatccccaatctggatattatcggcaagcgcatcgagaaaattaagcaggagcatgaaacgagctggcactacgaccaggatcacccgtataaaacctgggcctaccatggctcctatgagacaaagcagaccgggagcgcgtcttccatggtgaacggagttgtgcggctgctcacaaagccttgggacgtcctgcccaccgtgacacaaatggccatgaccgatacgacacctttcggccagcagagagtgtttaaagaaaaggtcgacacccgcacccaggagcccaaagaggggacaaagaaacttatgaagatcacggctgaatggctgtggaaagagctcggaaagaagaaaacccctcggatgtgtacaagagaagagttcacccgcaaggttagaagcaatgccgctctgggcgccatttttacagatgagaacaaatggaagtctgctcgggaagccgtggaggactcccgcttctgggaactggtggataaagagagaaatctccacctggaagggaagtgcgagacctgtgtctacaacatgatgggaaagcgggagaagaaacttggcgaatttggcaaagcgaaagggagcagagccatctggtacatgtggctgggagctcggttcctcgagtttgaagccctgggcttccttaatgaggaccattggttttctcgcgaaaactccctgagcggggtggagggagagggcctccacaaactggggtatattctgagagatgtttccaagaaggaaggcggagctatgtacgccgacgacacagccggctgggatacccggatcacgctcgaggacctgaaaaatgaagagatggtgaccaaccacatggaaggggagcataagaaacttgcggaggctatcttcaagctgacatatcaaaataaagtcgtgcgcgttcagagacccaccccgcggggaacagtgatggatattatcagccgcagagaccagcggggctctgggcaagtcggaacctacggcctcaacacgtttacaaatatggaagcccagctgattcgccagatggagggggaaggcgtgttcaagaacatccagcaccttaccgttacagaggaggtggccgtccaaaattggctggctagagtgggacgggaacgcctcagcagaatggccatttccggcgatgactgcgtcgtgaagcctctggatgaccggttcgctaacgccctgaccgcgctcaacgatatggggaaaatccgcaaggacatccagcagtgggagccctctaaaggatggaatgattggacgcaggttcccttttgcagccatcacttccatgaactgattatgaaggacggcagagtgcttgtcgtgccttgtcggaaccaagatgagctgatcgggagagcccgcatttcccagggagctggctggtctctccgggaaaccgcctgcctggggaaaagctatgctcagatgtggtcccttatgtactttcacagacgcgacctgcggctcgccgcgaatgccatctgttctgctgtgccgagccactgggttcccacatccagaaccacatggagcattcatgccaagcacgagtggatgaccacagaggacatgctgaccgtgtggaaccgcgtctggatccgggaaaatccttggatggaggataagacgcccgtggaatcttgggaggaaattccttatctgggcaaaagagaggaccagtggtgcggatccctcatcggcctgacaagccgcgctacctgggccaagaacatccaagctgccattaatcaggttcggtctcttatcgggaacgaggaatacaccgattacatgccctccatgaaaagattccgccgggaggaagaggaagcgggagtgctgtggtga

SEQ ID NO: 20190 - RNA, 9876 nt, synthetic construct
  misc_feature 1..9876: note = derived and/or modified CDS sequence (opt5) from DENV-2__FM210243__SS-prME
  source 1..9876: mol_type = other RNA
accgccggcgtgatcattatgctgatccccaccgctatggccttccacctcacgacccggaatggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaggaacaggacaaacgctttgtgtgcaagcattccatggtggatagaggctggggcaacgggtgtggactgttcggcaaagggggaatcgtcacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtcttccattacagaggccgaactgaccgggtatggaacggtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacactggtgaccttcaagaaccctcatgccaaaaagcaagacgtcgtggttctcggctcccaggaaggggctatgcacacggcgctgacaggcgccaccgagattcagatgagctccggaaatcttctgtttacaggccatctcaaatgcagactgcggatggataaacttcaactgaaagggatgtcttacagcatgtgtaccggaaagttcaagatcgtgaaagaaattgctgagacccagcacggcacaatcgtcatcagagtgcagtatgagggggacggatccccctgcaagattcccttcgaaatcatggatctcgagaaacgccatgtcctgggccggctgattacggtgaaccctatcgttaccgaaaaggacagcccggtgaacattgaggccgaacccccttttggggattcttacatcattatcggcgtcgagcccggacagctcaaactgaattggttcaagaagggctccagcatcgggcaaatgtttgagacaaccatgagaggagccaaacgcatggctattcttggcgacacagcctgggatttcgggtctctgggaggcgtgtttaccagcatcgggaaggcgctccaccaggttttcggcgctatttacggagccgccttttccggcgtgtcttggacgatgaaaatcctgattggggtcatcatcacatggattggaatgaacagccggtccaccagcctgtctgtgtcccttgtgctcgttggcatcattaccctgtatctgggggctatggtccaggccgacagcggatgtgtggtgtcttggaagaataaagaactcaagtgcggctccgggatcttcattacagataacgtccacacctggacagagcagtacaagtttcaacctgaaagcccctccaaactggcttctgccatccagaaggcgcatgaggaaggcatctgtggaattagaagcgtgacgcgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacagaactcaaatatagctggaagacctggggcaaggctaaaatgctgtccacggagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgcgatcaaagacaatagagccgttcacgctgatatgggctattggattgaatctgccctcaacgacacatggaagatggagaaggcttccttcatcgaggtgaaaagctgccactggcctaagtctcataccctgtggagcaatggggtcctggaatccgagatgattatccccaagagcttcgccggaccggtgtctcagcacaactaccgccctggctattacacgcaaacagccgggccctggcatcttggaaagctcgaaatggattttgacttctgtgagggcaccaccgttgtggtcacagaagattgcgggaaccggggaccctccctgagaaccacgacagctagcggcaaactgattaccgagtggtgctgtcggtcctgcacactccctccgctgcgctacagaggcgaggacgggtgttggtatggaatggaaatccggccccttaaggagaaggaagagaatctggtgaactctctcgtgaccgcgggccacgggcagatcgataattttagcctgggagtcctgggcatggcccttttcctcgaagagatgctgagaacacgcgttgggaccaaacatgctattctgctcgtgacggtgtcctttgtcaccctgatcacaggaaacatgtctttccgggaccttggcagagtgatggttatggtgggcgccgccatgaccgatgacattgggatgggagtcacatacctggctctcctggccgcgtttaaggtgcgccctaccttcgctgccggcctgcttctgagaaaactcacgagcaaggagctgatgatggccacaatcgggattgctctcctgtcccagtctaccatccccgaaacaatccttgagctgaccgatgccctcgcgctgggaatgatggttctgaaaattgtgcggaatatggaaaagtatcaacttgctgtcaccatcatggccattagctgcgtgcctaacgccgttatcctgcagaatgcttggaaggtgtcctgtacaattctcgccgctgtcagcgtgtttcccctgctcctgacgtcttcccagcagaaagccgactggatccctcttgcgctgaccatcaagggcctcaaccccacagccattttcctgaccacactgagccgcacctctaaaaagagatcctggccgcttaatgaggctatcatggccgtggggatggtcagcattctggcttcttccctcctgaaaaacgacatccctatgacgggacccctcgttgccggcggcctgcttacagtgtgctacgtgctgaccgggcggagcgccgatctggaactcgagcgcgctaccgacgtcaagtgggaggatcaagcggaaatttccggaagctctcctatcctgagcattacaatcgccgaggacggctccatgtctatcaaaaatgaagaggaggaacagacccttacaattctgatcagaacggggctcctggtgattagcggactctttcccgtttccatcccgattaccgctgccgcctggtatctgtgggaggtgaagaagcagcgggctggcgtcctttgggatgtgccttctccccctcccgttgggaaagccgaactggaggacggagcgtaccgcatcaagcagaaaggcatcctgggctatagccaaattggggctggagtgtacaaggaaggcacattccacaccatgtggcacgtcacaagaggggccgtgctcatgcatcggggaaaacgcatcgagccctcctgggccgatgtcaagaaggacctgatttcttacggcgggggatggaaacttgagggcgaatggaaggagggcgaagaggtgcaggttctggctctcgaacctgggaaaaacccgagagccgtgcagaccaagcccggactgtttaaaacgaataccggcacaatcggggcggtcagcctcgatttctcccctggaaccagcggctctcccattgtggaccggaaggggaaggttgtgggactgtatggcaacggcgtcgtgacaagatccggggcttacgtgagcgccatcgcccagaccgagaaatctatcgaggataatcctgaaattgaggacgatatcttccgcaagaaacggcttacaattatggacctgcaccccggagctggcaagacgaaaagatatctgcctgccatcgttcgcgaagctattaagcgggggctcagaaccctgatccttgccccgacacgcgtcgtggcggccgagatggaagaggctctgcggggactccccattagataccaaacccctgccatccgcgctgagcataccggccgggaaatcgtggacctgatgtgtcacgccacatttacgatgagactcctgtcccccgtccgggtgcctaactataaccttattatcatggatgaggcccatttcaccgaccccgctagcattgcggcccgcgggtacatctccacaagagttgaaatgggcgaggctgccggaatttttatgaccgccacaccgcctggctctcgggatcccttcccccagagcaatgctcctatcatggacgaggaacgcgagatccccgaaagatcctggaacagcgggcacgagtgggtgaccgattttaagggaaaaacggtctggttcgtgccttctattaaggccggcaatgacatcgcggcttgcctgcggaaaaacgggaagaaagttattcagctgtccagaaagacatttgatagcgaatatgtgaagacccgcaccaatgactgggatttcgtcgtgacaaccgacatctctgagatgggagccaactttaaagccgagcgggttattgatccgagacgctgtatgaagcccgtgatcctcacagacggcgaagaacgggtcatcctggctgggcctatgcccgtgacccacagctccgccgcgcaaagacgcggccggattggaagaaatcctaaaaacgaaaatgaccagtacatctacatgggcgagccccttgaaaacgatgaggactgcgcccattggaaggaggctaaaatgctgctcgataatattaacacgccggaagggatcattccttctatgttcgagcccgaacgcgagaaggtggacgccatcgatggagaatatagactgcggggcgaggctcgcaaaacatttgtcgacctgatgagaagaggggatctccctgtttggcttgcctaccgcgtggctgccgagggaattaattatgcggacagacggtggtgtttcgatggcgtgaagaacaatcagatcctggaagagaacgtcgaagtggagatctggaccaaggagggggaacgcaagaagctgaaaccccgctggctcgacgcccggatttacagcgatcctctggctcttaaggagttcaaagaatttgccgctggcagaaagtccctgacactcaacctgatcaccgagatgggacgcctgcccacgttcatgacccagaaggcccgggacgccctcgataatcttgctgttctgcacacagcggaagccggcgggagagcttataaccatgccctgtctgagctcccggagaccctggaaacacttctgctcctgaccctgctcgccacagtgaccggaggcatttttcttttcctgatgagcgggaaaggagtcggcaagatgacgctgggcatgtgctgcatcattacagcttccatcctcctgtggtacgcccaaatccagcctcactggattgcggccagcatcattcttgagtttttcctgatcgtgctcctgattcccgaacccgagaaacagcggacccctcaggacaatcaactgacctatgttgtgatcgctatcctcacagtcgtggccgctaccatggccaacgaaatggggtttcttgagaagaccaagaaggacctgggactgggctctattgcgacgcaggagccggaatccaatatcctcgatattgacctgcgccccgccagcgcttggaccctttacgccgtcgctacaaccttcgtgacacctatgctgagacactccatcgagaactctagcgttaatgtgtccctcaccgccattgctaaccaggccacggtgctgatggggctgggaaagggctggcccctctctaaaatggatatcggggtccctcttctggcgattggatgttacagccaggttaatcccatcaccctgacagccgctctcctgcttctggtggcccattatgctatcattggccctggcctccaagccaaggccacccgggaagcgcagaaacgcgctgccgctgggatcatgaagaacccgacagtggacggaattaccgtcatcgatctggaccccattccttacgatcccaaatttgagaagcagctgggccaggtgatgctccttatcctgtgcgttacgcaagtgctgatgatgagaacaacctgggccctctgtgaagccctgacacttgctaccgggcctatctccaccctgtgggagggaaatcccggccggttctggaacacaacgattgccgtcagcatggcgaatatctttcgcgggtcttatctcgccggagctggcctgctgttctccattatgaagaacaccacaaataccagacggggcacagggaacatcggagagaccctcggcgaaaaatggaaaagccgccttaatgccctggggaaatctgagtttcagatttacaagaaatccggaatccaggaagtggacagaacgctggctaaggagggcatcaaaagaggggagacagatcaccatgccgtcagcagaggatctgcgaagctccgctggttcgtggaacggaacatggttaccccggagggcaaggtggtcgacctgggctgcgggagaggaggctggagctattactgtgggggacttaaaaacgtgcgcgaagttaagggcctgaccaaagggggacctggccacgaggaacccattcccatgtccacatatggctggaatctcgtgcggctgcaatctggggtcgatgtgttctttacccctcccgagaagtgcgacacactgctctgtgatatcggagagagctcccctaacccgacgattgaagccggcagaacccttcgcgtgctgagcctggttgagaattggctcaacaatgacacacagttctgcatcaaagtcctgaacccctacatgccttccgtgattgaaaagatggagacccttcagcggaagtacgggggagctctggtgagaaatcccctctctcgcaacagcacacatgaaatgtattgggtctccaatgccaccggcaacatcgtttctagcgtgaatatgatctcccggatgctgattaacagatttacgatgaaacacaagaaagctacctacgagcctgacgtggatctggggtctggaacacgcaatatcggcattgagagcgaaatccccaacctcgacattatcggcaagcggattgagaaaatcaagcaggaacacgagacctcctggcattatgatcaagaccacccgtacaagacatgggcctatcatgggagctacgaaaccaaacagacaggatctgcttccagcatggtcaatggcgtggttagacttctgaccaagccttgggatgtggtccccatggtgacgcagatggccatgacagacaccacccctttcgggcagcaacgcgtttttaaagagaaggtggatacaagaacgcaggagcccaaagaaggaaccaagaagctgatgaaaatcacagcggagtggctctggaaggaactgggcaaaaagaaaacccctcggatgtgtacacgcgaggagttcaccagaaaggtccggtctaacgccgctcttggggccatttttacagacgaaaacaaatggaagtccgctagagaggccgtggaagatagccggttctgggagctggtggacaaggaacgcaatctccacctggagggaaaatgcgagacctgtgtctataacatgatgggcaagagagagaagaagctgggcgagtttgggaaagccaagggatctcgggcgatctggtacatgtggctcggcgctcgcttcctggaatttgaggcccttgggttcctgaatgaagatcactggttttccagagagaacagcctctccggagttgagggcgaagggctgcataaacttggctacattctgcgggacgtgagcaaaaaggagggaggcgccatgtatgctgacgatacggccgggtgggacacccgcatcacactcgaagatctgaaaaatgaggaaatggtgaccaaccacatggagggagagcataagaaactggctgaagccattttcaagctcacataccagaataaggtcgtgagagttcagcggcccaccccgcgcggcacggtgatggacatcatctctagacgggatcaacgcgggagcggacaggtcggcacatatgggctgaacaccttcacaaatatggaggcgcagcttattagacaaatggaaggcgagggaatctttaaatccattcagcacctgaccgtgacggaggaaatcgccgttcagaactggctcgctcgggtgggccgcgagagactgtctcggatggccattagcggggacgattgcgtcgtgaagcctcttgacgatagattcgcttccgccctgaccgcgctcaatgacatgggaaaagttcgcaaggatatccagcaatgggaaccctctcggggctggaacgactggacacaggtgcccttttgcagccatcacttccacgagctgatcatgaaagatgggagagtcctggtggtcccttgtcgcaatcaggacgaactcattggacgggccagaatctcccagggcgctgggtggtctctgaaggagaccgcctgccttggcaagagctacgctcaaatgtggtccctgatgtattttcatcgccgggacctcagactggccgctaacgccatttgtagcgcggtgccgtctcactgggttcccacatcccgcaccacatggagcatccatgccaaacacgagtggatgaccacggaagatatgcttacagtgtggaatcgggtctggattcaggagaacccttggatggaagacaagacccccgtggagtcttgggaagaggtgccttacctgggaaaaagagaggatcagtggtgcggctccctcatcgggctgaccagccgcgctacatgggccaagaacattcagaccgccatcaatcaagttcggtccctgatcggaaacgaagagtatacagactacatgccctctatgaaaagattccggagagaagaggaagaggctggcgtgctctggtga

SEQ ID NO: 20191 - RNA, 9876 nt, synthetic construct
  misc_feature 1..9876: note = derived and/or modified CDS sequence (opt5) from DENV-2__FM210244__SS-prME
  source 1..9876: mol_type = other RNA
accgccggagtgatcattatgctgatccccaccgctatggccttccacctcacgaccagaaacggggaacctcatatgattgtcggacggcaggaaaagggcaagagcctgctttttaagaccgaagacggggttaatatgtgcaccctgatggcgatcgatctcggagaactgtgtgaggacacaattacctacaagtgcccccttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacctgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtggccgtcagctttgtgacgctgattaccggaaacatgtccttccgggaccttggcagagttatggtgatggtcggcgccgctatgacagatgacatcgggattggagtgacctacctggccctcctggcggcttttaaggttcgccccacattcgccgccggcctgcttctgagaaaactcacctctaaggagctgatgatggctacgatcgggattgccctcctgagccagtccacaatccctgaaaccatccttgagctgacagatgcgctcgctctgggaatgatggtgctgaaaattgtccggaatatggaaaagtatcaacttgccgtgaccatcatggccatttcttgcgttcccaacgctgtgatcctgcagaatgcctggaaggtcagctgtaccattctcgctacagtgtccgtgagccctctgctcctgacgtcttcccagcagaaagccgactggatcccccttgcgctgaccatcaagggcctcaacccgacagccatttttctgaccacactgagccgcacctctaaaaagagatcctggcctcttaatgaggctatcatggccgtcgggatggttagcattctggcttcttccctcctgaaaaacgacatccccatgacgggacctctcgtggccggcggcctgcttacagtgtgctacgtcctgaccgggcggagcgccgatctggaactcgagcgcgctaccgacgtgaagtgggaggatcaagcggaaatttccggaagctctcccatcctgagcattacaatcgccgaggacggctccatgtctatcaaaaatgaagaggaggaacagacccttacaattctgatcagaacggggctcctggttattagcggactcttcccggtgtccatccctattaccgctgccgcctggtatctgtgggaggtcaagaagcagcgggctggcgtgctttgggatgttccctctcctccgcccgtggggaaagccgaactggaggacggagcgtaccgcatcaagcagaaaggcatcctgggctatagccaaattggggctggagtctacaaggaaggcacatttcacaccatgtggcacgtgacaagaggggccgtcctcatgcatcggggaaaacgcatcgagccttcctgggccgatgtgaagaaggacctgatttcttacggcgggggatggaaacttgagggcgaatggaaggagggcgaagaggttcaggtgctggctctcgaaccggggaaaaaccccagagccgtccagaccaagcctggactgttcaaaacgaataccggcacaatcggggcggtgagcctcgatttttcccccggaaccagcggctctcctattgttgaccggaaggggaaggtggtcggactgtatggcaacggcgtggtgacaagatccggggcttacgttagcgccatcgcccagaccgagaaatctatcgaggataatcccgaaattgaggacgatatcttccgcaagaaacggcttacaattatggacctgcaccctggagctggcaagacgaaaagatatctgccggccatcgtccgcgaagctattaagcgggggctcagaaccctgatccttgcccccacacgcgtggtggcggccgagatggaagaggctctgcggggactccctattagataccaaacccccgccatccgcgctgagcataccggccgggaaatcgtcgacctgatgtgtcacgccacattcacgatgagactcctgtcccctgtgcgggttcccaactataaccttattatcatggatgaggcccattttaccgacccggctagcattgcggcccgcgggtacatctccacaagagtggaaatgggcgaggctgccggaattttcatgaccgccacacctcccggctctaaggatccctttcctcagagcaatgctcccatcatggacgaggaacgggagatccctgaacgctcctggaacagcgggcacgagtgggtcaccgatttcaaaggaaagacggtgtggtttgttccgtctattaaagccggcaatgacatcgcggcttgcctgagaaagaacgggaaaaaggtgattcagctgtcccggaagacattcgatagcgaatatgtcaaaaccagaaccaatgactgggattttgtggttacaaccgacatctctgagatgggagccaacttcaaggccgagcgcgtgattgatccccggagatgtatgaaacctgtcatcctcacagacggcgaagaacgcgtgatcctggctgggcccatgcctgtgacccacagctccgccgcgcaacggagaggccgcattggacggaatcccaagaacgaaaatgaccagtacatctacatgggcgagccgcttgaaaacgatgaggactgcgcccattggaaagaggctaagatgctgctcgataatattaacacgcctgaagggatcattccctctatgtttgagcctgaaagagagaaagtcgacgccatcgatggagaatatcgcctgagaggcgaggctcggaagacattcgttgacctgatgcgcagaggggatctccccgtgtggcttgcctaccgggtggctgccgagggaattaattatgcggaccgcagatggtgttttgatggcgtcaagaacaatcagatcctggaagagaacgtggaagttgagatctggaccaaagagggggaacggaagaaactgaagcctagatggctcgacgcccgcatttacagcgatcccctggctcttaaagagttcaaggagttcgccgctggccggaagtccctgacactcaacctgatcaccgagatgggaagactgccgacgtttatgacccagaaagcccgcgacgccctcgataatcttgctgtgctgcacacagcggaagccggcgggaaggcttataaccatgccctgtctgagctccctgagaccctggaaacacttctgctcctgaccctgctcgccacagtcaccggaggcattttcctttttctgatgagcgggaaaggagtgggcaagatgacgctgggcatgtgctgcatcattacagcttccatcctcctgtggcacgcccaaatccagccccactggattgcggccagcatcattcttgagttctttctgatcgttctcctgattcccgaacctgagaaacagcggaccccgcaggacaatcaactgacctacgtggtcatcgctatcctcacagtggtcgccgctaccatggccaacgaaatggggttccttgagaagacaaagaaagacctgggactgggctctattgcgacgcaggagcccgaatccaatatcctcgatattgacctgagacctgccagcgcttggaccctttatgccgtggctacaacctttgttacacccatgctgcggcattccatcgagaactctagcgtgaatgtgtccctcaccgccattgctaaccaggccacggtcctgatggggctgggaaagggctggcctctctctaaaatggatatcggggttccccttctggcgattggatgttacagccaggtgaatcctatcaccctgacagccgctctcctgcttctggtggcccactacgctatcattggcccgggcctccaagccaaggccacccgcgaagcgcagaaaagagctgccgctgggatcatgaagaaccccacagtcgacggaattaccgtgatcgatctggaccctattccctatgatcctaagttcgagaaacagctgggccaggttatgctccttatcctgtgcgtgacgcaagtcctgatgatgcggacaacctgggccctctgtgaagccctgacacttgctaccgggcccatctccaccctgtgggagggaaatccgggccgcttttggaacacaacgattgccgtgagcatggcgaatatcttcagagggtcttacctcgccggagctggcctgctgttttccattatgaagaacaccacaaatacccggcgcggcacagggaacatcggagagaccctcggcgaaaaatggaaaagcagacttaatgccctggggaaatctgagttccagatttataagaaatccggaatccaggaagtcgaccggacgctggctaaggagggcatcaagcgcggggagacagatcatcacgccgtgagcagaggatctgcgaaactccggtggtttgttgaaagaaacatggtgacccctgagggcaaggtcgtggacctgggctgcgggcgcggaggctggagctactattgtgggggacttaaaaacgttcgggaagtgaagggcctgaccaaagggggacccggccatgaggaacccattcctatgtccacatacggctggaatctcgtcagactgcaatctggggtggatgtgttcttcacaccccctgagaagtgcgacaccctgctctgtgatatcggagagagctccccgaaccccacgattgaagccggccgcacccttcgggttctgagcctggtcgagaattggctcaacaatgacacacagttttgcatcaaggtgctgaacccttatatgccctccgtgattgagaagatggagacccttcagagaaagtacgggggagctctggtccgcaatcctctctctcggaacagcacacacgaaatgtactgggtttccaatgccaccggcaacatcgtgtctagcgtgaatatgatctccagaatgctgattaaccgcttcacgatgaaacacaagaaagctacctatgagcccgacgtcgatctggggtctggaacacggaatatcggcattgagagcgaaatgccgaacctcgacatcattggcaagagaatcgagaagattaaacaggaacatgagacctcctggcactacgatcaagaccatccttataagacatgggcctaccacgggagctatgaaaccaaacagacaggatctgcttccagcatggtgaatggcgttgtgcgccttctgaccaagccctgggatgtcgtgcctatggttacgcagatggccatgacagacaccaccccctttgggcagcaacgggtgttcaaagagaaggtcgatacaagaacgcaggagcctaaggaaggaaccaaaaagctgatgaaaatcacagcggagtggctctggaaggaactgggcaaaaagaaaacaccccgcatgtgtacaagagaggagtttacccggaaggtgcgctctaacgccgctcttggggccatcttcacagacgaaaacaagtggaaatccgctagagaggccgtggaagatagccggttttgggagctggtcgacaaggaaagaaatctccacctggagggaaaatgcgagacctgtgtttacaacatgatgggcaagcgggagaagaagctgggcgagttcgggaaggccaaaggatctcgcgcgatttggtatatgtggctcggcgctagatttctggagttcgaggcccttgggtttctgaatgaagatcattggttctcccgggagaacagcctctccggagtggagggcgaagggctgcacaaacttggctacatcctgcgcgacgtgagcaaaaaggagggaggcgccatgtacgctgacgatacggccgggtgggacaccagaattacactcgaagatctgaaaaatgaggaaatggtcaccaaccatatggagggagagcacaagaagctggctgaagccatctttaaactcacatatcagaataaggtggttcgggtgcagcgcccgacccctagaggcacggtcatggacattatctctcggcgcgatcaaagagggagcggacaggtgggcacatacgggctgaacaccttcacaaatatggaggcgcagcttatccggcaaatggaaggcgagggaattttcaaatccatccagcatctgaccgttacggaggaaattgccgtgcagaactggctcgctcgcgtcggcagagagcggctgtctcgcatggccatcagcggggacgattgcgtggttaagccccttgacgatagatttgcttccgccctgaccgcgctcaatgacatgggaaaagtgcggaaggatattcagcaatgggaaccctctagaggctggaacgactggacacaggtccctttctgcagccaccactttcatgagctgatcatgaaggatgggcgcgtgctggtcgtgccgtgtcggaatcaggacgaactcatcggcagagcccgcatttcccagggcgctgggtggtctctgaaagagaccgcctgccttggcaagagctatgctcaaatgtggtccctgatgtacttccaccggagagacctccgcctggccgctaacgccatctgtagcgcggttccctctcattgggtgcctacatcccggaccacatggagcattcacgccaaacacgagtggatgaccacggaagatatgcttacagtctggaatagagtgtggatccaggagaacccctggatggaagacaagacccctgtggagtcttgggaagaggttccctatctgggaaaacgcgaggatcagtggtgcggctccctcattgggctgaccagccgggctacatgggccaagaacatccagaccgccattaatcaagtgagatccctgatcggaaacgaagagtacacagactatatgccttctatgaagcgctttcggagagaagaggaagaggctggcgtcctctggtga

SEQ ID NO: 20192 - RNA, 9876 nt, synthetic construct
  misc_feature 1..9876: note = derived and/or modified CDS sequence (opt5) from DENV-2__FM210234__SS-prME
  source 1..9876: mol_type = other RNA
accgccggagtgatcattatgctgatccccaccgctatggccttccacctcacgaccagaaacggggaacctcatatgattgtcggacggcaggaaaagggcaaaagcctgctttttaagaccgaagacggggttaatatgtgcaccctgatggcgatcgatctcggagaactgtgtgaagacacaattacctacaaatgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggaatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgggaaggactcccccgtgaacattgaagccgagcctccctttggcgatagctacatcattatcggagtcgaacctggccagctcaaactgaattggttcaagaaggggtcttccatcggacaaatgtttgagacaaccatgagaggcgccaaacgcatggctattcttggggacacagcctgggatttcggaagcctgggcggggtgtttacctctatcggcaaggcgctccaccaggttttcggagctatttacggcgccgcctttagcggggtgtcctggacgatgaaaatcctgattggagtcatcatcacatggattggcatgaactctcggagcacctccctgagcgtgtctcttgtgctcgttggggtcatcaccctgtatctgggagctatggtgcaggccgactccggctgtgtggtcagctggaagaataaagagctcaagtgcgggtctggcattttcatcacagataacgtgcacacctggacagaacagtacaagtttcaacccgagtccccgagcaaactggcttccgccattcagaaggcgcatgaagagggaatctgtggcatcagatctgttacgcgccttgaaaatctgatgtggaaacagattacccctgagctcaaccacatcctgagcgagaatgaagtgaagctgacaattatgaccggggacatcaaaggaattatgcaggccggcaagcggtcccttagaccccaacctacagagctcaaatattcttggaagacctgggggaaggctaaaatgctgagcacggaatcccataaccagaccttcctgatcgatggacccgagacagccgaatgccctaataccaaccgcgcttggaatagcctcgaggtcgaggactacggctttggcgtgttcacaaccaacatctggctgaaacttcgggaaaaacaggacgtcttttgtgattctaagctgatgtccgccgcgattaaagacaatagagccgtgcacgctgatatggggtattggatcgagagcgccctcaacgacacatggaagatggaaaaggcttctttcattgaggtcaaatcctgccactggcccaagagccataccctgtggtctaatggagtgctggagagcgaaatgatcattccgaaatccttcgccggccctgttagccagcacaactaccgccccgggtattacacgcaaacagccggaccctggcatcttggcaagctcgagatggattttgacttctgtgaagggaccaccgtggtcgtgacagaggattgcggaaaccggggcccttctctgagaaccacgacagcttccggcaaactgatcaccgaatggtgctgtcggagctgcacactcccgcccctgcgctacagaggggaggacggatgttggtatggcatggagattcggcctcttaaggaaaaggaggaaaatctggtgaactccctcgtcaccgcggggcacggacagatcgataatttttctctgggcgttctggggatcgcccttttcctcgaggaaatgctgagaacacgcgtgggaaccaaacatgctattctgctcgtggccgtcagctttgtgacgctgatcaccggcaacatgtccttccgggaccttggcagagttatggtgatggtcggggccgctatgacagatgacattggaatgggcgtgacctacctggccctcctggcggcttttaaggttcgccccacattcgccgccgggctgcttctgagaaaactcacctctaaggagctgatgatggctacgatcggaattgccctcctgagccagtccacaatccctgagaccatccttgaactgacagatgcgctcgctctgggcatgatggtgctgaaaattgtccggaatatggagaagtatcaacttgccgtgaccatcatggccatttcttgcgttcccaacgctgtgatcctgcagaatgcctggaaggtcagctgtaccattctcgctacagtgtccgtgagccctctgctcctgacgtcttcccagcagaaagccgactggatcccccttgcgctgaccatcaaggggctcaacccgacagccatttttctgaccacactgagccgcacctctaaaaagagatcctggcctcttaatgaagctatcatggccgtcggaatggttagcattctggcttcttccctcctgaaaaacgacatccccatgacgggccctctcgtggccggcgggctgcttacagtgtgctacgtcctgaccggacggagcgccgatctggagctcgaacgcgctaccgacgtgaagtgggaggatcaagcggagatttccggcagctctcccatcctgagcattacaatcgccgaagacgggtccatgtctatcaaaaatgaggaagaggagcagacccttacaattctgatcagaacgggactcctggttattagcggcctcttcccggtgtccatccctattaccgctgccgcctggtatctgtgggaagtcaagaagcagcgggctggggtgctttgggatgttccctctcctccgcccgtgggaaaagccgagctggaagacggcgcgtaccgcatcaagcagaaaggcatcctggggtatagccaaattggagctggcgtctacaaggaggggacatttcacaccatgtggcacgtgacaagaggagccgtcctcatgcatcggggcaaacgcatcgaaccttcctgggccgatgtgaagaaggacctgatttcttacgggggaggctggaaacttgagggcgagtggaaggaaggggaggaagttcaggtgctggctctcgagccgggcaagaaccccagagccgtccagaccaagcctggcctgttcaaaacgaataccgggacaatcggagcggtgagcctcgatttttcccccggcaccagcgggtctcctattgttgaccggaagggaaaggtggtcggcctgtatggcaacggggtggtgacaagatccggagcttacgttagcgccatcgcccagaccgaaaaatctatcgaggataatcccgagattgaagacgatatcttccgcaagaaacggcttacaattatggacctgcaccctggcgctgggaagacgaaaagatatctgccggccatcgtccgcgaggctattaagcggggactcagaaccctgatccttgcccccacacgcgtggtggcggccgaaatggaggaagctctgcggggcctccctattagataccaaacccccgccatccgcgctgagcataccgggcgggagatcgtcgacctgatgtgtcacgccacattcacgatgagactcctgtcccctgtgcgggttcccaactataaccttattatcatggatgaagcccattttaccgacccggctagcattgcggcccgcggctacatctccacaagagtggagatgggagaagctgccggcattttcatgaccgccacacctcccgggtctcgggatccctttcctcagagcaatgctcccatcatggacgaggagcgcgaaatccctgagagatcctggaacagcggacacgaatgggtcaccgatttcaagggcaaaacggtgtggtttgttccgtctattaaggccgggaatgacatcgcggcttgcctgcggaaaaacggaaagaaagtgattcagctgtccagaaagacattcgatagcgagtatgtcaagacccgcaccaatgactgggattttgtggttacaaccgacatctctgaaatgggcgccaacttcaaagccgagcgggtgattgatcccagacgctgtatgaagcctgtcatcctcacagacggggaggaacgggtgatcctggctggccccatgcctgtgacccacagctccgccgcgcaaagacgcggacggattggcagaaatcccaaaaacgagaatgaccagtacatctacatgggggaaccgcttgagaacgatgaagactgcgcccattggaaggaggctaaaatgctgctcgataatattaacacgcctgagggaatcattccctctatgtttgaacctgagcgcgaaaaggtcgacgccatcgatggcgagtatagactgagaggggaagctcgcaaaacattcgttgacctgatgagacggggagatctccccgtgtggcttgcctaccgcgtggctgccgagggcattaattatgcggacagacggtggtgttttgatggggtcaagaacaatcagatcctggaggaaaacgtggaggttgaaatctggaccaaggagggcgagcgcaagaagctgaaacctcgctggctcgacgcccggatttacagcgatcccctggctcttaaggagttcaaagagttcgccgctggaagaaagtccctgacactcaacctgatcaccgaaatgggccgcctgccgacgtttatgacccagaaggcccgggacgccctcgataatcttgctgtgctgcacacagcggaggccgggggacgggcttataaccatgccctgtctgaactccctgagaccctggagacacttctgctcctgaccctgctcgccacagtcaccggcgggattttcctttttctgatgagcggaaaaggcgtgggcaagatgacgctggggatgtgctgcatcattacagcttccatcctcctgtggcacgcccaaatccagccccactggattgcggccagcatcattcttgagttctttctgatcgttctcctgattcccgagcctgaaaaacagcggaccccgcaggacaatcaactgacctacgtggtcatcgctatcctcacagtggtcgccgctaccatggccaacgagatgggattccttgaaaagaccaagaaggacctgggcctggggtctattgcgacgcaggagcccgagtccaatatcctcgatattgacctgcgccctgccagcgcttggaccctttatgccgtggctacaacctttgttacacccatgctgagacattccatcgaaaactctagcgtgaatgtgtccctcaccgccattgctaaccaggccacggtcctgatgggactgggcaaggggtggcctctctctaaaatggatatcggagttccccttctggcgattggctgttacagccaggtgaatcctatcaccctgacagccgctctcctgcttctggtggcccactacgctatcattggcccggggctccaagccaaggccacccgggaggcgcagaaacgcgctgccgctggaatcatgaagaaccccacagtcgacggcattaccgtgatcgatctggaccctattccctatgatcctaaattcgaaaagcagctggggcaggttatgctccttatcctgtgcgtgacgcaagtcctgatgatgagaacaacctgggccctctgtgaggccctgacacttgctaccggacccatctccaccctgtgggaaggcaatccggggcggttttggaacacaacgattgccgtgagcatggcgaatatcttccgcggatcttacctcgccggcgctggcctgctgttttccattatgaagaacaccacaaataccagacgggggacaggaaacatcggcgagaccctcggggagaaatggaaaagccgccttaatgccctgggaaaatctgagttccagatttataagaaatccggcatccaggaggtcgacagaacgctggctaaggaagggatcaaacggggagagacagatcatcacgccgtgagcagaggctctgcgaagctccgctggtttgttgagcggaacatggtgacccctgaaggcaaggtcgtggacctggggtgcggaagaggcgggtggagctactattgtggaggccttaaaaacgttcgcgaggtgaaggggctgaccaaaggaggccccggccatgaagaacccattcctatgtccacatacgggtggaatctcgtccggctgcaatctggagtggatgtgttcttcacaccccctgaaaagtgcgacaccctgctctgtgatatcggcgagagctccccgaaccccacgattgaggccgggagaacccttcgcgttctgagcctggtcgaaaattggctcaacaatgacacacagttttgcatcaaagtgctgaacccttatatgccctccgtgattgagaagatggaaacccttcagcggaagtacggaggcgctctggtcagaaatcctctctctcgcaacagcacacacgagatgtactgggtttccaatgccaccgggaacatcgtgtctagcgtgaatatgatctcccggatgctgattaacagattcacgatgaaacacaagaaagctacctatgaacccgacgtcgatctgggatctggcacacgcaatatcggcattgagagcgagatcccgaacctcgacattatcgggaagcggattgagaagatcaagcaggagcatgaaacctcctggcactacgatcaagaccatccttataagacatgggcctaccacggaagctatgagaccaaacagacaggctctgcttccagcatggtgaatggggttgtgagacttctgaccaagccctgggatgtcgtgcctatggttacgcagatggccatgacagacaccaccccctttggacagcaacgcgtgttcaaagaaaaggtcgatacaagaacgcaggagcctaaagagggcaccaagaagctgatgaaaatcacagcggaatggctctggaaggagctggggaaaaagaaaacaccccggatgtgtacacgcgaagagtttaccagaaaggtgcggtctaacgccgctcttggagccattttcacagacgagaacaaatggaagtccgctagagaagccgtggaggatagccggttttgggaactggtcgacaaggagcgcaatctccacctggaaggcaaatgcgagacctgtgtttacaacatgatgggcaagagagagaaaaagctgggggagttcggaaaagccaagggctctcgggcgatctggtatatgtggctcggggctcgctttctggagttcgaagcccttggatttctgaatgaggatcattggttctccagagaaaacagcctctccggcgtggagggggagggcctgcacaaacttggatacattctgcgggacgtgagcaaaaaggaaggcggggccatgtacgctgacgatacggccggatgggacacccgcatcacactcgaggatctgaaaaatgaagagatggtcaccaaccatatggaaggcgagcacaagaaactggctgaggccatttttaagctcacatatcagaataaggtggttagagtgcagcggccgacccctcgcgggacggtcatggacatcatctctagacgggatcaacgcggaagcggccaggtggggacatacggcctgaacaccttcacaaatatggaagcgcagcttattagacaaatggagggagaaggcatcttcaaatccattcagcatctgaccgttacggaggagatcgccgtgcagaactggctcgctcgggtcgggcgcgaaagactgtctcggatggccattagcggagacgattgcgtggttaagccccttgacgatagatttgcttccgccctgaccgcgctcaatgacatgggcaaagtgcgcaaggatatccagcaatgggagccctctcgggggtggaacgactggacacaggtccctttctgcagccaccactttcatgaactgatcatgaaagatggaagagtgctggtcgtgccgtgtcgcaatcaggacgagctcattggccgggccagaatctcccagggggctggctggtctctgaaggaaaccgcctgccttggaaagagctatgctcaaatgtggtccctgatgtacttccaccgccgggacctcagactggccgctaacgccatttgtagcgcggttccctctcattgggtgcctacatcccgcaccacatggagcatccacgccaaacacgagtggatgaccacggaggatatgcttacagtctggaatcgggtgtggattcaggaaaacccctggatggaggacaagacccctgtggaatcttgggaggaagttccctatctgggcaaaagagaggatcagtggtgcgggtccctcatcggactgaccagccgcgctacatgggccaagaacattcagaccgccatcaatcaagtgcggtccctgatcggcaacgaggaatacacagactatatgccttctatgaaaagatttcggagagaggaagaggaagctggggtcctctggtga

SEQ ID NO: 20193 - RNA, 9876 nt, synthetic construct
  misc_feature 1..9876: note = derived and/or modified CDS sequence (opt5) from DENV-2__FM210213__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaggaacaggacaaacgctttgtgtgcaagcattccatggtggatagaggctggggcaacgggtgtggactgttcggcaaagggggaatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtggccgtcagctttgtgacgctgattaccggaaacatgtccttccgggaccttggcagagttatggtgatggtcggcgccgctatgacagatgacatcgggatgggagtgacctacctggccctcctggcggcttttaaggttcgccccacattcgccgccggcctgcttctgagaaaactcacctctaaggagctgatgatggctacgattgggatcgccctcctgagccagtccacaattcctgaaaccatccttgagctgacagatgcgctcgctctgggaatgatggtgctgaaaatcgtccggaatatggaaaagtatcaacttgccgtgaccattatggccatctcttgcgttcccaacgctgtgattctgcagaatgcctggaaggtcagctgtaccatcctcgctacagtgtccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtcgggatggttagcatcctggcttcttccctcctgaaaaacgacattcccatgacgggacctctcgtggccggcggcctgcttacagtgtgctacgtcctgaccgggcggagcgccgatctggaactcgagcgcgctaccgacgtgaagtgggaggatcaagcggaaatctccggaagctctcccattctgagcatcacaattgccgaggacggctccatgtctatcaaaaatgaagaggaggaacagacccttacaatcctgattagaacggggctcctggttatcagcggactcttcccggtgtccattcctatcaccgctgccgcctggtatctgtgggaggtcaagaagcagcgggctggcgtgctttgggatgttccctctcctccgcccgtggggaaagccgaactggaggacggagcgtaccgcattaagcagaaaggcatcctgggctatagccaaatcggggctggagtctacaaggaaggcacatttcacaccatgtggcacgtgacaagaggggccgtcctcatgcatcggggaaaacgcattgagccttcctgggccgatgtgaagaaggacctgatctcttacggcgggggatggaaacttgagggcgaatggaaggagggcgaagaggttcaggtgctggctctcgaaccggggaaaaaccccagagccgtccagaccaagcctggactgttcaaaacgaataccggcacaattggggcggtgagcctcgatttttcccccggaaccagcggctctcctatcgttgaccggaaggggaaggtggtcggactgtatggcaacggcgtggtgacaagatccggggcttacgttagcgccattgcccagaccgagaaatctatcgaggataatcccgaaatcgaggacgatattttccgcaagaaacggcttacaatcatggacctgcaccctggagctggcaagacgaaaagatatctgccggccattgtccgcgaagctatcaagcgggggctcagaaccctgattcttgcccccacacgcgtggtggcggccgagatggaagaggctctgcggggactccctatcagataccaaacccccgccattcgcgctgagcataccggccgggaaatcgtcgacctgatgtgtcacgccacattcacgatgagactcctgtcccctgtgcgggttcccaactataaccttatcattatggatgaggcccattttaccgacccggctagcatcgcggcccgcgggtacatttccacaagagtggaaatgggcgaggctgccggaatcttcatgaccgccacacctcccggctctcgggatccctttcctcagagcaatgctcccattatggacgaggaacgcgagatccctgaaagatcctggaacagcgggcacgagtgggtcaccgatttcaagggaaaaacggtgtggtttgttccgtctatcaaggccggcaatgacattgcggcttgcctgcggaaaaacgggaagaaagtgatccagctgtccagaaagacattcgatagcgaatatgtcaagacccgcaccaatgactgggattttgtggttacaaccgacatttctgagatgggagccaacttcaaagccgagcgggtgatcgatcccagacgctgtatgaagcctgtcattctcacagacggcgaagaacgggtgatcctggctgggcccatgcctgtgacccacagctccgccgcgcaaagacgcggccggatcggaagaaatcccaaaaacgaaaatgaccagtacatttacatgggcgagccgcttgaaaacgatgaggactgcgcccattggaaggaggctaaaatgctgctcgataatatcaacacgcctgaagggattatcccctctatgtttgagcctgaacgcgagaaggtcgacgccattgatggagaatatagactgcggggcgaggctcgcaaaacattcgttgacctgatgagaagaggggatctccccgtgtggcttgcctaccgcgtggctgccgagggaatcaattatgcggacagacggtggtgttttgatggcgtcaagaacaatcagattctggaagagaacgtggaagttgagatctggaccaaggagggggaacgcaagaagctgaaacctcgctggctcgacgcccggatctacagcgatcccctggctcttaaggagttcaaagagttcgccgctggcagaaagtccctgacactcaacctgattaccgagatgggacgcctgccgacgtttatgacccagaaggcccggaatgccctcgacaaccttgctgtgctgcacacagcggaagccggcgggagagcttataatcatgccctgtctgagctccctgagaccctggaaacacttctgctcctgaccctgctcgccacagtcaccggaggcatcttcctttttctgatgagcgggaaaggagtgggcaagatgacgctgggcatgtgctgcattatcacagcttccattctcctgtggcacgcccaaatccagccccactggatcgcggccagcattatccttgagttctttctgattgttctcctgatccccgaacctgagaaacagcggaccccgcaggataaccaactgacctacgtggtcattgctatcctcacagtggtcgccgctaccatggccaatgaaatggggttccttgagaagaccaagaaggacctgggactgggctctatcgcgacgcaggagcccgaatccaacattctcgacatcgatctgcgccctgccagcgcttggaccctttatgccgtggctacaacctttgttacacccatgctgagacattccattgaaaattctagcgtgaacgtgtccctcaccgccatcgctaatcaggccacggtcctgatggggctgggaaagggctggcctctctctaaaatggacattggggttccccttctggcgatcggatgttacagccaggtgaaccctattaccctgacagccgctctcctgcttctggtggcccactacgctatcatcggcccgggcctccaagccaaggccacccgggaagcgcagaaacgcgctgccgctgggattatgaagaatcccacagtcgatggaatcaccgtgattgacctggatcctatcccctatgaccctaaattcgagaagcagctgggccaggttatgctccttattctgtgcgtgacgcaagtcctgatgatgagaacaacctgggccctctgtgaagccctgacacttgctaccgggcccatctccaccctgtgggagggaaacccgggccggttttggaatacaacgatcgccgtgagcatggcgaacattttccgcgggtcttacctcgccggagctggcctgctgttttccatcatgaagaataccacaaacaccagacggggcacagggaatattggagagaccctcggcgaaaaatggaaaagccgccttaacgccctggggaaatctgagttccagatctataagaaatccggcattcaggaagtcgatagaacgctggctaaggagggcatcaaaagaggggaaacagaccatcacgccgtgagcagaggatctgcgaagctccgctggtttgttgaacggaacatggtgacccctgagggcaaggtcgtggatctgggctgcgggagaggaggctggagctactattgtgggggacttaaaaatgttcgcgaagtgaagggcctgaccaaagggggacccggccatgaggaacccatccctatgtccacatacggctggaacctcgtccggctgcaatctggggtggacgtgttcttcacaccccctgagaagtgcgataccctgctctgtgacattggagagagctccccgaatcccacgatcgaagccggcagaacccttcgcgttctgagcctggtcgagaactggctcaataacgatacacagttttgcattaaagtgctgaatccttatatgccctccgtgatcgaaaagatggagacccttcagcggaagtacgggggagctctggtcagaaaccctctctctcgcaatagcacacacgaaatgtactgggtttccaacgccaccggcaatattgtgtctagcgtgaacatgatctcccggatgctgatcaatagattcacgatgaaacacaagaaagctacctatgagcccgacgtcgacctggggtctggaacacgcaacattggcatcgagagcgaaattccgaatctcgatatcattggcaagcggatcgagaaaattaagcaggaacatgagacctcctggcactacgaccaagatcatccttataagacatgggcctaccacgggagctatgaaaccaaacagacaggatctgcttccagcatggtgaacggcgttgtgagacttctgaccaagccctgggacgtcgtgcctatggttacgcagatggccatgacagataccaccccctttgggcagcaacgcgtgttcaaagagaaggtcgacacaagaacgcaggagcctaaagaaggaaccaagaagctgatgaaaatcacagcggagtggctctggaaggaactgggcaaaaagaaaacaccccggatgtgtacacgcgaggagtttaccagaaaggtgcggtctaacgccgctcttggggccatcttcacagatgaaaataaatggaagtccgctagagaggccgtggaagacagccggttttgggagctggtcgataaggaacgcaacctccacctggagggaaaatgcgagacctgtgtttacaatatgatgggcaagagagagaagaagctgggcgagttcgggaaagccaagggatctcgggcgatttggtatatgtggctcggcgctcgctttctggagttcgaggcccttgggtttctgaacgaagaccattggttctccagagagaatagcctctccggagtggagggcgaagggctgcacaaacttggctacatcctgcgggatgtgagcaaaaaggagggaggcgccatgtacgctgacgacacggccgggtgggatacccgcattacactcgaagacctgaaaaacgaggaaatggtcaccaatcatatggagggagagcacaagaaactggctgaagccatctttaagctcacatatcagaacaaggtggttagagtgcagcggccgacccctcgcggcacggtcatggatattatctctagacgggaccaacgcgggagcggacaggtgggcacatacgggctgaataccttcacaaacatggaggcgcagcttatcagacaaatggaaggcgagggaattttcaaatccatccagcatctgaccgttacggaggaaattgccgtgcagaattggctcgctcgggtcggccgcgagagactgtctcggatggccatcagcggggatgactgcgtggttaagccccttgatgacagatttgcttccgccctgaccgcgctcaacgatatgggaaaagtgcgcaaggacattcagcaatgggaaccctctcggggctggaatgattggacacaggtccctttctgcagccaccactttcatgagctgatcatgaaagacgggagagtgctggtcgtgccgtgtcgcaaccaggatgaactcatcggacgggccagaatttcccagggcgctgggtggtctctgaaggagaccgcctgccttggcaagagctatgctcaaatgtggtccctgatgtacttccaccgccgggacctcagactggccgctaatgccatctgtagcgcggttccctctcattgggtgcctacatcccgcaccacatggagcattcacgccaaacacgagtggatgaccacggaagacatgcttacagtctggaaccgggtgtggatccaggagaacccctggatggaagataagacccctgtggagtcttgggaagaggttccctatctgggaaaaagagaggaccagtggtgcggctccctcattgggctgaccagccgcgctacatgggccaagaatatccagaccgccattaaccaagtgcggtccctgatcggaaatgaagagtacacagattatatgccttctatgaaaagatttcggagagaagaggaagaggctggcgtcctctggtga

SEQ ID NO: 20194 - RNA, 9876 nt, synthetic construct
  misc_feature 1..9876: note = derived and/or modified CDS sequence (opt5) from DENV-2__FM210235__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagagcaggacaaacgctttgtgtgcagacattccatggtggatcggggctggggcaacgggtgtggactgttcggcaaggggggaatcgtcacctgcgccatgtttacatgcaagaaaaatatggaaggcaagattgttcagcctgagaacctcgaatacacgatcgtgattaccccccacagcggggaggagcatgctgtgggaaatgacacaggcaaacacggcaaggaaatcaaaatcacccctcagtctcccattacagaggccgaactgaccgggtatggaacggtcaccatggagtgttccccgcgcacaggccttgatttcaacgaaatggtgctgctccaaatggaggacaaggcttggctggttcacagacagtggtttcttgatctgcctctcccctggctgcctggggccgacacccagggaagcaattggatccagaaagagacactggtgaccttcaagaacccccatgccaagaaacaagacgtcgtggttctcggctctcaggaaggggctatgcacacggcgctgacaggcgccaccgagattcagatgtccagcggaaatcttctgtttacaggccatctcaagtgccggctgagaatggataaacttcaactgaaggggatgtcctactctatgtgtaccggaaaattcaagatcgtgaaggaaattgctgagacccagcacggcacaatcgtcatccgcgtgcagtatgagggggacggaagcccctgcaaaattcctttcgaaatcatggatctcgagaagcggcatgtcctgggcagactgattacggtgaacccgatcgttaccgaaaaagactcccccgtgaacattgaggccgaacctccctttggggatagctacatcattatcggcgtcgagcctggacagctcaagctgaattggttcaaaaagggctcttccatcgggcaaatgtttgagacaaccatgcgcggagccaagcggatggctattcttggcgacacagcctgggatttcgggagcctgggaggcgtgtttacctctatcgggaaagcgctccaccaggttttcggcgctatttacggagccgcctttagcggcgtgtcctggacgatgaagatcctgattggggtcatcatcacatggattggaatgaactctagaagcacctccctgagcgtgtctcttgtgctcgttggcgtcatcaccctgtatctgggggctatggtgcaggccgactccggatgtgtggtcagctggaaaaataaggaactcaaatgcggctctgggattttcatcacagataacgtgcacacctggacagagcagtacaagtttcaacccgaatccccgagcaagctggcttccgccattcagaaagcgcatgaggaaggcatctgtggaatccgctctgttacgcggcttgagaatctgatgtggaagcagattacccctgagctcaaccacatcctgagcgaaaatgaggtgaaactgacaattatgaccggcgacatcaaggggattatgcaggccggaaaaagatcccttcgcccccaacctacagaactcaagtattcttggaaaacctggggcaaggctaagatgctgagcacggagtcccataaccagaccttcctgatcgatgggcccgaaacagccgagtgccctaataccaaccgggcttggaatagcctcgaggtcgaagactacggatttggcgtgttcacaaccaacatctggctgaaacttagagagaagcaggacgttttttgtgattctaaactgatgtccgccgcgattaaggacaatcgcgccgtgcacgctgatatgggctattggatcgaaagcgccctcaacgacacatggaaaatggagaaggcttctttcattgaggtcaagtcctgccactggcccaaaagccataccctgtggtctaatggggtgctggaaagcgagatgatcattccgaagtccttcgccggacctgttagccagcacaactaccggcccggctattacacgcaaacagccgggccctggcatcttggaaaactcgaaatggattttgacttctgtgagggcaccaccgtggtcgtgacagaagattgcgggaacagaggaccttctctgcggaccacgacagcttccggcaagctgatcaccgagtggtgctgtcgcagctgcacactcccgcccctgagataccggggcgaggacgggtgttggtatggaatggaaattagacctcttaaagagaaggaagagaatctggtgaactccctcgtcaccgcgggccacgggcagatcgataatttttctctgggagttctgggcatggcccttttcctcgaagagatgctgcgcacacgggtggggaccaagcatgctatcctgctcgtgacggtcagctttgtgaccctgattacaggaaacatgtccttcagagaccttggccgcgttatggtgatggtcggcgccgccatgaccgatgacatcgggatgggagtgacatacctggctctcctggccgcgtttaaagttagacccaccttcgctgccggcctgcttctgcggaagctcacgtctaaagagctgatgatggccacaattgggatcgctctcctgagccagtccaccattcctgaaacaatccttgagctgaccgatgccctcgcgctgggaatgatggtgctgaagatcgtccgcaatatggaaaaatatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaggccgactggattccccttgagtggagcatcaaaggcctgaacccgaccgcgatctttctcacaaccctgtctagaacatccaagaaacggagctggcctctgaatgaagccattatggctgtcgggatggtttctatccttgcctccagcctgctcaagaacgacattcccatgaccggacctctggtggctggcggcctcctgacggtgtgctacgtccttacagggcgctccgccgatctggagctggagagagccaccgacgtgaaatgggaagatcaagctgagatcagcggatctagccccattctctccatcaccattgcggaagacggctctatgagcatcaagaatgaggaggaagagcagacactgaccatccttattcggacagggctgctcgttatctccggactgttcccggtgtctattcctatcacggccgctgcctggtatctctgggaagtcaaaaagcagcgcgccggcgtgctgtgggatgttcccagccctccccccgtggggaaggctgagcttgaagacggagcctacagaattaaacagaagggcatcctgggctattcccaaatcggggcgggagtctacaaagagggcacctttcacacaatgtggcacgtgacccggggggctgtcctgatgcatcgcggaaagagaattgagccttcttgggccgatgtgaaaaaggacctcatcagctacggcgggggatggaagctggaaggcgagtggaaagaaggcgaggaagttcaggtgcttgccctggagccggggaagaacccccgggctgtccagacaaaacctggactcttcaagaccaatacgggcaccattggggccgtgtccctggattttagccccggaacatctggctcccctatcgttgacagaaaagggaaggtggtcggactctatggcaacggcgtggtgacccgcagcggggcgtacgtttctgctattgcccagacagagaagtccatcgaagataatcccgagatcgaagacgatattttccggaaaaagagactgaccatcatggaccttcaccctggagccggcaaaacaaagcgctatctgccggctattgtccgggaggccatcaaaagagggctgcgcacgctcattctggctcccacccgggtggtggccgcggaaatggaggaggcccttagaggactgcctatccgctaccaaacacccgctattcgggccgaacataccggcagagagatcgtcgacctcatgtgtcacgctaccttcacaatgcggctgctcagccctgtgcgcgttcccaactataacctgatcattatggatgaagcccattttacggacccggcctccatcgctgcgagagggtacatttctacccgggtggagatgggcgaggccgctggaatcttcatgacagccacccctcccggcagccgcgatccctttcctcagtccaatgcccccattatggacgaagagagagaaatccctgagcggagctggaactctgggcacgaatgggtcacagatttcaagggaaagaccgtgtggtttgttccgtccatcaaagctggcaatgacattgccgcgtgccttagaaagaacgggaaaaaggtgatccagctgagccgcaaaacgttcgattctgagtatgtcaagacacggaccaatgactgggattttgtggttaccacagacattagcgagatgggagctaacttcaaggccgaaagagtgatcgatccccgccggtgtatgaaacctgtcattctgaccgacggcgaggaaagagtgatcctcgccgggcccatgcctgtgacacactcctctgctgcccaacgccggggcagaatcggacgcaatcccaagaacgagaatgaccagtacatttacatgggcgaaccgctggagaacgatgaggactgcgcgcattggaaagaagccaagatgcttctggataatatcaacacccctgaggggattatccccagcatgtttgaacctgagagagaaaaagtcgacgctattgatggagagtatcggctccgcggcgaggccagaaagacgttcgttgacctgatgcggcgcggggatctgcccgtgtggctcgcttacagagtggccgctgaaggaatcaattatgccgaccggagatggtgttttgatggcgtcaaaaacaatcagattcttgaggaaaacgtggaggttgagatctggacaaaggaaggggagcgcaagaaactgaagcctcggtggctggacgcgagaatctactccgatcccctcgccctgaaagaattcaaggagttcgctgccggccgcaaatctcttaccctgaacctcattacagaaatgggacggctgccgacctttatgacgcagaaggctagagacgccctggataatctcgccgtgcttcacaccgctgaggcgggcgggcgggcctataaccatgctctgagcgagctgcctgaaacactcgagaccctgcttctgctcacactgctggccaccgtcacaggaggcatcttcctctttcttatgtccgggaagggagtgggcaaaatgaccctgggcatgtgctgcattatcacggccagcattctgctctggtacgctcaaatccagccccactggatcgccgcgtctattatcctggaattctttcttattgttctgctcatccccgagcctgaaaagcagcgcacaccgcaggacaatcaactgacctatgtggtcattgccatcctgaccgtggtcgctgccacaatggctaacgagatggggttcctcgagaaaaccaagaaagaccttggactgggctccatcgccacaagagaacccgagagcaatattctggatatcgacctccggcctgcgtccgcctggacgctgtacgctgtggccaccacatttgttacccccatgcttcgccactctattgaaaacagctccgtgaatgtgtctctgacagctatcgccaaccaggctaccgtcctcatggggctgggaaagggctggcctctgagcaagatggatattggggttcccctccttgccatcggatgttactcccaggtgaatcctattacgctgaccgcggccctgctcctgcttgtggctcattatgccatcatcggcccgggcctgcaggctaaagccacaagagaggcccaaaagcgggcggctgccgggattatgaaaaaccccaccgtcgacggagtgacagttatcgatctcgaccctattccctacgatcctaagttcgaaaaacagctgggccaggtgatgctgctcatcctttgcgtcacccaggtgctgatgatgcgcacgacatgggctctgtgtgaggccctcaccctggccacagggcccattagcaccctttgggagggaaatccgggcagattttggaacaccacaatcgctgtctctatggccaatatcttccgggggtcctatctggcgggagccggcctcctgtttagcattatgaagaacacgaccaatacacgcagaggcaccgggaacatcggagaaacactgggcgagaagtggaaatctcggctcaatgctcttgggaagtccgaattccaaatttacaaaaagagcggaatccaggaggtggacagaaccctggccaaagagggcattaagcgcggggaaacggatcaccatgctgtttctcggggaagcgccaaactgagatggtttgtggagcgcaacatggtcacacctgaaggcaaggtggttgacctcggctgcgggcggggaggctggtcctattactgtgggggactgaagaacgtgagagaggtcaaaggccttaccaaggggggacccggccacgaagagcccatccctatgtctacctatggctggaatctggtgcgcctccagagcggggtggatgttttcttcacaccccctgagaaatgcgacaccctgctgtgtgatatcggagaatccagcccgaaccccacaattgaggcgggccggacgctcagagtcctttccctggtggaaaattggctgaacaatgacacccaattttgcatcaaggtgctcaacccttacatgccctctgtcattgagaaaatggaaacactgcagcgcaagtacgggggagcccttgttcggaatcctctgagcagaaactccacccatgagatgtattgggtgtctaatgctacaggcaacatcgtgagctccgtcaatatgatttctcgcatgctcatcaaccggttcaccatgaagcacaaaaaggccacgtacgagcccgacgtggatctggggagcggaaccagaaatatcggcattgaatccgagatcccgaacctggacattatcggcaaacgcattgaaaagatcaaacaggagcacgaaacaagctggcattatgatcaggaccacccttacaagacctgggcttatcatgggtcttacgagacaaagcaaaccggatccgccagctctatggttaatggcgtggtcagactccttacaaaaccctgggatgtggttcctatggtgacccagatggctatgacggacacaaccccctttgggcagcagcgggtcttcaaggagaaagtggatacccgcacacaagaacctaaggagggaacgaaaaagctgatgaagattaccgccgaatggctgtggaaagagctcggcaagaaaaagacacccagaatgtgtacccgggaggaatttacaagaaaagtgcggtccaacgcggccctgggggctatcttcaccgacgagaacaagtggaaaagcgcccgcgaagctgtcgaggattctagattttgggaacttgttgacaaggagcggaatctgcacctcgagggaaagtgcgaaacatgtgtgtataacatgatgggcaaacgcgagaagaaactgggcgaattcgggaaggccaaaggatccagagccatctggtacatgtggctgggcgcgcggtttctcgagttcgaagctctggggtttcttaatgaggatcactggttcagccgcgagaactccctgagcggagtggaaggcgaggggctccataagctgggctacattcttagagacgtctctaagaaagaaggaggcgccatgtatgccgacgataccgctgggtgggacacgcggatcaccctggaggatctcaagaatgaagagatggtgacaaaccacatggagggagaacataaaaagctggccgaggctatttttaaactgacctaccagaataaggttgtgcgcgtccagagaccgacacctcggggcaccgtgatggacatcattagccgcagagatcagcgggggtccggacaagttggcacgtatgggctcaacacattcaccaatatggaagcccagctgatccgccagatggagggcgagggagtgttcaagtctatccaaagacttacagtcaccgaagagattgcggtgcagaactggctggcccgggttggcagagaacgcctcagccggatggctatctccggggacgattgcgtggtcaaacccctggacgatagatttgcctctgctcttacggccctgaatgacatgggaaaggtgcgcaaagatattcagcagtgggagcccagccggggctggaacgactggacccaagtccctttctgctcccaccattttcacgaactcatcatgaaggatgggagagtgctggttgtgccgtgtcgcaatcaggacgagctgattggacgggcgagaatctctcagggcgccgggtggagcctcaaagagacagcttgcctgggcaagtcctacgcccagatgtggagccttatgtatttccaccgccgggacctgagactcgctgccaacgctatctgttctgccgtcccctcccattgggtgcctaccagccgcacaacctggtctattcacgcgaagcatgaatggatgacaaccgaggatatgctgacggtgtggaatcgggtttggatccaagaaaacccctggatggaggacaaaacacctgtggaatcctgggaggaggtcccctaccttggaaagagagaagatcagtggtgcggcagcctgattgggctcacctcccgggccacctgggctaaaaacatccagacagccattaatcaggtgagatctctgatcggaaacgaggaatataccgactacatgcctagcatgaagcgctttcggagagaggaagaggaggccggcgttctgtggtga

SEQ ID NO: 20195 - RNA, 9876 nt, synthetic construct
  misc_feature 1..9876: note = derived and/or modified CDS sequence (opt5) from DENV-2__FM210205__SS-prME
  source 1..9876: mol_type = other RNA
agcgccggcatgatcattatgctgatccccaccgtgatggctttccacctgacaacgagaaatggggaacctcatatgattgtcggaatccaggaaaagggcaagtccctgctttttaagaccgaagacggggttaatatgtgcacactgatggccatggatctcggagaactgtgtgaagacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctcaagaaactgacctccaaggagctcatgatgacaaccattggcatcgtgctgctttctcaaagcacgattcccgaaacagtcctggagctcaccgatgccctggccctggggatgatggtgcttaaaatcgtgcggaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctagaacaaataagaagcgctcctggccgctcaacgaggccatcatggctgtgggcatggtcagcattctggcctcttccctcctgaaaaatgacatccctatgaccgggccccttgtggcgggaggcctgctgacggtttgctatgtgctcacaggcagaagcgccgatctggaacttgagcgggctaccgacgtcaagtgggaggatcaggccgaaatttctgggtccagccctatcctgtccattaccatcagcgaggacggatctatgagcattaaaaacgaagaggaggaacagacactcaccatcctgatccgcacaggcctcctggtgatttccgggctttttcccatctctattccgatcacggctgccgcctggtacctgtgggaggtcaagaaacagagagctggagtgctgtgggatgttccttctccccctcccatgggcaaggcggaactcgaggacggggcctatcggattaagcaaaaaggaatcctgggctactcccagatcggcgctggggtgtacaaggaaggaaccttccacacaatgtggcatgtcacccgcggcgccgtgcttatgcacaaagggaagagaattgagccctcctgggccgatgttaaaaaggacctgatcagctatggaggcgggtggaagctcgagggagaatggaaagagggcgaagaggtgcaggtcctggctctcgaacctggcaagaatccgcgggccgtgcagacaaaacccgggctgtttaagaccaacacgggaaccattggcgcggtgtcccttgatttctctcctgggacaagcggatcccccatcattgacaaaaagggcaaggttgtcgggctgtacggaaacggcgtggtgacccgcagcggcgcttatgtctctgccatcgcccaaacagagaaatccatcgaggataatcctgaaattgaggacgatatctttagaaagcggcgcctgaccattatggacctccaccccggggctggaaaaacaaagagatacctgcctgccatcgtgcgggaagcgattaaaagaggccttcgcacgctgatcctcgctccgacccgggttgtggccgccgagatggaagaggctctgagagggctccccattcgctatcagacccctgccatccgggctgagcataccggaagagaaatcgtcgacctgatgtgtcacgccaccttcacaatgcgccttctgagccccgtgcgggttcctaactacaatctgattatcatggatgaggcgcatttcacggaccccgcctctattgctgccagaggctatatctccacccgcgtggaaatgggggaggctgccggcatttttatgacagccaccccgcctggaagccgggatcccttcccccagtccaacgctcctatcatcgacgaggaaagagagattcccgaacggtcttggaatagcggccacgagtgggtcacagattttaaggggaagaccgtgtggttcgttccttccatcaaagcgggaaacgacattgccgcttgcctccgcaagaatggcaaaaaggtgatccaactgagcagaaaaacgtttgattctgaatacgtcaagacacggaccaacgactgggatttcgtggtgaccacagacatttccgagatgggggccaattttaaagccgagcgcgtcatcgatccgagacggtgtatgaagcccgttatccttaccgacggagaagagagagtgattctggctggccctatgcccgtgacacatagctctgccgcgcagcgccgggggagaatcggccgcaaccctaagaatgaaaacgaccagtacatttatatgggagagcccctcgaaaatgatgaggactgcgctcactggaaagaggccaagatgctgctggataacatcaataccccggaaggcattatccctagcatgttcgagcccgaacgggagaaagtcgacgccattgatggggaatacagactccgcggagaggctcggaagacgtttgtggaccttatgagacgcggcgatctgcctgtttggctggcctataaagtggcggccgaggggatcaactacgctgacagacggtggtgtttcgatggaatcaagaacaatcagattctcgaagagaacgtcgaagtggagatctggacaaaggagggcgaacgcaaaaagctgaaacccagatggcttgacgcccggatttattccgatcctctggctctcaaggagtttaaagagttcgccgctgggcgcaagtctctgaccctgaatctcatcacagagatgggcagacttcccaccttcatgacgcaaaagacccgggacgccctggataacctggcggttctccacacagccgaagctggaggcagagcctacaatcatgctctgagcgagcttccggagaccctggaaacactcctgctgctcacccttctggccacagtgaccgggggaatttttctgttcctcatgtccggccgcgggatcggaaaaatgacgctgggcatgtgctgcatcattacagcctctatccttctgtggtatgctcagattcagcctcactggatcgcggccagcattatcctcgagtttttcctgatcgtcctgctcattcccgaacccgagaagcagcggacccctcaagacaaccagcttacctacgtggtcatcgctattctgacagtggttgccgccaccatggctaatgaaatgggctttctggagaaaacaaagaaagacttcgggctcggatccatcgccacgcagcagccggagagcaacattctggatatcgaccttagacccgcgtctgcctggaccctgtacgctgtggccacaacctttgtgacacctatgctccgccattccattgaaaatagctccgtcaacgtttctctgaccgctatcgccaatcaagcgacggtgctgatgggcctcgggaagggatggccccttagcaagatggatatcggcgtgcctctgctggccattgggtgttattcccaggtcaaccccatcaccctcacagctgccctgcttctgctcgtggctcactacgccattatcggacctggcctgcaggctaaagccacccgggaggcgcagaagagagccgctgccggcattatgaaaaatccgacagttgacgggatcaccgtgatcgatctggaccccattccttatgatcccaagttcgaaaaacaactcggacaggtcatgcttctgatcctgtgcgtgacgcaggtcctcatgatgcggacaacctgggctctgtgtgaggcccttacactggccaccggccctatttctaccctctgggaagggaaccccggacgcttttggaatacaacgatcgcggtgagcatggctaacattttcagaggctcctacctggccggggctggactgctctttagcatcatgaagaataccacaaacacccggcgcggcacaggcaacatcggggagacccttggagagaaatggaagtctagactgaatgccctgggcaagtccgagttccaaatttataaaaagagcgggatccaggaggttgaccggacgctcgccaaagaaggaattaagcgcggcgagacagatcaccatgctgtgtctagagggtccgccaaactgcggtggtttgtcgagcgcaacatggtgaccccggaaggaaaggttgtggaccttggctgcggcagagggggatggagctactattgtggcgggctgaagaatgtccgggaggtgaaaggactcaccaagggcgggcctggacacgaagaacccatccccatgtctacatacggctggaacctggtgagactgcagagcggcgttgatgtcttcttcattcctcccgaaaaatgcgacaccctcctttgtgatatcggggagtcctctcctaatccgacagtggaggcgggacgcacgctgcgggtgctgaacctcgtcgaaaattggctgaacaataacacccagttttgcatcaaggttcttaatccctacatgcctagcgtgattgagaaaatggaagccctgcaaagaaagtatggcggggctctcgtgcgcaaccccctgtcccggaatagcacacatgagatgtactgggtctccaacgcctctggaaatatcgtgagctccgttaacatgatttctagaatgctgatcaaccgcttcaccatgcggcacaagaaagctacatatgaacctgacgtggacctcggcagcgggaccagaaatattggaatcgagtccgagattcccaaccttgatatcatcggcaagcgcattgagaagatcaagcaggagcatgaaacgtcttggcactacgaccaggatcacccgtataaaacctgggcctaccatggcagctatgagacaaagcagaccgggtccgcgagctctatggtcaatggagtggttcggctgctgacaaagccttgggacgtgctccccaccgtcacacaaatggccatgaccgatacgacaccttttggccagcagagagtgttcaaagaaaaggtggacacccgcacccaggagcccaaagaggggacaaagaaactgatgaagattacggctgaatggctttggaaagagctgggaaagaagaaaacccctcggatgtgtacaagagaagagtttacccgcaaggtcagatccaacgccgctctcggcgccatcttcacagatgagaataaatggaaaagcgctcgggaagccgttgaggactctcgcttttgggaactggtggataaagagagaaacctgcacctcgaagggaagtgcgagacctgtgtgtacaatatgatgggaaagcgggagaaaaagctgggcgagttcggcaaagcgaaggggtccagagccatttggtacatgtggcttggagctcggtttctggagttcgaagccctcggctttctgaacgaggaccattggttcagccgcgaaaattctctttccggggtcgagggagagggcctgcacaaactcgggtatatcctgagagatgtgagcaagaaggaaggcggagctatgtacgccgacgacacagccggctgggatacccggatcacgctggaggacctcaaaaacgaagagatggttaccaatcacatggaaggggagcataagaaactggcggaggctatttttaaacttacatatcaaaacaaagtggtccgcgtgcagagacccaccccgcggggaacagttatggatatcatttcccgcagagaccagcggggcagcgggcaagtgggaacctacggcctgaatacgttcacaaacatggaagcccagctcatccgccagatggagggggaaggcgtcttcaagaatattcagcacctgaccgtgacagaggaggttgccgtgcaaaactggcttgctagagtcggacgggaacgcctgtctagaatggccatcagcggcgatgactgcgtggtcaagcctctcgatgaccggtttgctaacgccctgaccgcgctgaatgatatggggaaaatccgcaaggacattcagcagtgggagccctccaaaggatggaacgattggacgcaggtccccttctgctctcatcactttcatgaactcatcatgaaggacggcagagttctggtggtcccttgtcggaatcaagatgagcttattgggagagcccgcatcagccagggagctggctggtccctgcgggaaaccgcctgcctcgggaaatcttatgctcagatgtggagcctgatgtacttccacagacgcgaccttcggctggccgcgaacgccatttgttccgctgtgccgtctcactgggtgcccacaagcagaaccacatggtccatccatgccaagcacgagtggatgaccacagaggacatgctcaccgtttggaatcgcgtgtggattcgggaaaacccttggatggaggataagacgcccgtcgaaagctgggaggaaatcccttatctgggcaaaagagaggaccagtggtgcggatctctgatcggcctcacatcccgcgctacctgggccaagaatattcaagctgccatcaaccaggtgcggagcctgattgggaatgaggaatacaccgattacatgccctctatgaaaagatttcgccgggaggaagaggaagcgggagttctttggtga

SEQ ID NO: 20196 - RNA, 9876 nt, synthetic construct
  misc_feature 1..9876: note = derived and/or modified CDS sequence (opt5) from DENV-2__FM210206__SS-prME
  source 1..9876: mol_type = other RNA
agcgccggaatgatcattatgctgatccccaccgtcatggctttccacctcaccacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccctcatggccgctatcctggcctacacaattggaaccacccactttcagcgcgttcttatcttcattctgctcacagctgtggccccttccatgacgatgagatgcatcggcatttctaaccgggattttgtcgaaggggtgagcggaggctcctgggttgacatcgtgctggagcacgggagctgtgtcaccacaatggcgaagaataagcccacccttgatttcgaactgatcaaaacagaggccaagcagcctgctaccctccgcaaatattgcattgaagccaagctgacgaacacaaccaccgagtctagatgtccgacacaaggagagccctccctgaaagaagaacaagacaagcggtttgtgtgcaagcatagcatggtggatcgcggctggggcaatgggtgtggactcttcggcaaagggggaatcgtgacctgcgctatgtttacatgcaagaaaaacatggaaggcaagattgttcagcctgagaatctggaatacacgatcgtggtgacaccccactctggggaggagcatgccgtcggaaacgacacaggcaaacacggcaaggaaattaaagtgacccctcagtccagcatcacagaggcggaacttaccgggtatggaacggttaccatggagtgttctcccagaacaggcctggatttcaatgaaatggtgctcctgcaaatggagaacaaggcctggcttgtccaccggcagtggtttctggacctcccgctgccttggctgcccggggctgataagcaggagtccaattggatccagaaagaaaccctcgtgacattcaagaaccctcatgccaaaaagcaagacgttgtggtcctgggaagccaggagggcgctatgcacaccgcccttacgggggccacagaaattcagatgtcctctggcaatctgctctttaccggacatctgaaatgccgccttagaatggacaagctgcaactcaagggcatgagctactccatgtgtacagggaaattcaaggtggtcaaagagatcgctgagacccagcacggaaccattgtgatccgggttcagtatgaaggcgatgggagcccctgcaagattcccttcgagatcatggacctggagaagcggtacgtgctgggacgcctcatcacagtcaaccctattgtgacggagaaggattctccggttaacatcgaagcggagcccccttttggcgactcctacattatcattggggtggagcccggccagctgaaacttaattggttcaaaaagggaagctctatcggccaaatgtttgaaaccacaatgagaggggccaaaagaatggctattctgggagataccgcctgggacttcggcagcctcgggggagtctttacatccatcggcaaggccctgcatcaggtgttcggggctatctatggcgccgcgttttctggagtgagctggaccatgaaaattctgatcggcgttattatcacgtggattgggatgaactcccgcagcacatctctttccgtcagcctcgtgctggtgggaatcgtcaccctgtacctcggcgtgatggttcaggctgattctgggtgtgtggtctcctggaagaataaggagctgaaatgcggaagcggcatcttcattaccgacaacgtgcacacatggaccgaacagtataagtttcaacctgagtccccctctaaacttgccagcgccatccagaaggctcaggaagaggggatttgtggcatccggtccgttacaagactggagaatctcatgtggaaacagattacgccggaactgaaccacatcctggccgagaatgaagtgaaacttaccatcatgacaggagatattaaaggcatcatgcaagctgggaagcgctctctccggcctcagcccaccgagctgaagtacagctggaaaacatggggaaaggccaaaatgctgtccattgaaagctataaccagaccttcctcatcgacggccctgagacggcggagtgccccaataccaacagagcctggaactctctggaagtcgaggattacgggtttggagtgttcacaaccaacatttggcttaagctgaaagaaaagcaggacgctttttgtgactccaagctcatgagcgccgctatcaaagataatcgcgccgttcatgcggacatgggctattggatcgagtctgccctgaacgatacatggaagattgagaaggctagcttcatcgaagtgaagaattgccactggcctaaaagccataccctgtggtctaacggcgtccttgagagcgaaatgattatccccaagaacctcgccgggccggtgtcccaacacaattaccggcctggataccacacacagattgctggcccctggcatctggggaagctggagatggacttcgatttttgtgacggaaccacggtgatcgtcacagaagattgcggcaacagagggcccagcctccgcaccaccacagcctctggaaaactgattaccgagtggtgctgtcggtcctgcacgcttcctccgctgagatatcggggcgaggacggctgttggtacgggatggaaatccgccccctcaaggagaaagaagagaatctggttaacagcctggtgacagccggacacggccaggtggataatttctcccttggggtcctcggaatggctctgtttctggaagagatgctcagaacccgggtgggcacaaagcatgcgatcctgcttgttgccgtgtctttcgtcaccctgattacagggaacatgagctttaaagacctcggaagagtggttgtgatggtcggcgctaccatggccgatgacatcggcatgggggtgacgtatctggccctgcttgctgccttcaaggttcgccctacctttgcggctggactgctcctgcggaagctcacatccaaagagctgatgatgaccacaattggcatcgtgcttctgtctcaaagcaccattcccgaaacggtcctcgagctgacagatgccctggcccttgggatgatggtgctgaagatcgtgagaaatatggaaaaataccagctcgctgtcaccatcatggccattctgtgcgttcctaacgcggtgatcctccagaatgcttggaaggtgtcctgtacaattctggccgtcgtgtctgttagcccccttctgctcacctccagccagcagaaaaccgactggatccctctggccctgacaattaagggacttaaccccacggctatcttcctgaccacactctctcgcaccaataaaaagagatcctggccgctgaacgaggccatcatggctgtgggcatggtcagcattctcgcctcttccctgcttaagaatgacatccctatgacagggcccctggtggcgggaggcctgctcaccgtttgctatgtgctgacgggccggagcgccgatcttgaactggagcgcgctacagacgtcaaatgggaggatcaggccgaaatttctgggtccagccctatcctctccattaccatcagcgaggacggatctatgagcattaagaacgaagaggaggaacagaccctgacaatcctcatcagaaccggcctgcttgtgatttccgggctgtttcccatctctattccgatcacagctgccgcctggtacctgtgggaggtcaaaaagcagcgggctggagtgctctgggatgttccttctccccctcccatgggcaaagcggaactggaggacggggcctatcgcattaagcaaaagggaatccttggctactcccagatcggcgctggggtgtacaaagaaggaacgttccacaccatgtggcatgtcacaagaggcgccgtgctgatgcacaaggggaaacggattgagccctcctgggccgatgttaagaaagacctcatcagctatggaggcgggtggaagctggagggagaatggaaggagggcgaagaggtgcaggtcctcgctctggaacctggcaaaaatccgcgcgccgtgcagaccaagcccgggctttttaaaacaaacaccggaacgattggcgcggtgtccctggatttctctcctgggaccagcggatcccccatcattgacaagaaaggcaaggttgtcgggctgtacggaaacggcgtggtgacaagaagcggcgcttatgtctctgccatcgcccaaaccgagaagtccatcgaggataatcctgaaattgaggacgatatctttcggaaacgcagactcacaattatggacctgcaccccggggctggaaagaccaaacggtaccttcctgccatcgtgagagaagcgattaagcgcggcctgcggacactcatcctggctccgacgagagttgtggccgccgagatggaagaggctctccgcgggctgcccattcggtatcagacccctgccatcagagctgagcatacaggacgcgaaatcgtcgaccttatgtgtcacgccaccttcaccatgcggctgctgagccccgtgagagttcctaactacaatctcattatcatggatgaggcgcatttcacagaccccgcctctattgctgcccgcggctatatctccacgcgggtggaaatgggggaggctgccggcatttttatgaccgccacaccgcctggaagcagagatcccttcccccagtccaacgctcctatcatcgacgaggaacgggagattcccgaacgctcttggaatagcggccacgagtgggtcaccgattttaaagggaagacagtgtggttcgttccttccatcaaggcgggaaacgacattgccgcttgcctgcgcaaaaatggcaagaaagtgatccaacttagccggaagacctttgattctgaatacgtcaaaacgcgcacaaacgactgggatttcgtggtgaccaccgacatttccgagatgggggccaattttaaggccgagagagtcatcgatccgcggagatgtatgaaacccgttatcctgacagacggagaagaaagagtgattctcgctggccctatgcccgtgacccatagctctgccgcgcagcggagagggcgcatcggccggaaccctaagaatgaaaacgaccagtacatttatatgggagagcccctggaaaatgatgaggactgcgctcactggaaggaggccaaaatgctgctcgataacatcaatacaccggaaggcattatccctagcatgttcgagcccgaaagagagaaggtcgacgccattgatggggaataccgccttcggggagaggctagaaaaacctttgtggacctgatgcgcagaggcgatctgcctgtttggctcgcctataaggtggcggccgaggggatcaactacgctgaccggcgctggtgtttcgatggaatcaaaaacaatcagattctggaagagaacgtcgaagtggagatctggacgaaggagggcgaaagaaagaaacttaagccccggtggctggacgcccgcatttattccgatcctctcgctctgaaagagtttaaggagttcgccgctgggagaaaatctctgacactcaatcttatcaccgagatgggccggctgcccacattcatgacccaaaagacgagagacgccctggataacctcgcggttctgcacaccgccgaagctggaggccgcgcctacaatcatgctcttagcgagctgccggagacactcgaaaccctgctgctccttacactgctggccaccgtgacagggggaatttttctcttcctgatgtccggccgggggatcggaaagatgacccttggcatgtgctgcatcattacggcctctatcctgctctggtatgctcagattcagcctcactggatcgcggccagcattatcctggagtttttcctgatcgtcctccttattcccgaacccgagaaacagagaacacctcaagacaaccagctgacctacgtggtcatcgctattctgaccgtggttgccgccacaatggctaatgaaatgggctttctcgagaagaccaaaaaggacctggggcttggatccatcgccacacagcagccggagagcaacattctggatatcgacctccgccccgcgtctgcctggacgctgtacgctgtggccaccacattcgtgacccctatgctgcggcattccattgaaaatagctccgtcaacgtttctctcacagctatcgccaatcaagcgaccgtgcttatgggcctggggaaaggatggcccctgagcaagatggatatcggcgtgcctctcctggccattgggtgttattcccaggtcaaccccatcacgcttaccgctgccctgctcctgctggtggctcactacgccattatcggacctggcctccaggctaaggccacaagagaggcgcagaaacgggccgctgccggcattatgaagaatccgaccgttgacgggatcacagtgatcgatcttgaccccattccttatgatcccaaatttgaaaagcaactgggacaggtcatgctgctcatcctgtgcgtgacccaggtccttatgatgcgcacgacatgggctctgtgtgaggccctcaccctggccacaggccctatttctaccctgtgggaagggaaccccggaagattctggaataccacaatcgcggtgagcatggctaacatttttcggggctcctacctcgccggggctggacttctgttcagcatcatgaaaaatacgaccaacacacgcagaggcaccggcaacatgggggagacactgggagagaagtggaaatctcggctcaatgccctgggcaagtccgaatttcaaatctataagaaaagcgggattcaggaggttgaccgcacccttgccaaggaaggaatcaaaagaggcgagacggatcaccatgctgtgtctcgggggtccgccaagctgcgctggttcgtcgagagaaacatggtgacaccggaaggaaaagttgtggacctcggctgcggcagagggggatggagctactattgtggcgggctgaagaatgtccgggaggtgaagggactgaccaaaggcgggcctggacacgaggaacccattcccatgtctacctacggctggaacctcgtgcgccttcagagcggcgttgatgtctttttcatccctcccgaaaagtgcgacacactgctgtgtgatattggggagtcctctcctaatccgaccgtggaggcgggacggacactcagagtgctgaaccttgtcgaaaattggctgaacaataacacgcagttctgcatcaaagttctcaatccctacatgcctagcgtgatcgagaagatggaagccctgcaacgcaaatatggcggggctctggtgcggaaccccctctccagaaatagcacccatgagatgtactgggtctccaacgcctctggaaatattgtgagctccgttaacatgatctctcgcatgcttattaaccggtttacaatgagacacaagaaggctacctatgaacctgacgtggacctgggcagcgggacacgcaatatcggaattgagtccgagatccccaacctggatattatcggcaaacggatcgaaaagattaaacaggagcatgaaacctcttggcactacgaccaggatcacccgtataagacgtgggcctaccatggcagctatgagaccaaacagacagggtccgcgagctctatggtcaatggagtggttagactcctgaccaagccttgggacgtgcttcccacagtcacccaaatggccatgacagataccacgcctttcggccagcagcgcgtgtttaaggaaaaagtggacacacggacccaggagcccaaggaggggaccaaaaagctgatgaaaatcacagctgaatggctctggaaggagctgggcaaaaagaagacgcctagaatgtgtacccgcgaagagttcacaagaaaagtccggtccaacgccgctctgggcgccatttttaccgatgagaataagtggaaaagcgctcgcgaagccgttgaggactctagattctgggaactcgtggataaggagcggaacctgcaccttgaagggaaatgcgagacatgtgtgtacaatatgatgggaaagagagagaagaaactgggcgaatttggcaaggcgaaagggtcccgggccatctggtacatgtggctcggagctcgcttcctggagtttgaagcccttggcttcctgaacgaggaccattggtttagcagagaaaattctctctccggggtcgagggagagggcctgcacaagctggggtatattctccgggatgtgagcaaaaaggaaggcggagctatgtacgccgacgacaccgccggctgggatacacgcatcaccctggaggaccttaagaacgaagagatggttacgaatcacatggaaggggagcataaaaagctggcggaggctatcttcaaactcacctatcaaaacaaggtggtcagagtgcagcggcccacaccgcgcggaaccgttatggatattatctccagacgggaccagcgcggcagcgggcaagtgggaacatacggcctgaatacctttacgaacatggaagcccagcttattagacagatggagggggaaggcgtcttcaaaaatatccagcacctgacagtgaccgaggaggttgccgtgcaaaactggctcgctcgggtcggacgcgaaagactgtctcggatggccattagcggcgatgactgcgtggtcaagcctctggatgaccgcttcgctaacgccctcacagcgctgaatgatatggggaagatcagaaaagacatccagcagtgggagccctccaagggatggaacgattggacccaggtgcccttttgctctcatcacttccatgaacttattatgaaagacggccgggttctggtggtcccttgtagaaatcaagatgagctcatcgggcgcgcccggattagccagggagctggctggtccctgagagaaacggcctgccttgggaagtcttatgctcagatgtggagcctgatgtactttcaccgccgggacctcagactggccgcgaacgccatctgttccgctgtgccgtctcactgggtgcccaccagccgcacaacctggtccattcatgccaaacacgagtggatgacaaccgaggacatgctgacagtttggaatcgggtgtggatcagagaaaacccttggatggaggataagacccccgtcgaaagctgggaggaaattccttatctcggcaagcgcgaggaccagtggtgcggatctctgatcggccttacgtcccgggctacatgggccaaaaatatccaagctgccattaaccaggtgagaagcctgatcgggaatgaggaatacaccgattacatgccctctatgaagcgcttccggagagaggaagaggaagcgggagttctctggtga

SEQ ID NO: 20197 - RNA, 9876 nt, synthetic construct
  misc_feature 1..9876: note = derived and/or modified CDS sequence (opt5) from DENV-2__FM210246__SS-prME
  source 1..9876: mol_type = other RNA
agcgccggaatgatcattatgctgatccccacagtgatggctttccacctgacaacgagaaatggggaacctcatatgattgtcggaatccaggaaaagggcaaatccctgctttttaagaccgaagacggggttaatatgtgcacactgatggccatggatctcggagaactgtgtgaagacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgagagcttcaaccagacgtttctgatcgacggccctgagaccgcggagtgccccaatacaaacagagcctggaactctctcgaagtcgaggattatgggttcggagtgtttaccacaaacatttggctgaaacttaaagaaaagcaggacgctttctgtgactccaagctgatgagcgccgctatcaaagataatcgcgccgttcatgcggacatgggctactggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattatcggcctggataccacacccagattgctggcccctggcatctcgggaagctggagatggactttgatttctgtgacggaacgacagtgatcgtcaccgaagattgcggcaacagagggcccagcctgcgcaccacaaccgcctctggaaaactcattacggagtggtgctgtcggtcctgcacactgcctccgcttagataccggggcgaggacggctgttggtatgggatggaaatccgccccctgaaggagaaagaagagaatctcgttaacagcctggtgaccgccggacacggccaggtggataatttttccctgggggtccttggaatggctctcttcctggaagagatgctgagaacacgggtgggcaccaagcatgcgatcctcctggttgccgtgtcttttgtcacacttattaccgggaacatgagcttcaaagacctgggaagagtggttgtgatggtcggcgctacgatggccgatgacatcggcatgggggtgacctacctcgccctgctggctgcctttaaggttcgccctacattcgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaatatcagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatctttcttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctacgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggcttttccccatctctattccgatcacggctgccgcctggtatctgtgggaggtcaaaaagcagcgggctggagtgctgtgggatgttccttctccccctcccatgggcaaagcggaactcgaggacggggcctaccgcattaagcaaaagggaatcctgggctattcccagatcggcgctggggtgtacaaagaaggaacctttcacacaatgtggcatgtcaccagaggcgccgtgcttatgcacaaggggaaacggattgagccctcctgggccgatgttaagaaagacctgatcagctacggaggcgggtggaagctcgagggagaatggaaggagggcgaagaggtgcaggtcctggctctcgaacctggcaaaaatccgcgcgccgtgcagacaaagcccgggctgttcaaaaccaacacgggaaccattggcgcggtgtcccttgatttttctcctgggacaagcggatcccccatcattgacaagaaaggcaaggttgtcgggctgtatggaaacggcgtggtgaccagaagcggcgcttacgtctctgccatcgcccaaacagagaagtccatcgaggataatcctgaaattgaggacgatatcttccggaaacgcagactgaccattatggacctccaccccggggctggaaagacaaaacggtatctgcctgccatcgtgagagaagcgattaagcgcggccttcggacgctgatcctcgctccgaccagagttgtggccgccgagatggaagaggctctgcgcgggctccccattcggtaccagacccctgccatcagagctgagcataccggacgcgaaatcgtcgacctgatgtgtcacgccaccttcacaatgcggcttctgagccccgtgagagttcctaactataatctgattatcatggatgaggcgcattttacggaccccgcctctattgctgcccgcggctacatctccacccgggtggaaatgggggaggctgccggcattttcatgacagccaccccgcctggaagcagagatccctttccccagtccaacgctcctatcatcgacgaggaacgggagattcccgaacgctcttggaatagcggccacgagtgggtcacagatttcaaagggaagaccgtgtggtttgttccttccatcaaggcgggaaacgacattgccgcttgcctccgcaaaaatggcaagaaagtgatccaactgagccggaagacgttcgattctgaatatgtcaaaacacgcaccaacgactgggattttgtggtgaccacagacatttccgagatgggggccaatttcaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttacatgggagagcccctcgaaaatgatgaggactgcgctcactggaaggaggccaaaatgctgctggataacatcaataccccggaaggcattatccctagcatgtttgagcccgaaagagagaaggtcgacgccattgatggggaatatcgcctccggggagaggctagaaaaacgttcgtggaccttatgcgcagaggcgatctgcctgtttggctggcctacaaggtggcggccgaggggatcaactatgctgaccggcgctggtgttttgatggaatcaaaaacaatcagattctcgaagagaacgtcgaagtggagatctggacaaaggagggcgaaagaaagaaactgaagccccggtggcttgacgcccgcatttactccgatcctctggctctcaaagagttcaaggagttcgccgctgggagaaaatctctgaccctgaatctcatcacagagatgggccggcttcccacctttatgacgcaaaagaccagagacgccctggataacctggcggttctccacacagccgaagctggaggccgcgcctataatcatgctctgagcgagcttccggagaccctggaaacactcctgctgctcacccttctggccacagtgaccgggggaattttcctgtttctcatgtccggccgggggatcggaaagatgacgctgggcatgtgctgcatcattacagcctctatccttctgtggtacgctcagattcagcctcactggatcgcggccagcattatcctcgagttctttctgatcgtcctgctcattcccgaacccgagaaacagagaacccctcaagacaaccagcttacctatgtggtcatcgctattctgacagtggttgccgccaccatggctaatgaaatgggcttcctggagaagaccaagaaggacctcgggctgggatccatcgccacgcagcagccggagagcaacattcttgatatcgacctgcgccccgcgtctgcctggaccctctacgctgtggccacaacctttgtgacacctatgctgcggcattccattgaaaatagctccgtcaacgtttctctgaccgctatcgccaatcaagcgacggtgctcatgggccttgggaaaggatggcccctgagcaagatggatatcggcgtgcctctgctcgccattgggtgttactcccaggtcaaccccatcaccctgacagctgcccttctgctcctggtggctcactatgccattatcggacctggcctgcaggctaaggccaccagagaggcgcagaaacgggccgctgccggcattatgaagaatccgacagttgacgggatcaccgtgatcgatctcgaccccattccttacgatcccaaattcgaaaagcaacttggacaggtcatgctgctgatcctctgcgtgacgcaggtcctgatgatgcgcacaacctgggctctttgtgaggccctgacactcgccaccggccctatttctaccctgtgggaagggaaccccggaagattttggaatacaacgatcgcggtgagcatggctaacattttccggggctcctatctggccggggctggactcctttttagcatcatgaaaaataccacaaacacccgcagaggcacaggcaacatgggggagaccctgggagagaagtggaaatctcggctgaatgccctcggcaagtccgagttccaaatctacaagaaaagcgggattcaggaggttgaccgcacgctggccaaggaaggaatcaaaagaggcgagacagatcaccatgctgtgtctcgggggtccgccaaacttcgctggtttgtcgagagaaacatggtgaccccggaaggaaaagttgtggacctgggctgcggcagagggggatggagctattactgtggcgggctcaagaatgtccgggaggtgaagggactgaccaaaggcgggcctggacacgaagaacccattcccatgtctacatatggctggaacctggtgcgcctccagagcggcgttgatgtcttcttcatccctcccgaaaagtgcgacacccttctgtgtgatattggggagtcctctcctaatccgacagtggaggcgggacggacgctgagagtgctcaacctggtcgaaaattggcttaacaataacacccagttttgcatcaaagttctgaatccctacatgcctagcgtgatcgagaagatggaagccctccaacgcaaatacggcggggctctggtgcggaaccccctgtccagaaatagcacacatgagatgtattgggtctccaacgcctctggaaatattgtgagctccgttaacatgatctctcgcatgctcattaaccggttcaccatgagacacaagaaggctacatacgaacctgacgtggaccttggcagcgggacccgcaatatcggaattgagtccgagatccccaacctggatattatcggcaaacggatcgaaaagattaaacaggagcatgaaacgtcttggcactatgaccaggatcacccgtacaagacctgggcctatcatggcagctacgagacaaaacagaccgggtccgcgagctctatggtcaatggagtggttagactgctcacaaagccttgggacgtgctgcccaccgtcacacaaatggccatgaccgatacgacaccttttggccagcagcgcgtgttcaaggaaaaagtggacacccggacccaggagcccaaggaggggaccaagaaacttatgaaaatcacggctgaatggctgtggaaggagctcggcaaaaagaagacccctagaatgtgtacacgcgaagagtttaccagaaaagtccggtccaacgccgctctgggcgccattttcacagatgagaataagtggaaaagcgctcgcgaagccgttgaggactctagattttgggaactggtggataaggagcggaacctccacctggaagggaaatgcgagacctgtgtgtataatatgatgggaaagagagagaagaaacttggcgagttcggcaaggcgaaagggtcccgggccatctggtacatgtggctgggagctcgctttctcgagttcgaagccctgggctttcttaacgaggaccattggttcagcagagaaaattctctgtccggggtcgagggagagggcctccacaagctggggtacattctgcgggatgtgagcaaaaaggaaggcggagctatgtatgccgacgacacagccggctgggatacccgcatcacgctcgaggacctgaagaacgaagagatggttaccaatcacatggaaggggagcataagaaacttgcggaggctatctttaaactgacataccaaaacaaagtggtcagagtgcagcggcccaccccgcgcggaacagttatggatattatctccagacgggaccagcgcggcagcgggcaagtgggaacctatggcctcaatacgttcacaaacatggaagcccagctgattagacagatggagggggaaggcgtcttcaaaaatatccagcaccttaccgtgacagaggaggttgccgtgaagaactggctggctcgggtcggacgcgaaagactctctcggatggccattagcggcgatgactgcgtggtcaagcctctggatgaccgctttgctaacgccctgaccgcgctcaatgatatggggaaaatcagaaaggacatccaacagtgggagccctccaaaggatggaacgattggacacaggtgcccttctgctctcatcactttcatgaactgattatgaaggacggccgggttcttgtggtcccttgtagaaatcaggatgagctgatcgggcgcgcccggattagccaaggagctggctggtccctcagagaaaccgcctgcctggggaaatcttacgctcagatgtggagccttatgtatttccaccgccgggacctgagactcgccgcgaacgccatctgttccgctgtgccgtctcactgggtgcccacaagccgcaccacatggtccattcatgccaagcacgagtggatgaccacagaggacatgctgaccgtttggaatcgggtgtggatcagagaaaacccttggatggaggataagacgcccgtcgaaagctgggaggaaattccttacctgggcaaacgcgaggaccagtggtgcggatctctcatcggcctgacatcccgggctacctgggccaagaatatccaggctgccattaaccaagtgagaagccttatcgggaatgaggaatataccgattacatgccctctatgaaacgctttcggagagaggaagaggaagcgggagttctgtggtga

SEQ ID NO: 20198 - RNA, 9876 nt, synthetic construct
  misc_feature 1..9876: note = derived and/or modified CDS sequence (opt5) from DENV-2__FM210207__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgctgaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagagaacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaaacgggccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcatgaaaaataccacaaacacccgcagaggcacaggcaacatgggggagaccctgggagagaagtggaaatctcggctgaatgccctcggcaagaacgaatttcaaatctataagaaatccgggattcaggaggttgaccgcacgctggccaaggaaggaatcaaaagaggcgagacagatcaccatgctgtgagccgggggtctgccaaacttcgctggttcgtcgagagaaatatggtgaccccggaaggaaaagttgtggacctgggctgcggcagagggggatggtcctactattgtggcgggctcaagaacgtccgggaggtgaagggactgaccaaaggcgggcctggacacgaagaacccattcccatgagcacatacggctggaatctggtgcgcctccagtctggcgttgatgtctttttcatccctcccgaaaagtgcgacacccttctgtgtgatattggggagagctcccctaacccgacagtggaggcgggacggacgctgagagtgctcaatctggtcgaaaactggcttaataacaatacccagttctgcatcaaagttctgaacccctacatgccttctgtgatcgagaagatggaagccctccaacgcaaatatggcggggctctggtgcggaatcccctgagcagaaactccacacatgagatgtactgggtcagcaatgcctccggaaacattgtgtctagcgttaacatgatctcccgcatgctcattaatcggtttaccatgagacacaagaaggctacatatgaacctgacgtggaccttggctctgggacccgcaacatcggaattgagagcgagatccccaatctggatattatcggcaaacggatcgaaaagattaaacaggagcatgaaacgtcctggcactacgaccaggatcacccgtataagacctgggcctaccatggctcttatgagacaaaacagaccgggagcgcgtccagcatggtcaacggagtggttagactgctcacaaagccttgggacgtgctgcccaccgtcacacaaatggccatgaccgatacgacacctttcggccagcagcgcgtgtttaaggaaaaagtggacacccggacccaggagcccaaggaggggaccaagaaacttatgaaaatcacggctgaatggctgtggaaggagctcggcaaaaagaagacccctagaatgtgtacacgcgaagagttcaccagaaaagtccggtctaatgccgctctgggcgccatttttacagatgagaacaagtggaaatccgctcgcgaagccgttgaggacagcagattctgggaactggtggataaggagcggaatctccacctggaagggaaatgcgagacctgtgtgtacaacatgatgggaaagagagagaagaaacttggcgaatttggcaaggcgaaagggtctcgggccatctggtacatgtggctgggagctcgcttcctcgagtttgaagccctgggcttccttaatgaggaccattggttttccagagaaaacagcctgtctggggtcgagggagagggcctccacaagctggggtatattctgcgggatgtgtccaaaaaggaaggcggagctatgtacgccgacgacacagccggctgggatacccgcatcacgctcgaggacctgaagaatgaagagatggttaccaaccacatggaaggggagcataagaaacttgcggaggctatcttcaaactgacatatcaaaataaagtggtcagagtgcagcggcccaccccgcgcggaacagttatggatattatcagcagacgggaccagcgcggctccgggcaagtgggaacctacggcctcaacacgtttacaaatatggaagcccagctgattagacagatggagggggaaggcgtcttcaaaaacatccagcaccttaccgtgacagaggaggttgccgtgcaaaactggctggctcgggtcggacgcgaaagactcagccggatggccatttctggcgatgactgcgtggtcaagcctctggatgaccgcttcgctaatgccctgaccgcgctcaacgatatggggaagatcagaaaagacatccagcagtgggagcccagcaagggatggaatgattggacacaggtgcccttttgctcccatcacttccatgaactgattatgaaagacggccgggttcttgtggtcccttgtagaaaccaagatgagctgatcgggcgcgcccggatttctcagggagctggctggagcctcagagaaaccgcctgcctggggaagtcctatgctcagatgtggtctcttatgtactttcaccgccgggacctgagactcgccgcgaatgccatctgtagcgctgtgccgtcccactgggtgcccacatctcgcaccacatggagcatgcatgccaaacacgagtggatgaccacagaggacatgctgaccgtttggaaccgggtgtggattagagaaaatccttggatggaggataagacgcccgtcgaatcctgggaggaaatcccttatctgggcaagcgcgaggaccagtggtgcggaagcctcattggcctgacatctcgggctacctgggccaaaaacatccaagctgccatcaatcaggtgagatcccttattgggaacgaggaatacaccgattacatgcccagcatgaagcgcttccggagagaggaagaggaagcgggagttctgtggtga

SEQ ID NO: 20199 - RNA, 9876 nt, synthetic construct
  misc_feature 1..9876: note = derived and/or modified CDS sequence (opt5) from DENV-2__FM210238__SS-prME
  source 1..9876: mol_type = other RNA
accgccggcatgatcattatgctgatccccaccgctatggccttccacctcacgacccggaacggggagcctcatatgattgtgggacggcaggaaaagggcaagagcctgctttttaagacagaggacggggtcaatatgtgcaccctgatggcgatcgatctcggagaactgtgtgaggacacaattacctacaaatgcccccttctgagacaaaacgaacccgaggatatcgactgttggtgcaattccacatctacctgggttacgtatggcacctgtacaaccacaggggagcacagacgggaaaagcgcagcgtggctctcgtgcctcatgtcggaatgggcctggagaccagaacggaaacatggatgtcctctgagggcgcctggaaacacgcccagcggatcgagacctggattctgcgccatcccgggttcacaatcatggctgccattctcgcttacaccgtgggaaccacacactttcagagagccctgatcttcattcttctggcggccgttgctcctagcatgacgatgcggtgcatcggcatttccaaccgcgattttgtggaaggggtctctggaggcagctgggtggacatcgttctcgagcacgggtcctgtgtgaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaggaacaggacaaacgctttgtctgcaagcattccatggtggatagaggctggggcaacgggtgtggactgttcggcaaagggggaatcgtgacctgcgccatgtttacatgcaaaaagaatatggaaggcaaaattgtccagcctgagaacctcgaatacacgatcgttattacaccccacagcggggaggagcatgctgtgggaaatgacacaggcaagcacggcaaagaaatcaagatcacccctcagtctcccattacagaggccgaactgaccgggtatggaacggtgaccatggagtgttccccgcggacaggccttgatttcaacgaaatggtcctgctccaaatggaggacaaggcttggctggtgcaccgccagtggtttcttgatctgcctctcccctggctgcctggggccgacacccagggaagcaattggatccagaaggagacactggttaccttcaagaacccccatgccaaaaagcaagacgtggtcgtgctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgttaaagaaattgctgagacccagcacggcacaatcgtgatcagagtccagtatgagggggacggaagcccctgcaagattcctttcgaaatcatggatctcgagaaacgccatgtgctgggccggctgattacggtcaacccgatcgtgaccgaaaaggactcccccgttaacattgaggccgaacctccctttggggatagctacatcattatcggcgtggagcctggacagctcaaactgaattggttcaagaagggatcttccatcgggcaaatgtttgagacaaccatgagaggagccaaacgcatggctattcttggcgacacagcctgggatttcgggagcctgggaggcgtctttacctctatcgggaaggcgctccaccaggtgttcggcgctatttacggagccgcctttagcggcgtttcctggacgatgaaaatcctgattggggtgatcatcacatggattggaatgaactctcggagcacctccctgagcgtctctcttgtgctcgtgggcgttatcaccctgtatctgggggctatggtccaggccgactccggatgtgtggtgagctggaagaataaagaactcaagtgcggctctgggattttcatcacagataacgtccacacctggacagagcagtacaagtttcaacccgaatccccgagcaaactggcttccgccattcagaaggcgcatgaggaaggcatctgtggaatcagatctgtgacgcgccttgagaatctgatgtggaaacagattacccctgagctcaaccacatcctgagcgaaaatgaggttaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtggaagactacggatttggcgtcttcacaaccaacatctggctgaaacttcgggagaaacaggacgtgttttgtgattctaagctgatgtccgccgcgattaaagacaatagagccgttcacgctgatatgggctattggatcgaaagcgccctcaacgacacatggaagatggagaaggcttctttcattgaggtgaaatcctgccactggcccaagagccataccctgtggtctaatggggtcctggaaagcgagatgatcattccgaaatccttcgccggacctgtgagccagcacaactaccgccccggctattacacgcaaacagccgggccctggcatcttggaaagctcgaaatggattttgacttctgtgagggcaccaccgttgtggtcacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtgaccgcgggccacgggcagatcgataatttttctctgggagtcctgggcatggcccttttcctcgaagagatgctgagaacacgcgttgggaccaaacatgctatcctgctcgtgacggtgagctttgtcaccctgattacaggaaacatgtccttccgggaccttggcagagtgatggttatggtgggcgccgccatgaccgatgacatcgggatgggagtcacatacctggctctcctggccgcgtttaaggtgcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggttctgaaaatcgtgcggaatatggaaaagtatcaacttgctgtcaccattatggccatctcttgcgtgcccaacgccgttattctgcagaatgcttggaaggtgagctgtacaatcctcgccgctgtctccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtggggatggtcagcatcctggcttcttccctcctgaaaaacgacattcccatgacgggacctctcgttgccggcggcctgcttacagtgtgctacgtgctgaccgggcggagcgccgatctggaactcgagcgcgctaccgacgtcaagtgggaggatcaagcggaaatctccggaagctctcccattctgagcatcacaattgccgaggacggctccatgtctatcaaaaatgaagaggaggaacagacccttacaatcctgattagaacggggctcctggtgatcagcggactcttcccggtttccattcctatcaccgctgccgcctggtatctgtgggaggtgaagaagcagcgggctggcgtcctttgggatgtgccctctcctccgcccgttgggaaagccgaactggaggacggagcgtaccgcattaagcagaaaggcatcctgggctatagccaaatcggggctggagtgtacaaggaaggcacatttcacaccatgtggcacgtcacaagaggggccgtgctcatgcatcggggaaaacgcattgagccttcctgggccgatgtcaagaaggacctgatctcttacggcgggggatggaaacttgagggcgaatggaaggagggcgaagaggtgcaggttctggctctcgaaccggggaaaaaccccagagccgtgcagaccaagcctggactgttcaaaacgaataccggcacaattggggcggtcagcctcgatttttcccccggaaccagcggctctcctatcgtggaccggaaggggaaggttgtgggactgtatggcaacggcgtcgtgacaagatccggggcttacgtgagcgccattgcccagaccgagaaatctatcgaggataatcccgaaatcgaggacgatattttccgcaagaaacggcttacaatcatggacctgcaccctggagctggcaagacgaaaagatatctgccggccattgttcgcgaagctatcaagcgggggctcagaaccctgattcttgcccccacacgcgtcgtggcggccgagatggaagaggctctgcggggactccctatcagataccaaacccccgccattcgcgctgagcataccggccgggaaatcgtggacctgatgtgtcacgccacattcacgatgagactcctgtcccctgtccgggtgcccaactataaccttatcattatggatgaggcccattttaccgacccggctagcatcgcggcccgcgggtacatttccacaagagttgaaatgggcgaggctgccggaatcttcatgaccgccacacctcccggctctcgggatccctttcctcagagcaatgctcccattatggacgaggaacgcgagatccctgaaagatcctggaacagcgggcacgagtgggtgaccgatttcaagggaaaaacggtctggtttgtgccgtctatcaaggccggcaatgacattgcggcttgcctgcggaaaaacgggaagaaagttatccagctgtccagaaagacattcgatagcgaatatgtgaagacccgcaccaatgactgggattttgtcgtgacaaccgacatttctgagatgggagccaacttcaaagccgagcgggttatcgatcccagacgctgtatgaagcctgtgattctcacagacggcgaagaacgggtcatcctggctgggcccatgcctgtgacccacagctccgccgcgcaaagacgcggccggatcggaagaaatcccaaaaacgaaaatgaccagtacatttacatgggcgagccgcttgaaaacgatgaggactgcgcccattggaaggaggctaaaatgctgctcgataatatcaacacgcctgaagggattatcccctctatgtttgagcctgaacgcgagaaggtggacgccattgatggagaatatagactgcggggcgaggctcgcaaaacattcgtcgacctgatgagaagaggggatctccccgtttggcttgcctaccgcgtggctgccgagggaatcaattatgcggacagacggtggtgttttgatggcgtgaagaacgaccagattctggaagagaatgtcgaagtggagatctggaccaaggagggggaacgcaagaagctgaaacctcgctggctcgatgcccggatctacagcgaccccctggctcttaaggagttcaaagagttcgccgctggcagaaagtccctgacactcaacctgattaccgagatgggacgcctgccgacgtttatgacccagaaggcccgggatgccctcgacaaccttgctgttctgcacacagcggaagccggcgggagagcttataatcatgccctgtctgagctccctgagaccctggaaacacttctgctcctgaccctgctcgccacagtgaccggaggcatcttcctttttctgatgagcgggaaaggagtcggcaagatgacgctgggcatgtgctgcattatcacagcttccattctcctgtggtacgcccaaatccagccccactggatcgcggccagcattatccttgagttctttctgattgtgctcctgatccccgaacctgagaaacagcggaccccgcaggacaaccaactgacctatgttgtgattgctatcctcacagtcgtggccgctaccatggccaatgaaatggggttccttgagaagaccaagaaggatctgggactgggctctatcgcgacgcaggagcccgaatccaacattctcgacatcgatctgcgccctgccagcgcttggaccctttacgccgtcgctacaacctttgtgacacccatgctgagacactccattgaaaattctagcgttaacgtgtccctcaccgccatcgctaatcaggccacggtgctgatggggctgggaaagggctggcctctctctaaaatggacattggggtcccccttctggcgatcggatgttacagccaggttaaccctattaccctgacagccgctctcctgcttctggtggcccattatgctatcatcggcccgggcctccaagccaaggccacccgggaagcgcagaaacgcgctgccgctgggattatgaagaatcccacagtggatggaatcaccgtcattgacctggatcctatcccctacgaccctaaattcgagaagcagctgggccaggtgatgctccttattctgtgcgttacgcaagtgctgatgatgagaacaacctgggccctctgtgaagccctgacacttgctaccgggcccatctccaccctgtgggagggaaacccgggccggttttggaatacaacgatcgccgtcagcatggcgaacattttccgcgggtcttatctcgccggagctggcctgctgttttccatcatgaagaataccacaaacaccagacggggcacagggaatattggagagaccctcggcgaaaaatggaaaagccgccttaacgccctggggaaatctgagttccagatctacaagaaatccggcattcaggaagtggatagaacgctggctaaggagggcatcaaaagaggggaaacagaccaccatgccgtcagcagaggatctgcgaagctccgctggtttgtggaacggaatatggttacccctgagggcaaggtggtcgatctgggctgcgggagaggaggctggagctattactgtgggggacttaaaaacgtgcgcgaagttaagggcctgaccaaagggggacccggccacgaggaacccatccctatgtccacatatggctggaacctcgtgcggctgcaatctggggtcgacgtgttcttcacaccccctgagaagtgcgataccctgctctgtgacattggagagagctccccgaatcccacgatcgaagccggcagaacccttcgcgtgctgagcctggttgagaactggctcaataacgacacacagttttgcattaaagtcctgaatccttacatgccctccgtgatcgaaaagatggagacccttcagcggaagtacgggggagctctggtgagaaaccctctctctcgcaatagcacacatgaaatgtattgggtctccaacgccaccggcaatattgtttctagcgtgaacatgatctcccggatgctgatcaatagattcacgatgaaacacaagaaagctacctacgagcccgatgtggacctggggtctggaacacgcaacattggcatcgagagcgaaattccgaatctcgatatcattggcaagcggatcgagaaaattaagcaggaacacgagacctcctggcattatgaccaagatcacccttacaagacatgggcctatcatgggagctacgaaaccaaacagacaggatctgcttccagcatggtcaacggcgtggttagacttctgaccaagccctgggacgtggtccctatggtgacgcagatggccatgacagataccaccccctttgggcagcaacgcgttttcaaagagaaggtggacacaagaacgcaggagcctaaagaaggaaccaagaagctgatgaaaatcacagcggagtggctctggaaggaactgggcaaaaagaaaacaccccggatgtgtacacgcgaggagtttaccagaaaggtccggtctaatgccgctcttggggccatcttcacagatgaaaacaaatggaagtccgctagagaggccgtggaagacagccggttttgggagctggtggataaggaacgcaacctccacctggagggaaaatgcgagacctgtgtctataatatgatgggcaagagagagaagaagctgggcgagttcgggaaagccaagggatctcgggcgatttggtacatgtggctcggcgctcgctttctggagttcgaggcccttgggtttctgaacgaagaccactggttctccagagagaatagcctctccggagttgagggcgaagggctgcataaacttggctacatcctgcgggacgtgagcaaaaaggagggaggcgccatgtatgctgatgacacggccgggtgggatacccgcattacactcgaagacctgaaaaacgaggaaatggtgaccaatcacatggagggagagcataagaaactggctgaagccatctttaagctcacataccagaacaaggtcgtgagagttcagcggccgacccctcgcggcacggtgatggatattatctctagacgggaccaacgcgggagcggacaggtcggcacatatgggctgaataccttcacaaacatggaggcgcagcttatcagacaaatggaaggcgagggagtgttcaaatccattcagcggctgaccgttacggaggaaatcgccgtgcagaattggctcgctcgcgtcggcagagagcggctgtctagaatggccattagcggggatgactgcgtggttaagccccttgatgaccgctttgcttccgccctgaccgcgctcaacgatatgggaaaagtgcggaaggacatccagcaatgggaaccctctagaggctggaatgattggacacaggtccctttctgcagccaccattttcacgagctgattatgaaagacgggcgcgtgctggtcgtgccgtgtcggaaccaggacgaactcatcggacgggcccgcatctcccagggcgctgggtggtctctgaaggagaccgcctgccttggcaagagctacgctcaaatgtggtccctgatgtatttccaccggagagatctccgcctggccgctaatgccatttgtagcgcggttccctctcattgggtgcctacatcccggaccacatggagcatccacgccaaacatgagtggatgaccacggaagacatgcttacagtctggaacagagtgtggattcaggagaatccctggatggaagataagacccctgtggagtcttgggaagaggttccctacctgggaaaacgcgaggaccagtggtgcggctccctcatcgggctgaccagccgggctacatgggccaagaacattcagaccgccatcaaccaagtgagatccctgattggaaatgaagagtatacagattacatgccttctatgaaacggtttagacgcgaagaggaagaggctggcgtcctctggtga

SEQ ID NO: 20200 - RNA, 9876 nt, synthetic construct
  misc_feature 1..9876: note = derived and/or modified CDS sequence (opt5) from DENV-2__FM210224__SS-prME
  source 1..9876: mol_type = other RNA
accgccggagtgatcattatgctgatccccacagctatggccttccacctcacgacccggaatggggagcctcatatgattgtcggacggcaggaaaagggcaagtccctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccatcaccgaggctgaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggattcagaaggagaccctggttacgttcaagaaccctcatgccaaaaagcaagacgtggtcgtgctcggctcccaggaaggggccatgcacacagctctgaccggcgcgacagagatccagatgagctccggaaatcttctgtttaccggccatctcaaatgcagactgcggatggataaacttcaactgaaagggatgtcttacagcatgtgtaccggaaagttcaagattgttaaagaaatcgccgagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggctgaacccccttttggggattcttacattatcatcggcgtggagcccggacagctcaaactgaattggttcaagaagggctccagcattgggcaaatgtttgagaccacaatgagaggagccaaacgcatggccatccttggcgacaccgcttgggatttcgggtctctgggaggcgtctttacgagcattgggaaggccctccaccaggtgttcggcgcgatctacggagctgccttttccggcgtttcttggacaatgaaaattctgatcggggccatcattacctggatcggaatgaacagccggtccaccagcctgtctgtgtcccttgtcctcgtgggcgtgattacactgtatctgggggctatggttcaggccgacagcggatgtgtcgtgtcttggaagaataaagaactcaagtgcggctccgggatcttcattaccgataacgtgcacacatggacggagcagtacaagtttcaacctgaaagcccctccaaactggcttctgccatccagaaggcgcatgaggaaggcatctgtggaattagaagcgtcacccgccttgagaatctgatgtggaaacagatcacaccggagctcaaccacattctgtccgaaaatgaggtgaagctgaccatcatgacaggcgacattaaagggatcatgcaggccggaaagcggtctcttagacctcaacccaccgaactcaaatatagctggaagacgtggggcaaggctaaaatgctgtccaccgagagccataaccagacattcctgatcgatgggcctgaaaccgccgagtgccccaatacaaaccgcgcttggaactctctcgaggttgaagactacggatttggcgtgttcaccacaaacatttggctgaaacttcgggagaaacaggacgtcttttgtgattccaagctgatgagcgccgcgatcaaagacaatagagccgtgcacgctgatatgggctattggattgaatctgccctcaacgacacctggaagatggagaaggcttccttcatcgaggttaaaagctgccactggcctaagtctcatacgctgtggagcaatggggtgctggaatccgagatgattatccccaagagcttcgccggaccggtctctcagcacaactaccgccctggctattacacacaaaccgccgggccctggcatcttggaaagctcgaaatggattttgacttctgtgagggcaccacagtggttgtgaccgaagattgcgggaaccggggaccctccctgagaacgacaaccgctagcggcaaactgattacagagtggtgctgtcggtcctgcaccctccctccgctgcgctacagaggcgaggacgggtgttggtatggaatggaaatccggccccttaaggagaaggaagagaatctggtcaactctctcgtgacagcgggccacgggcagatcgataattttagcctgggagtgctgggcatggcccttttcctcgaagagatgctgagaacccgcgtcgggacgaaacatgctattctgctcgttgccgtgtcctttgtgaccctgatcacaggaaacatgtctttccgggaccttggcagagtcatggtgatggttggcgccaccatgacagatgacattgggatgggagtgacctacctggctctcctggccgcgtttaaggtccgccctacgttcgctgccggcctgcttctgagaaaactcacaagcaaggagctgatgatggccaccatcgggattgctctcctgtcccagtctacaatccccgaaaccatccttgagctgaccgatgccctcgcgctgggaatgatggtgctgaaaattgttcggaatatggaaaagtatcaacttgctgtgacaatcatggccattagctgcgtccctaacgccgtgatcctgcagaatgcttggaaggtttcctgtacgattctcgccgctgtgagcgtctctcccctgctcctgacctccagccagcagaaagccgactggatccctcttgcgctgacaatcaagggcctcaaccccaccgccatttttctgacaaccctgtctcgcacgtccaaaaagagaagctggccgcttaatgaggctatcatggccgtggggatggtgtctattctggcttccagcctcctgaaaaacgacatccctatgacaggacccctcgtcgccggcggcctgcttaccgtttgctacgtgctgaccgggcggtccgccgatctggaactcgagcgcgctacagacgtgaagtgggaggatcaagcggaaattagcggatctagccctatcctgtccattaccatctctgaggacggcagcatgtccatcaaaaatgaagaggaggaacagacacttacgattctgatcagaaccgggctcctggtcatttctggactcttccccgtgagcatcccgattacagccgctgcctggtatctgtgggaggttaagaagcagcgggccggcgtgctttgggatgtcccttctccccctcccgtggggaaagctgaactggaggacggagcctaccgcatcaagcagaaaggcatcctgggctatagccaaattggggcgggagtttacaaggaaggcacctttcacacaatgtggcacgtgaccagaggggctgtcctcatgcatcggggaaaacgcatcgagcccagctgggccgatgtgaagaaggacctgatttcctacggcgggggatggaaacttgagggcgaatggaaggagggcgaagaggtccaggtgctggccctcgaacctgggaaaaacccgagagctgttcagacgaagcccggactgttcaaaaccaatacaggcaccatcggggccgtgagcctcgatttttctcctggaacatccggcagccccattgtcgaccggaaggggaaggtggttggactgtatggcaacggcgtggtcaccagatctggggcgtacgtgtccgctatcgcccagacagagaaaagcatcgaggataatcctgaaattgaggacgatatcttccgcaagaaacggcttacgattatggacctgcaccccggagccggcaagaccaaaagatatctgcctgctatcgtgcgcgaagccattaagcgggggctcagaacactgatccttgctccgacccgcgttgtcgccgcggagatggaagaggccctgcggggactccccattagataccaaacccctgctatccgcgccgagcatacaggccgggaaatcgtggacctgatgtgtcacgctacgttcaccatgagactcctgtcccccgtgcgggtccctaactataaccttattatcatggatgaggcccattttacagaccccgcctctattgctgcgcgcgggtacatcagcaccagagtggaaatgggcgaggccgctggaattttcatgacagccaccccgcctggctcccgggatccctttccccagagcaatgcccctatcatcgacgaggaacgcgagattcccgaaagatcttggaactccgggcacgagtgggttacggatttcaagggaaaaacagtgtggtttgtccctagcatcaaggctggcaatgacattgccgcgtgcctgcggaaaaacgggaagaaagtgatccagctgtctagaaagaccttcgatagcgaatatgttaagacccgcacaaatgactgggattttgtggtcaccacagacatttccgagatgggagctaacttcaaagccgagcgggtgatcgatccgagacgctgtatgaagcccgttatcctcaccgacggcgaagaacgggtgattctggccgggcctatgcccgtcacgcactctagcgctgcccaaagacgcggccggatcggaagaaatcctaaaaacgaaaatgaccagtacatttacatgggcgagccccttgaaaacgatgaggactgcgcgcattggaaggaggccaaaatgctgctcgataatatcaacacaccggaagggattatcccttccatgtttgagcccgaacgcgagaaggtggacgctattgatggagaatatagactgcggggcgaggcccgcaaaaccttcgtggacctgatgagaagaggggatctccctgtctggcttgcttaccgcgttgccgctgagggaatcaattatgccgacagacggtggtgttttgatggcgcgaagaacaatcagatcctggaagagaacgtggaagtggagatttggacaaaggagggggaacgcaagaagctgaaaccccgctggctcgacgcccggatctactctgatcctctggctcttaaggagttcaaagagttcgccgctggcagaaagagcctgaccctcaacctgattacggagatgggacgcctgcccacctttatgacacagaaggcccgggacgccctcgataatcttgctgtcctgcacaccgcggaagccggcgggagagcttataaccatgccctgtccgagctcccggagacactggaaacccttctgctcctgacactgctcgccaccgtgacgggaggcatcttcctttttctgatgagcgggaaaggagttggcaagatgacactgggcatgtgctgcattatcaccgcttctatcctcctgtggtacgcccaaattcagcctcactggatcgcggcctccattatccttgagttctttctgattgtgctcctgatccccgaacccgagaaacagcggacccctcaggacaatcaactgacatatgtcgtgatcgctattctcaccgttgtggccgctacaatggccaacgaaatggggttccttgagaagacgaaaaaggacctgggactgggcagcatcgcgacccaggagccggaatccaatattctcgatatcgacctgcgccccgcctctgcttggacactttacgccgtcgctaccacatttgtgacccctatgctgagacacagcattgagaactcctctgtcaatgtgagcctcacggccatcgctaaccaggccaccgttctgatggggctgggaaagggctggcccctctccaaaatggatattggggtgcctcttctggcgatcggatgttacagccaggtgaatcccatcacactgaccgccgctctcctgcttctgattgcccattatgctatcattggccctggcctccaagccaaggccacacgggaagcgcagaaacgcgctgccgctgggatcatgaagaacccgaccgtcgacggaattacggttatcgatctggaccccatcccttacgatcccaaattcgagaagcagctgggccaggtgatgctccttattctgtgcgtgacacaagtcctgatgatgagaaccacatgggccctctgtgaagccctgacccttgctaccgggcctatctctacactgtgggagggaaatcccggccggttttggaacacgaccattgccgtgtccatggcgaatatcttccgcgggagctatctcgccggagctggcctgctgttttctattatgaagaacacaaccaatacaagacggggcaccgggaacatcggagagacgctcggcgaaaaatggaagtcccgccttaatgccctggggaaaagcgagttccagatctacaagaaatctggcattcaggaagttgacagaacactggctaaggagggcatcaaaagaggggaaaccgatcaccatgccgtgagcagaggatccgcgaagctccgctggtttgtcgaacggaacatggtgaccccggagggcaaggtcgtggacctgggctgcgggagaggaggctggtcttattactgtgggggacttaaaaacgttcgcgaagtgaagggcctgacaaaagggggacctggccacgaggaacccattcccatgagcacctatggctggaatctcgtccggctgcaatccggggtggatgttttcttcacacctcccgagaagtgcgacacgctgctctgtgatatcggagagagctcccctaacccgaccattgaagccggcagaacacttcgcgtgctgtctctggtcgagaattggctcaacaatgacacccagttttgcatcaaagtgctgaacccctacatgcctagcgtgatcgaaaagatggagacacttcagcggaagtacgggggagctctggttagaaatcccctctcccgcaactctacccatgaaatgtattgggtcagcaatgccacgggcaacattgtgtcctctgtgaatatgatcagccggatgctgattaacagattcaccatgaaacacaagaaagctacatacgagcctgacgtcgatctggggtccggaacccgcaatatcggcattgagagcgaaatccccaacctcgacattatcggcaagcggatcgagaaaattaagcaggaacacgagacatcttggcattatgatcaagaccacccgtacaagacctgggcctatcatgggtcctacgaaacaaaacagaccggaagcgcttcttccatggttaatggcgtggtgagacttctgacgaagccttgggatgtcgtgcccatggttacacagatggccatgaccgacaccacaccttttgggcagcaacgcgtgttcaaagagaaggtcgatacgagaacccaggagcccaaagaaggaacaaagaagctgatgaaaatcaccgcggagtggctctggaaggaactgggcaaaaagaaaacacctcggatgtgtacccgcgaggagtttacaagaaaggtgcggagcaacgccgctcttggggccattttcaccgacgaaaacaaatggaagtctgctagagaggccgttgaagattcccggttttgggagctggtggacaaggaacgcaatctccacctggagggaaaatgcgagacgtgtgtctataacatgatgggcaagagagagaagaagctgggcgagttcgggaaagccaagggaagccgggcgatctggtacatgtggctcggcgctcgctttctggagttcgaggcccttgggtttctgaatgaagatcactggttctccagagagaacagcctctctggagtggagggcgaagggctgcataaacttggctacattctgcgggacgtgagcaaaaaggagggaggcgccatgtatgctgacgataccgccgggtgggacacacgcatcaccctcgaagatctgaaaaatgaggaaatggtcacaaaccacatggagggagagcataagagactggctgaagccatctttaaactcacctaccagaataaggttgtgcgggtgcagcgccccacgccgagaggcacagtcatggacattatctcccggcgcgatcaaagagggtctggacaggtgggcacctatgggctgaacacattcaccaatatggaggcgcagcttattcggcaaatggaaggcgagggaatcttcaagagcattcagcacctgacggttaccgaggaaatcgccgtgcagaactggctcgctcgcgtcggcagagagcggctgtccagaatggccatctctggggacgattgcgtggttaaacctcttgacgatcgctttgctagcgccctgacagcgctcaatgacatgggaaaggtgcggaaagatattcagcaatgggaaccctccaagggctggaacgactggacccaggtccccttctgctctcatcactttcacgagctgatcatgaaagatgggagagtgctggttgtgccttgtcgcaatcaggacgaactcattggacgggccagaatcagccagggcgctgggtggtccctgaaggagacagcctgccttggcaagagctacgctcaaatgtggtctctgatgtatttccatcgccgggacctcagactggccgctaacgccatttgttccgcggtcccgagccactgggtgcccacctctcgcacaacctggtccatccatgccaaacacgagtggatgacgacagaagatatgcttaccgtctggaatcgggtgtggattcaggagaacccttggatggaagacaagacccccgttgagagctgggaagaggtgccttacctgggaaaaagagaggatcagtggtgcggctccctcatcgggctgacatctcgcgctacctgggccaagaacatccagacagccattaatcaagtccggagcctgatcggaaacgaagagtatacggactacatgccctccatgaaaagatttcggagagaagaggaagaggctggcgtgctctggtga

SEQ ID NO: 20201 - RNA, 9876 nt, synthetic construct
  misc_feature 1..9876: note = derived and/or modified CDS sequence (opt5) from DENV-2__FM210225__SS-prME
  source 1..9876: mol_type = other RNA
accgccggagtgatcattatgctgatccccacagctatggccttccacctcacgacccggaatggggagcctcatatgattgtcggacggcaggaaaagggcaagtccctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccatcaccgaggctgaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggattcagaaggagaccctggttacgttcaagaaccctcatgccaaaaagcaagacgtggtcgtgctcggctcccaggaaggggccatgcacacagctctgaccggcgcgacagagatccagatgagctccggaaatcttctgtttaccggccatctcaaatgcagactgcggatggataaacttcaactgaaagggatgtcttacagcatgtgtaccggaaagttcaagattgttaaagaaatcgccgagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggctgaacccccttttggggattcttacattatcatcggcgtggagcccggacagctcaaactgaattggttcaagaagggctccagcattgggcaaatgtttgagaccacaatgagaggagccaaacgcatggccatccttggcgacaccgcttgggatttcgggtctctgggaggcgtctttacgagcattgggaaggccctccaccaggtgttcggcgcgatctacggagctgccttttccggcgtttcttggacaatgaaaattctgatcggggccatcattacctggatcggaatgaacagccggtccaccagcctgtctgtgtcccttgtcctcgtgggcgtgattacactgtatctgggggctatggttcaggccgacagcggatgtgtcgtgtcttggaagaataaagaactcaagtgcggctccgggatcttcattaccgataacgtgcacacatggacggagcagtacaagtttcaacctgaaagcccctccaaactggcttctgccatccagaaggcgcatgaggaaggcatctgtggaattagaagcgtcacccgccttgagaatctgatgtggaaacagatcacaccggagctcaaccacattctgtccgaaaatgaggtgaagctgaccatcatgacaggcgacattaaagggatcatgcaggccggaaagcggtctcttagacctcaacccaccgaactcaaatatagctggaagacgtggggcaaggctaaaatgctgtccaccgagagccataaccagacattcctgatcgatgggcctgaaaccgccgagtgccccaatacaaaccgcgcttggaactctctcgaggttgaagactacggatttggcgtgttcaccacaaacatttggctgaaacttcgggagaaacaggacgtcttttgtgattccaagctgatgagcgccgcgatcaaagacaatagagccgtgcacgctgatatgggctattggattgaatctgccctcaacgacacctggaagatggagaaggcttccttcatcgaggttaaaagctgccactggcctaagtctcatacgctgtggagcaatggggtgctggaatccgagatgattatccccaagagcttcgccggaccggtctctcagcacaactaccgccctggctattacacacaaaccgccgggccctggcatcttggaaagctcgaaatggattttgacttctgtgagggcaccacagtggttgtgaccgaagattgcgggaaccggggaccctccctgagaacgacaaccgctagcggcaaactgattacagagtggtgctgtcggtcctgcaccctccctccgctgcgctacagaggcgaggacgggtgttggtatggaatggaaatccggccccttaaggagaaggaagagaatctggtcaactctctcgtgacagcgggccacgggcagatcgataattttagcctgggagtgctgggcatggcccttttcctcgaagagatgctgagaacccgcgtcgggacgaaacatgctattctgctcgttgccgtgtcctttgtgaccctgatcacaggaaacatgtctttccgggaccttggcagagtcatggtgatggttggcgccaccatgacagatgacattgggatgggagtgacctacctggctctcctggccgcgtttaaggtccgccctacgttcgctgccggcctgcttctgagaaaactcacaagcaaggagctgatgatggccaccatcgggattgctctcctgtcccagtctacaatccccgaaaccatccttgagctgaccgatgccctcgcgctgggaatgatggtgctgaaaattgttcggaatatggaaaagtatcaacttgctgtgacaatcatggccattagctgcgtccctaacgccgtgatcctgcagaatgcttggaaggtttcctgtacgattctcgccgctgtgagcgtctctcccctgctcctgacctccagccagcagaaagccgactggatccctcttgcgctgacaatcaagggcctcaaccccaccgccatttttctgacaaccctgtctcgcacgtccaaaaagagaagctggccgcttaatgaggctatcatggccgtggggatggtgtctattctggcttccagcctcctgaaaaacgacatccctatgacaggacccctcgtcgccggcggcctgcttaccgtttgctacgtgctgaccgggcggtccgccgatctggaactcgagcgcgctacagacgtgaagtgggaggatcaagcggaaattagcggatctagccctatcctgtccattaccatctctgaggacggcagcatgtccatcaaaaatgaagaggaggaacagacacttacgattctgatcagaaccgggctcctggtcatttctggactcttccccgtgagcatcccgattacagccgctgcctggtatctgtgggaggttaagaagcagcgggccggcgtgctttgggatgtcccttctccccctcccgtggggaaagctgaactggaggacggagcctaccgcatcaagcagaaaggcatcctgggctatagccaaattggggcgggagtttacaaggaaggcacctttcacacaatgtggcacgtgaccagaggggctgtcctcatgcatcggggaaaacgcatcgagcccagctgggccgatgtgaagaaggacctgatttcctacggcgggggatggaaacttgagggcgaatggaaggagggcgaagaggtccaggtgctggccctcgaacctgggaaaaacccgagagctgttcagacgaagcccggactgttcaaaaccaatacaggcaccatcggggccgtgagcctcgatttttctcctggaacatccggcagccccattgtcgaccggaaggggaaggtggttggactgtatggcaacggcgtggtcaccagatctggggcgtacgtgtccgctatcgcccagacagagaaaagcatcgaggataatcctgaaattgaggacgatatcttccgcaagaaacggcttacgattatggacctgcaccccggagccggcaagaccaaaagatatctgcctgctatcgtgcgcgaagccattaagcgggggctcagaacactgatccttgctccgacccgcgttgtcgccgcggagatggaagaggccctgcggggactccccattagataccaaacccctgctatccgcgccgagcatacaggccgggaaatcgtggacctgatgtgtcacgctacgttcaccatgagactcctgtcccccgtgcgggtccctaactataaccttattatcatggatgaggcccattttacagaccccgcctctattgctgcgcgcgggtacatcagcaccagagtggaaatgggcgaggccgctggaattttcatgacagccaccccgcctggctcccgggatccctttccccagagcaatgcccctatcatcgacgaggaacgcgagattcccgaaagatcttggaactccgggcacgagtgggttacggatttcaagggaaaaacagtgtggtttgtccctagcatcaaggctggcaatgacattgccgcgtgcctgcggaaaaacgggaagaaagtgatccagctgtctagaaagaccttcgatagcgaatatgttaagacccgcacaaatgactgggattttgtggtcaccacagacatttccgagatgggagctaacttcaaagccgagcgggtgatcgatccgagacgctgtatgaagcccgttatcctcaccgacggcgaagaacgggtgattctggccgggcctatgcccgtcacgcactctagcgctgcccaaagacgcggccggatcggaagaaatcctaaaaacgaaaatgaccagtacatttacatgggcgagccccttgaaaacgatgaggactgcgcgcattggaaggaggccaaaatgctgctcgataatatcaacacaccggaagggattatcccttccatgtttgagcccgaacgcgagaaggtggacgctattgatggagaatatagactgcggggcgaggcccgcaaaaccttcgtggacctgatgagaagaggggatctccctgtctggcttgcttaccgcgttgccgctgagggaatcaattatgccgacagacggtggtgttttgatggcgtgaagaacaatcagatcctggaagagaacgtggaagtcgagatttggacaaaggagggggaacgcaagaagctgaaaccccgctggctcgacgcgcggatctactctgatcctctggcccttaaggagttcaaagagttcgctgccggcagaaagagcctgaccctcaacctgattacggagatgggacgcctgcccacctttatgacacagaaggctcgggacgccctcgataatcttgccgtgctgcacaccgctgaagcgggcgggagagcctataaccatgctctgtccgagctcccggagacactggaaacccttctgctcctgacactgctcgccaccgttacgggaggcatcttcctttttctgatgagcgggaaaggagtgggcaagatgacactgggcatgtgctgcattatcaccgcctctatcctcctgtggtacgctcaaattcagcctcactggatcgccgcgtccattatccttgagttctttctgattgtcctcctgatccccgaacccgagaaacagcggacccctcaggacaatcaactgacatatgtggttatcgccattctcaccgtggtcgctgccacaatggctaacgaaatggggttccttgagaagacgaaaaaggacctgggactgggcagcatcgccacccaggagccggaatccaatattctcgatatcgacctgcgccccgcgtctgcctggacactttacgctgtggccaccacatttgtcacccctatgctgagacacagcattgagaactcctctgtgaatgttagcctcacggctatcgccaaccaggctaccgtgctgatggggctgggaaagggctggcccctctccaaaatggatattggggtgcctcttctggccatcggatgttacagccaggtcaatcccatcacactgaccgcggccctcctgcttctgattgctcattatgccatcattggccctggcctccaagctaaggccacacgggaagcccagaaacgcgcggctgccgggatcatgaagaacccgaccgttgacggaattacggtgatcgatctggaccccatcccttacgatcccaaattcgagaagcagctgggccaggtgatgctccttattctgtgcgtcacacaagtgctgatgatgagaaccacatgggctctctgtgaagccctgacccttgccaccgggcctatctctacactgtgggagggaaatcccggccggttttggaacacgaccattgctgtttccatggccaatatcttccgcgggagctatctcgcgggagccggcctgctgttttctattatgaagaacacaaccaatacaagacggggcaccgggaacatcggagagacgctcggcgaaaaatggaagtcccgccttaatgctctggggaaaagcgagttccagatctacaagaaatctggcattcaggaagtggacagaacactggccaaggagggcatcaaaagaggggaaaccgatcaccatgctgtcagcagaggatccgccaagctccgctggtttgtggaacggaacatggtcaccccggagggcaaggtggttgacctgggctgcgggagaggaggctggtcttattactgtgggggacttaaaaacgtgcgcgaagtcaagggcctgacaaaagggggacctggccacgaggaacccattcccatgagcacctatggctggaatctcgtgcggctgcaatccggggttgatgtgttcttcacacctcccgagaagtgcgacacgctgctctgtgatatcggagagagctcccctaacccgaccattgaagcgggcagaacacttcgcgtcctgtctctggtggagaattggctcaacaatgacacccagttttgcatcaaagtgctgaacccctacatgcctagcgttatcgaaaagatggagacacttcagcggaagtacgggggagccctggtcagaaatcccctctcccgcaactctacccatgaaatgtattgggtgagcaatgctacgggcaacattgtgtcctctgtcaatatgatcagccggatgctgattaacagattcaccatgaaacacaagaaagccacatacgagcctgacgttgatctggggtccggaacccgcaatatcggcattgagagcgaaatccccaacctcgacattatcggcaagcggatcgagaaaattaagcaggaacacgagacatcttggcattatgatcaagaccacccgtacaagacctgggcttatcatgggtcctacgaaacaaaacagaccggaagcgcctcttccatggtgaatggcgtggtcagacttctgacgaagccttgggatgtggttcccatggtgacacagatggctatgaccgacaccacaccttttgggcagcaacgcgtcttcaaagagaaggtggatacgagaacccaggagcccaaagaaggaacaaagaagctgatgaaaatcaccgccgagtggctctggaaggaactgggcaaaaagaaaacacctcggatgtgtacccgcgaggagtttacaagaaaggttcggagcaacgcggcccttggggctattttcaccgacgaaaacaaatggaagtctgccagagaggctgtggaagattcccggttttgggagctggtcgacaaggaacgcaatctccacctggagggaaaatgcgagacgtgtgtgtataacatgatgggcaagagagagaagaagctgggcgagttcgggaaagccaagggaagccgggccatctggtacatgtggctcggcgcgcgctttctggagttcgaggctcttgggtttctgaatgaagatcactggttctccagagagaacagcctctctggagtggagggcgaagggctgcataaacttggctacattctgcgggacgtcagcaaaaaggagggaggcgccatgtatgccgacgataccgctgggtgggacacacgcatcaccctcgaagatctgaaaaatgaggaaatggttacaaaccacatggagggagagcataagagactggccgaagctatctttaaactcacctaccagaataaggtggtgcgggtccagcgccccacgccgagaggcacagtgatggacattatctcccggcgcgatcaaagagggtctggacaggttggcacctatgggctgaacacattcaccaatatggaggcccagcttattcggcaaatggaaggcgagggaatcttcaagagcattcagcacctgacggtgaccgaggaaatcgcggtccagaactggctcgcccgcgtgggcagagagcggctgtccagaatggctatctctggggacgattgcgttgtgaaacctcttgacgatcgctttgccagcgctctgacagccctcaatgacatgggaaaggtccggaaagatattcagcaatgggaaccctccaagggctggaacgactggacccaggtgcccttctgctctcatcactttcacgagctgatcatgaaagatgggagagttctggtggtcccttgtcgcaatcaggacgaactcattggacgggcgagaatcagccagggcgccgggtggtccctgaaggagacagcttgccttggcaagagctacgcccaaatgtggtctctgatgtatttccatcgccgggacctcagactggctgccaacgctatttgttccgccgtgccgagccactgggtccccacctctcgcacaacctggtccatccatgcgaaacacgagtggatgacgacagaagatatgcttaccgtgtggaatcgggtttggattcaggagaacccttggatggaagacaagacccccgtggagagctgggaagaggtcccttacctgggaaaaagagaggatcagtggtgcggctccctcatcgggctgacatctcgcgccacctgggctaagaacatccagacagccattaatcaagtgcggagcctgatcggaaacgaagagtatacggactacatgccctccatgaaaagatttcggagagaagaggaagaggccggcgtgctctggtga

SEQ ID NO: 20202 - RNA, 9876 nt, synthetic construct
  misc_feature 1..9876: note = derived and/or modified CDS sequence (opt5) from DENV-2__FM210226__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtggccgtcagctttgtgacgctgattaccggaaacatgtccttccgggaccttggcagagttatggtgatggtcggcgccgctatgacagatgacatcgggattggagtgacctacctggccctcctggcggcttttaaggttcgccccacattcgccgccggcctgcttctgagaaaactcacctctaaggagctgatgatggctacgatcgggattgccctcctgagccagtccacaatccctgaaaccatccttgagctgacagatgcgctcgctctgggaatgatggtgctgaaaattgtccggaatatggaaaagtatcaacttgccgtgaccatcatggccatttcttgcgttcccaacgctgtgatcctgcagaatgcctggaaggtcagctgtaccattctcgctacagtgtccgtgagccctctgctcctgacgtcttcccagcagaaagccgactggatcccccttgcgctgaccatcaagggcctcaacccgacagccatttttctgaccacactgagccgcacctctaaaaagagatcctggcctcttaatgaggctatcatggccgtcgggatggttagcattctggcttcttccctcctgaaaaacgacatccccatgacgggacctctcgtggccggcggcctgcttacagtgtgctacgtcctgaccgggcggagcgccgatctggaactcgagcgcgctaccgacgtgaagtgggaggatcaagcggaaatttccggaagctctcccatcctgagcattacaatcgccgaggacggctccatgtctatcaaaaatgaagaggaggaacagacccttacaattctgatcagaacggggctcctggttattagcggactcttcccggtgtccatccctattaccgctgccgcctggtatctgtgggaggtcaagaagcagcgggctggcgtgctttgggatgttccctctcctccgcccgtggggaaagccgaactggaggacggagcgtaccgcatcaagcagaaaggcatcctgggctatagccaaattggggctggagtctacaaggaaggcacatttcacaccatgtggcacgtgacaagaggggccgtcctcatgcatcggggaaaacgcatcgagccttcctgggccgatgtgaagaaggacctgatttcttacggcgggggatggaaacttgagggcgaatggaaggagggcgaagaggttcaggtgctggctctcgaaccggggaaaaaccccagagccgtccagaccaagcctggactgttcaaaacgaataccggcacaatcggggcggtgagcctcgatttttcccccggaaccagcggctctcctattgttgaccggaaggggaaggtggtcggactgtatggcaacggcgtggtgacaagatccggggcttacgttagcgccatcgcccagaccgagaaatctatcgaggataatcccgaaattgaggacgatatcttccgcaagaaacggcttacaattatggacctgcaccctggagctggcaagacgaaaagatatctgccggccatcgtccgcgaagctattaagcgggggctcagaaccctgatccttgcccccacacgcgtggtggcggccgagatggaagaggctctgcggggactccctattagataccaaacccccgccatccgcgctgagcataccggccgggaaatcgtcgacctgatgtgtcacgccacattcacgatgagactcctgtcccctgtgcgggttcccaactataaccttattatcatggatgaggcccattttaccgacccggctagcattgcggcccgcgggtacatctccacaagagtggaaatgggcgaggctgccggaattttcatgaccgccacacctcccggctctcgggatccctttcctcagagcaatgctcccatcatggacgaggaacgcgagatccctgaaagatcctggaacagcgggcacgagtgggtcaccgatttcaagggaaaaacggtgtggtttgttccgtctattaaggccggcaatgacatcgcggcttgcctgcggaaaaacgggaagaaagtgattcagctgtccagaaagacattcgatagcgaatatgtcaagacccgcaccaatgactgggattttgtggttacaaccgacatctctgagatgggagccaacttcaaagccgagcgggtgattgatcccagacgctgtatgaagcctgtcatcctcacagacggcgaagaacgggtgatcctggctgggcccatgcctgtgacccacagctccgccgcgcaaagacgcggccggattggaagaaatcccaaaaacgaaaatgaccagtacatctacatgggcgagccgcttgaaaacgatgaggactgcgcccattggaaggaggctaaaatgctgctcgataatattaacacgcctgaagggatcattccctctatgtttgagcctgaacgcgagaaggtcgacgccatcgatggagaatatagactgcggggcgaggctcgcaaaacattcgttgacctgatgagaagaggggatctccccgtgtggcttgcctaccgcgtggctgccgagggaattaattatgcggacagacggtggtgttttgatggcgtcaagaacaatcagatcctggaagagaacgtggaagttgagatctggaccaaggagggggaacgcaagaagctgaaacctcgctggctcgacgcccggatttacagcgatcccctggctcttaaggagttcaaagagttcgccgctggcagaaagtccctgacactcaacctgatcaccgagatgggacgcctgccgacgtttatgacccagaaggcccgggacgccctcgataatcttgctgtgctgcacacagcggaagccggcgggagagcttataaccatgccctgtctgagctccctgagaccctggaaacacttctgctcctgaccctgctcgccacagtcaccggaggcattttcctttttctgatgagcgggaaaggagtgggcaagatgacgctgggcatgtgctgcatcattacagcttccatcctcctgtggcacgcccaaatccagccccactggattgcggccagcatcattcttgagttctttctgatcgttctcctgattcccgaacctgagaaacagcggaccccgcaggacaatcaactgacctacgtggtcatcgctatcctcacagtggtcgccgctaccatggccaacgaaatggggttccttgagaagaccaagaaggacctgggactgggctctattgcgacgcaggagcccgaatccaatatcctcgatattgacctgcgccctgccagcgcttggaccctttatgccgtggctacaacctttgttacacccatgctgagacattccatcgagaactctagcgtgaatgtgtccctcaccgccattgctaaccaggccacggtcctgatggggctgggaaagggctggcctctctctaaaatggatatcggggttccccttctggcgattggatgttacagccaggtgaatcctatcaccctgacagccgctctcctgcttctggtggcccactacgctatcattggcccgggcctccaagccaaggccacccgggaagcgcagaaacgcgctgccgctgggatcatgaagaaccccacagtcgacggaattaccgtgatcgatctggaccctattccctatgatcctaaattcgagaagcagctgggccaggttatgctccttatcctgtgcgtgacgcaagtcctgatgatgagaacaacctgggccctctgtgaagccctgacacttgctaccgggcccatctccaccctgtgggagggaaatccgggccggttttggaacacaacgattgccgtgagcatggcgaatatcttccgcgggtcttacctcgccggagctggcctgctgttttccattatgaagaacaccacaaataccagacggggcacagggaacatcggagagaccctcggcgaaaaatggaaaagccgccttaatgccctggggaaatctgagttccagatttataagaaatccggaatccaggaagtcgacagaacgctggctaaggagggcatcaaaagaggggaaacagatcatcacgccgtgagcagaggatctgcgaagctccgctggtttgttgaacggaacatggtgacccctgagggcaaggtcgtggacctgggctgcgggagaggaggctggagctactattgtgggggacttaaaaacgttcgcgaagtgaagggcctgaccaaagggggacccggccatgaggaacccgtccctatgtccacatacggctggaatctcgtgcggctgcaatctggggtggatgttttcttcacaccccctgagaagtgcgacaccctgctctgtgatattggagagagctccccgaaccccacgatcgaagccggcagaacccttcgcgtcctgagcctggtggagaattggctcaacaatgacacacagttttgcattaaagtgctgaacccttatatgccctccgtcatcgaaaagatggagacccttcagcggaagtacgggggagctctggttagaaatcctctctctcgcaacagcacacacgaaatgtactgggtgtccaatgccaccggcaacattgtgtctagcgtcaatatgatctcccggatgctgatcaacagattcacgatgaaacacaagaaagctacctatgagcccgacgtggatctggggtctggaacacgcaatattggcatcgagagcgaaattccgaacctcgacatcattggcaagcggatcgagaaaattaagcaggaacatgagacctcctggcactacgatcaagaccatccttataagacatgggcctaccacgggagctatgaaaccaaacagacaggatctgcttccagcatggttaatggcgtggtcagacttctgaccaagccctgggatgtggttcctatggtgacgcagatggccatgacagacaccaccccctttgggcagcaacgcgtcttcaaagagaaggtggatacaagaacgcaggagcctaaagaaggaaccaagaagctgatgaaaatcacagcggagtggctctggaaggaactgggcaaaaagaaaacaccccggatgtgtacacgcgaggagtttaccagaaaggtgcggtctaacgccgctcttggggccatcttcacagacgaaaacaaatggaagtccgctagagaggccgtcgaagatagccggttttgggagctggttgacaaggaacgcaatctccacctggagggaaaatgcgagacctgtgtgtacaacatgatgggcaagagagagaagaagctgggcgagttcgggaaagccaagggatctcgggcgatttggtatatgtggctcggcgctcgctttctggagttcgaggcccttgggtttctgaatgaagatcattggttctccagagagaacagcctctccggagtggagggcgaagggctgcacaaacttggctacatcctgcgggacgtcagcaaaaaggagggaggcgccatgtacgctgacgatacggccgggtgggacacccgcattacactcgaagatctgaaaaatgaggaaatggtgaccaaccatatggagggagagcacaagaaactggctgaagccatctttaagctcacatatcagaataaggttgtgagagtccagcggccgacccctcgcggcacggtgatggacattatctctagacgggatcaacgcgggagcggacaggttggcacatacgggctgaacaccttcacaaatatggaggcgcagcttatcagacaaatggaaggcgagggaattttcaaatccatccagcatctgaccgtgacggaggaaattgccgtccagaactggctcgctcgggtgggccgcgagagactgtctcggatggccatcagcggggacgattgcgttgtgaagccccttgacgatagatttgcttccgccctgaccgcgctcaatgacatgggaaaagtccgcaaggatattcagcaatgggaaccctctcggggctggaacgactggacacaggtgcctttctgcagccaccactttcatgagctgatcatgaaagatgggagagtcctggtggttccgtgtcgcaatcaggacgaactcatcggacgggccagaatttcccagggcgctgggtggtctctgaaggagaccgcctgccttggcaagagctatgctcaaatgtggtccctgatgtacttccaccgccgggacctcagactggccgctaacgccatctgtagcgcggtgccctctcattgggtccctacatcccgcaccacatggagcattcacgccaaacacgagtggatgaccacggaagatatgcttacagtgtggaatcgggtgtggatccaggagaacccctggatggaagacaagacccctgttgagtcttgggaagaggtgccctatctgggaaaaagagaggatcagtggtgcggctccctcattgggctgaccagccgcgctacatgggccaagaacatccagaccgccattaatcaagtccggtccctgatcggaaacgaagagtacacagactatatgccttctatgaaaagatttcggagagaagaggaagaggctggcgtgctctggtga

SEQ ID NO: 20203 - RNA, 9876 nt, synthetic construct
  misc_feature 1..9876: note = derived and/or modified CDS sequence (opt5) from DENV-2__FM210227__SS-prME
  source 1..9876: mol_type = other RNA
acagccggagtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaggaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccgtgaccgaggctgaactgacggggtatggaaccgtcacaatggagtgtagcccccggaccggccttgatttcaacgaaatggtgctgctccaaatggaggacaaagcctggctggttcaccgccagtggtttcttgatctgccgctcccttggctgcccggggctgacacacagggatctaattggatccagaaggagaccctggtgacgttcaagaaccctcatgccaaaaagcaagacgtcgtggttctcggctcccaggaaggggccatgcacacagctctgaccggcgcgacagagattcagatgagctccggaaatcttctgtttaccggccatctcaaatgcagactgcggatggataaacttcaactgaaagggatgtcttacagcatgtgtaccggaaagttcaagatcgtgaaagaaattgccgagacacagcacggcacgatcgtcatcagagtgcagtatgagggggacggatccccctgcaagattcccttcgaaatcatggatctcgagaaacgccatgtcctgggccggctgattaccgtgaaccctatcgttacagaaaaggacagcccggtgaacattgaggctgaacccccttttggggattcttacatcattatcggcgtcgagcccggacagctcaaactgaattggttcaagaagggctccagcatcgggcaaatgtttgagaccacaatgagaggagccaaacgcatggccattcttggcgacaccgcttgggatttcgggtctctgggaggcgtgtttacgagcatcgggaaggccctccaccaggttttcggcgcgatttacggagctgccttttccggcgtgtcttggacaatgaaaatcctgattggggccatcatcacctggattggaatgaacagccggtccaccagcctgtctgtctcccttgtgctcgtgggcgttatcacactgtatctgggggctatggtccaggccgacagcggatgtgtggtgtcttggaagaataaagaactcaagtgcggctccgggattttcatcaccgataacgtccacacatggacggagcagtacaagtttcaacctgaaagcccctccaaactggcttctgccattcagaaggcgcatgaggaaggcatctgtggaatcagaagcgtgacccgccttgagaatctgatgtggaaacagattacaccggagctcaaccacatcctgtccgaaaatgaggttaagctgaccattatgacaggcgacatcaaagggattatgcaggccggaaagcggtctcttagacctcaacccaccgaactcaaatatagctggaagacgtggggcaaggctaaaatgctgtccaccgagagccataaccagacattcctgatcgatgggcctgaaaccgccgagtgccccaatacaaaccgcgcttggaactctctcgaggtggaagactacggatttggcgtcttcaccacaaacatctggctgaaacttcgggagaaacaggacgtgttttgtgattccaagctgatgagcgccgcgattaaagacaatagagccgttcacgctgatatgggctattggatcgaatctaccctcaacgacacgtggaagatggagaaggcctccttcattgaggtgaaaagctgccactggcctaagtctcatacactgtggagcaatggggtcctggaatccgagatgatcattcccaagagcttcgctggaccggtgtctcagcacaactaccgccctggctatcatacccaaaccgccgggccctggcaccttggaaagctcgaaatggattttgacttctgtgagggcacaaccgttgtggtcacggaagattgcgggaaccggggaccctccctgagaacaaccacagccagcggcaaactgatcaccgagtggtgctgtcggtcctgcacactccctccgctgcgctacagaggcgaggacgggtgttggtacggaatggaaattcggccccttaaggagaaggaagagaatctggtgaactctctcgtgaccgctggccatgggcagatcgataattttagcctgggagtcctgggcatggcgcttttcctcgaagagatgctgagaacgcgcgttgggaccaaacacgccatcctgctcgtggctgtgtcctttgtcacactgattaccggaaacatgtctttccgggaccttggcagagtgatggttatggtgggcgccacaatgaccgatgacatcgggatgggagtcacgtatctggccctcctggctgcctttaaggtgcgccctacattcgcggctggcctgcttctgagaaaactcaccagcaaggagctgatgatggccacaattgggatcgccctcctgtcccagtctaccattcccgaaaccatccttgagctgacagatgctctcgccctgggaatgatgatcctgaaaattgttcggaatatggaaaagtaccaacttgcggtgacgatcatggctattagctgcgtccctaacgccgtgatcctgcagaatgcctggaaggtttcctgtaccattctcgctgccgtgagcgtctctcccctgctcctgacatccagccagcagaaagctgactggatccctcttgccctgaccatcaagggcctcaaccccacagcgatttttctgaccacgctgtctcgcacatccaaaaagagaagctggccgcttaatgaggccatcatggctgtggggatggtgtctattctggcctccagcctcctgaaaaacgacatccctatgaccggacccctcgtcgctggcggcctgcttaccgtttgctatgtgctgacagggcggtccgccgatctggaactcgagcgcgccaccgacgtgaagtgggaggatcaagctgaaattagcggatctagccctatcctgtccattacaatctctgaggacggcagcatgtccatcaaaaatgaagaggaggaacagacgcttaccattctgatcagaacagggctcctggtcatttctggactcttccccgtgagcatcccgattaccgcggccgcttggtacctgtgggaggttaagaagcagcgggccggcgtgctttgggatgtcccttctccccctcccgtggggaaagccgaactggaggacggagcttatcgcatcaagcagaaaggcatcctgggctacagccaaattggggccggagtttataaggaaggcacatttcacaccatgtggcatgtgacgagaggggcggtcctcatgcaccggggaaaacgcatcgagcccagctgggctgatgtgaagaaggacctgatttcctacggcgggggatggaaacttgagggcgaatggaaggagggcgaagaggtccaggtgctggccctcgaacctgggaaaaacccgagagccgttcagaccaagcccggactgttcaaaacaaataccggcacaatcggggctgtgagcctcgatttttctcctggaacctccggcagccccattgtcgaccggaaggggaaggtggttggactgtacggcaacggcgtggtcacaagatctggggcctatgtgtccgcgatcgctcagacggagaaaagcatcgaggataatcctgaaattgaggacgatatcttccgcaagaaacggcttaccattatggacctgcatcccggagccggcaagacaaaaagatacctgcctgccatcgtgcgcgaagctattaagcgggggctcagaaccctgatccttgccccgacccgcgttgtcgctgccgagatggaagaggcgctgcggggactccccattagatatcaaacccctgccatccgcgctgagcacacgggccgggaaatcgtggacctgatgtgtcatgccaccttcacaatgagactcctgtcccccgtgcgggtccctaactacaaccttattatcatggatgaggctcactttaccgaccccgcctctattgccgctcgcgggtatatcagcacaagagtggaaatgggcgaggcggccggaattttcatgaccgctacgccgcctggctcccgggatccctttccccagagcaatgcccctatcatggacgaggaacgcgagatccccgaaagatcttggaacttcgggcacgagtgggttacagattttaagggaaaaaccgtgtggttcgtcccttccattaaggccggcaatgacatcgctgcctgcctgcggaaaaacgggaagaaagtgattcagctgagcagaaagacctttgattctgaatacgttaagacacgcaccaatgactgggatttcgtggtcacaaccgacatcagcgagatgggagcgaactttaaagctgagcgggtgattgatccgagacgctgtatgaagcccgttatcctcacggacggcgaagaacgggtgatcctggccgggcctatgcccgtcacacattcctctgccgctcaaagacgcggccggattggaagaaatcctaaaaacgaaaatgaccagtatatctacatgggcgagccccttgaaaacgatgaggactgcgcccactggaaggaggcgaaaatgctgctcgataatattaacaccccggaagggatcattcctagcatgttcgagcccgaacgcgagaaggtggacgccatcgatggagaatacagactgcggggcgaggctcgcaaaacatttgtggacctgatgagaagaggggatctccctgtctggcttgcctatcgcgttgctgccgagggaattaattacgctgacagacggtggtgtttcgatggcgtgaagaacaatcagatcctggaagagaacgtggaagtcgagatctggaccaaggagggggaacgcaagaagctgaaaccccgctggctcgacgcccggatttattccgatcctctggcgcttaaggagttcaaagaatttgccgctggcagaaagtctctgacgctcaacctgatcaccgagatgggacgcctgcccacattcatgacccagaaggcccgggacgctctcgataatcttgccgtgctgcatacagccgaagctggcgggagagcgtacaaccacgccctgagcgagctcccggagaccctggaaacacttctgctcctgaccctgctcgctacggttacaggaggcatttttcttttcctgatgtccgggaaaggagtgggcaagatgaccctgggcatgtgctgcatcattaccgccagcatcctcctgtggtatgcccaaatccagcctcactggattgctgcctctatcattcttgagtttttcctgatcgtcctcctgattcccgaacccgagaaacagcggacacctcaggacaatcaactgacctacgtggttatcgcgatcctcacagtggtcgccgctacgatggccaacgaaatggggtttcttgagaagaccaaaaaggacctgggactgggctccgtggctacacaggagccggaaagcaatattctcgatatcgacctgcgccccgcctccgcgtggaccctttatgccgtcgctacaaccttcgtgacgcctatgctgagacattctattgagaacagctccgttaatgtgtctctcaccgccatcgctaaccaggccacagtgctgatggggctgggaaagggctggcccctcagcaaaatggatattggggtccctcttctggctatcggatgttactcccaggttaatcccattaccctgacagccgcgctcctgcttctggtggcccactacgctatcatcggccctggcctccaagccaaggctacccgggaagcccagaaacgcgccgcggctgggattatgaagaacccgacggtggacggaatcacagtcattgatctggaccccatcccttatgatcccaaatttgagaagcagctgggccaggtgatgctccttattctgtgcgttacccaagtgctgatgatgagaacaacctgggccctctgtgaagctctgacccttgccacagggcctatcagcacgctgtgggagggaaatcccggccggttctggaacaccacaatcgccgtctctatggctaatatttttcgcgggtcctacctcgccggagcgggcctgctgttcagcatcatgaagaacaccacaaataccagacggggcacggggaacattggagagacactcggcgaaaaatggaagtctcgccttaatgccctggggaaatccgagtttcagatctataagaaaagcggcattcaggaagtggacagaaccctggctaaggagggcatcaaaagaggggagaccgatcatcacgccgtctctagaggaagcgctaagctccgctggttcgtggaacggaacatggttacaccggagggcaaggtggtcgacctgggctgcgggagaggaggctggtcctactattgtgggggacttaaaaacgtgcgcgaagttaagggcctgaccaaagggggacctggccatgaggaacccatccccatgtctacatacggctggaatctcgtgcggctgcaaagcggggtcgatgtgttctttacgcctcccgagaagtgcgacaccctgctctgtgatattggagagtccagccctaacccgacaatcgaagccggcagaacccttcgcgtgctgtccctggttgagaattggctcaacaatgacacacagttctgcattaaagtcctgaacccctatatgccttctgtgatcgaaaagatggagacccttcagcggaagtacgggggagcgctggtgagaaatcccctcagccgcaactccacgcacgaaatgtactgggtctctaatgccaccggcaacattgttagctccgtgaatatgatctctcggatgctgatcaacagatttacaatgaaacacaagaaagctacctatgagcctgacgtggatctggggagcggaacacgcaatattggcatcgagtccgaaattcccaacctcgacatcattggcaagcggatcgagaaaattaagcaggaacatgagaccagctggcactacgatcaagaccatccgtataagacatgggcctaccacgggtcttatgaaaccaaacagacgggatccgctagctctatggtcaatggcgtggttagacttctgacaaagccttgggatgtggtccccatggtgacccagatggccatgaccgacacaacgcctttcgggcagcaacgcgtttttaaagagaaggtggataccagaacacaggagcccaaagaaggaaccaagaagctgatgaaaatcacagctgagtggctctggaaggaactgggcaaaaagaaaacccctcggatgtgtacacgcgaggagttcaccagaaaggtccggtccaacgccgcgcttggggccatctttacggacgaaaacaaatggaagtccgctagagaggccgtggaagattctcggttctgggagctggtggacaaggaacgcaatctccacctggagggaaaatgcgagacctgtgtctacaacatgatgggcaagagagagaagaagctgggcgagtttgggaaagctaagggatcccgggccatttggtatatgtggctcggcgcccgcttcctggaatttgaggcgcttgggttcctgaatgaagatcattggtttagcagagagaactccctcagcggagttgagggcgaagggctgcacaaacttggctacatcctgcgggacgtgtctaaaaaggagggaggcgctatgtacgccgacgatacagccgggtgggacacccgcattacactcgaagatctgaaaaatgaggaaatggtgaccaaccatatgggaggcgagcacaagagactggctgaggccatcttcaaactcacgtatcagaataaggtcgtgcgggttcagcgccccacaccgagagggaccgtgatggacattatcagccggcgcgatcaaagaggatccggccaggtcgggacatacggcctgaacaccttcacgaatatggaagctcagcttatccggcaaatggagggagaaggcatttttaagtctatccagcatctgaccgtgacagaggagattgccgttcagaactggctcgcgcgcgtggggagagaacggctgagcagaatggccatctccggagacgattgcgtcgtgaaacctcttgacgatcgcttcgcttctgccctgaccgctctcaatgacatgggcaaggttcggaaagatattcagcaatgggagcccagcaaggggtggaacgactggacacaggtgcccttttgctcccaccacttccatgatctgatcatgaaagacggaagagtcctggtggtcccttgtcgcaatcaggacgaactcatcggccgggccagaatttctcagggggcgggctggagcctgaaggagaccgcctgccttggaaagtcctatgctcaaatgtggagcctgatgtactttcaccgccgggatctcagactggccgctaacgccatctgttctgctgtgccgtcccattgggttcccacaagccgcaccacgtggtctattcacgccaaacacgaatggatgacaaccgaggacatgcttaccgtgtggaatcgggtctggatccaggagaacccttggatggaagataagacacccgtggagtcctgggaagaggtgccttatctgggcaaaagagaagaccagtggtgcgggagcctcattggactgacctcccgcgcgacatgggccaagaacatccagacggctattaatcaagttcggtctctgatcggcaacgaggagtacaccgattatatgcccagcatgaaaagattccggagagaagaggaagaggccggggtgctctggtga

SEQ ID NO: 20204 - RNA, 9876 nt, synthetic construct
  misc_feature 1..9876: note = derived and/or modified CDS sequence (opt5) from DENV-2__FM210204__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaaggcgggattgtgacatgcgcgatgtttacgtgcaaaaagaatatggaagggaaaatcgtccagcctgagaacctcgaatacaccattgttatcacaccccacagcggggaggagcatgccgtgggaaatgacaccggcaagcacggcaaagaaatcaagattacacctcagtcttccgtgaccgaggctgaactgacggggtatggaaccgtcacaatggagtgtagcccccggaccggccttgatttcaacgaaatggtgctgctccaaatggaggacaaagcctggctggttcaccgccagtggtttcttgatctgccgctcccttggctgcccggggctgacacacagggatctaattggatccagaaggagaccctggtgacgttcaagaaccctcatgccaaaaagcaagacgtcgtggttctcggctcccaggaaggggccatgcacacagctctgaccggcgcgacagagattcagatgagctccggaaatcttctgtttaccggccatctcaaatgcagactgcggatggataaacttcaactgaaagggatgtcttacagcatgtgtaccggaaagttcaagatcgtgaaagaaattgccgagacacagcacggcacgatcgtcatcagagtgcagtatgagggggacggatccccctgcaagattcccttcgaaatcatggatctcgagaaacgccatgtcctgggccggctgattaccgtgaaccctatcgttacagaaaaggacagcccggtgaacattgaggctgaacccccttttggggattcttacatcattatcggcgtcgagcccggacagctcaaactgaattggttcaagaagggctccagcatcgggcaaatgtttgagaccacaatgagaggagccaaacgcatggccattcttggcgacaccgcttgggatttcgggtctctgggaggcgtgtttacgagcatcgggaaggccctccaccaggttttcggcgcgatttacggagctgccttttccggcgtgtcttggacaatgaaaatcctgattggggccatcatcacctggattggaatgaacagccggtccaccagcctgtctgtctcccttgtgctcgtgggcgttatcacactgtatctgggggctatggtccaggccgacagcggatgtgtggtgtcttggaagaataaagaactcaagtgcggctccgggattttcatcaccgataacgtccacacatggacggagcagtacaagtttcaacctgaaagcccctccaaactggcttctgccattcagaaggcgtatgaggaaggcatctgtggaatcagaagcgtgacccgccttgagaatctgatgtggaaacagattacaccggagctcaaccatatcctgtccgaaaatgaggttaagctgaccattatgacaggcgacatcaaagggattatgcaggccggaaagcggtctcttagacctcaacccaccgaactcaaatacagctggaagacgtggggcaaggctaaaatgctgtccaccgagagccacaaccagacattcctgatcgatgggctcgaaaccgccgagtgccctaatacaaaccgcgcttggaactctctggaggtggaagactatggatttggcgtcttcaccacaaacatctggcttaagctgcgggagaaacaggacgtgttttgtgattccaagctcatgagcgccgcgattaaagacaatagagccgttcatgctgatatgggctactggatcgaatctgccctgaacgacacctggaagatggagaaggcttccttcattgaggtgaaaagctgccactggcccaagtctcacacgctgtggagcaatggggtccttgaatccgagatgatcattcctaagagcttcgccggacccgtgtctcagcataactatcgcccgggctaccacacacaaaccgccgggccttggcatctcggaaagctggaaatggattttgacttctgtgagggcaccacagttgtggtcaccgaagattgcgggaaccggggaccctccctgagaacgacaaccgctagcggcaaactcatcacagagtggtgctgtcggtcctgcaccctgccccctcttcgctacagaggcgaggacgggtgttggtatggaatggaaattcggccgctgaaggagaaggaagagaatctcgtgaactctctggtgacagcgggccacgggcagatcgataattttagcctgggagtccttggcatggccctcttcctggaagagatgctgagaacccgcgttgggacgaaacatgctatcctcctggtggccgtgtcctttgtcacccttattacaggaaacatgtctttcaaggacctgggccgggtgatggttatggtgggcgccaccatgacagatgacatcgggatgggagtcacctacctcgctctgctggccgcgtttaaagtgagacccacgttcgctgccggccttctgctccgcaagctgacaagcaaagagctcatgatggccaccattgggatcgctctgctttcccagtctacaattcctgaaaccatcctggagctcaccgatgccctggcgctgggaatgatggttcttaagatcgtgagaaatatggaaaagtatcaactggctgtcacaattatggccatcagctgcgtgcccaacgccgttattctccagaatgcttggaaagtgtcctgtacgatcctggccgctgtcagcgtgtctcctctcctgcttacctccagccagcagaaggccgactggattcccctggcgctcacaatcaaaggcctgaaccctaccgccatctttctgacaaccctttctcggacgtccaagaaacgcagctggcccctgaatgaggctattatggccgtggggatggtctctatcctcgcttccagcctgctcaagaacgacattccgatgacaggacctctggttgccggcggccttctgaccgtgtgctacgtgctgaccgggagatccgccgatctcgaactggagcgggctacagacgtcaaatgggaggatcaagcggaaatcagcggatctagccccattctttccatcaccatttctgaggacggcagcatgtccatcaagaatgaagaggaggaacagacactgacgatcctcattcgcaccgggctgctcgtgatctctggactgttccctgttagcattcccatcacagccgctgcctggtatctttgggaggtgaagaaacagagagccggcgtcctgtgggatgtgccgtcccctccccctgttgggaaggctgaactggaggacggagcctaccggattaaacagaagggcatcctcggctattctcaaatcggggcgggagtgtacaaagaaggcacctttcacacaatgtggcacgtcacccgcggggctgtgctgatgcatagaggaaagcggattgagcccagctgggccgatgtcaagaaagaccttatctcctacggcgggggatggaagctggagggcgaatggaaagagggcgaagaggtgcaggttctcgccctggaacccgggaagaaccctcgcgctgtgcagacgaaaccgggactcttcaagaccaatacaggcaccattggggccgtcagcctggatttttctcccggaacatccggcagccctatcgtggacagaaaggggaaagttgtgggactttatggcaacggcgtcgtgacccggtctggggcgtacgtgtccgctattgcccagacagaaaagagcatcgaggataatcccgaaatcgaggacgatattttccgcaagaagcgcctgacgatcatggacctgcaccctggagccggcaaaaccaagcggtatctccccgctattgttagagaagccatcaagcgcgggctgcggacacttattctggctcctaccagagtcgtggccgcggagatggaagaggccctccgcggactgccgatccggtaccaaacccccgctattagagccgagcatacaggccgcgaaatcgtggacctcatgtgtcacgctacgttcaccatgcggctgctttcccctgtcagagtgcccaactataacctgatcattatggatgaggcccattttacagaccctgcctctatcgctgcgcgggggtacattagcacccgcgttgaaatgggcgaggccgctggaatcttcatgacagccacacccccgggctccagagatccttttccccagagcaatgcccccattatggacgaggaacgggagatccctgaacgctcttggaactccgggcacgagtgggtgacggatttcaaaggaaagacagtctggtttgtgcccagcatcaaagctggcaatgacattgccgcgtgcctgagaaagaacgggaaaaaggttatccagctctctcggaagaccttcgatagcgaatatgtgaaaaccagaacaaatgactgggattttgtcgtgaccacagacatttccgagatgggagctaacttcaaggccgagcgcgttatcgatcctcggagatgtatgaaaccggtgattctgaccgacggcgaagagagagtcatccttgccgggcccatgcctgtgacgcactctagcgctgcccaacggagaggccgcatcggacggaatcccaagaacgaaaatgaccagtacatttacatgggcgagcctctggaaaacgatgaggactgcgcgcattggaaagaggccaagatgctcctggataatatcaacacacccgaagggattatcccgtccatgtttgagcctgaaagagagaaagtggacgctattgatggagaatatcgcctgagaggcgaggcccggaagaccttcgtcgacctcatgcgcagaggggatcttcccgtttggctggcttaccgggtggccgctgagggaatcaattatgccgaccgcagatggtgttttgatggcgtgaagaacaatcagattctggaagagaacgtcgaagtggagatctggacaaaagagggggaacggaagaaactcaagcctagatggctggacgcgcgcatctactctgatccccttgccctgaaagagttcaaggagttcgctgccggcagaaagagcctcaccctgaacctgattacggagatgggaagactccctacctttatgacacagaaagctcgcgacgcccttgataatctggccgttctgcacaccgctgaagcgggcgggcgggcctataaccatgctctctccgagctgcccgagacacttgaaaccctgctcctgctgacactccttgccaccgtgacgggaggcatcttcctgtttctgatgagcgggaagggagtcggcaaaatgacactcggcatgtgctgcattatcaccgcctctattctgctttggtacgctcaaatccagccgcactggatcgccgcgtccattatcctggagttctttctcattgtgctgctgatccctgaacccgagaagcagagaacaccccaggacaatcaactcacatatgttgtgattgccatccttaccgtcgtggctgccacaatggctaacgaaatggggttcctggagaaaacgaagaaggacctgggactcggcagcgtcgccacccaggagcctgaatccaatatcctggatattgaccttcggccggcgtctgcctggacactgtacgctgtggccaccacatttgttacccccatgctccgccacagcatcgagaactcctctgtgaatgtgagcctgacggctattgccaaccaggctaccgtcctgatggggctcggaaaaggctggcctctttccaagatggatatcggggttcccctgctggccattggatgttacagccaggtgaatcctatcacactcaccgcggccctgcttctgctcgtggctcattatgccattatcggccccggcctgcaagctaaagccacaagagaagcccagaagcgggcggctgccgggatcatgaaaaaccctaccgtcgacggaattacggtgatcgatctggacccgattccctacgatcctaagttcgagaagcagctcggccaggttatgcttctgatcctgtgcgtgacacaagtcctcatgatgcgcaccacatgggctctgtgtgaagcccttaccctggccaccgggcccatttctacactctgggagggaaatcctggcagattttggaacacgaccatcgctgtgtccatggccaatatcttccgggggagctatctggcgggagccggcctgctcttttctattatgaaaaacacaaccaatacacgcagaggcaccgggaacatcggagagacgcttggcgaaaagtggaaatcccggctgaatgctctgggaaagagcgagttccagatttacaaaaagtctggaatccaggaagtcgaccgcacactcgccaaagagggcattaagagaggggagaccgatcaccatgctgtgagccggggatccgccaagctgagatggtttgttgaacgcaacatggtgacccccgagggcaaagtcgtggaccttggctgcgggcggggaggctggtcttattactgtgggggactgaagaacgttagagaagtgaaaggcctcacaaaagggggaccgggccacgaggaacctatccccatgagcacctatggctggaatctggtccgcctgcaatccggggtggatgtgttcttcacaccccctgagaaatgcgacacgctcctttgtgatatcggagagagctcccccaaccctaccattgaagcgggccggacactgagagttctgtctctcgtcgagaattggctgaacaatgacacccagttttgcatcaaggtgcttaacccgtacatgccccctgtgattgaaaagatggagacactgcagcgcaaatacgggggagccctcgtccggaatcccctgagcagaaactccacccatgaaatgtattgggtttctaatgctacgggcaacatcgtgagctccgtgaatatgatttctcgcatgctgatcaaccggttcaccatgaagcacaaaaaggccacatacgagcctgacgtcgatctcgggagcggaaccagaaatatcggcattgagtccgaaatccccaaccttgacattatcggcaaacgcattgagaagatcaagcaggaacacgagacaagctggcattatgatcaagaccacccgtacaaaacctgggcttatcatgggtcttacgaaacaaagcagaccggatccgccagctctatggtgaatggcgttgtgcggctgctgacgaaaccttgggatgtcgtgcccatggttacacagatggctatgaccgacaccacaccttttgggcagcaaagagtgttcaaggagaaagtcgatacgcgcacccaggagcccaaggaaggaacaaagaaactcatgaagattaccgccgagtggctgtggaaagaacttggcaagaaaaagacacctagaatgtgtacccgggaggagtttacacgcaaagtgagatccaacgcggccctgggggctatcttcaccgacgaaaacaagtggaaaagcgcccgggaggctgtggaagattctagattttgggagctcgtcgacaaagaacggaatctgcacctggagggaaagtgcgagacgtgtgtttataacatgatgggcaaacgcgaaaagaaactcggcgagttcgggaaggccaagggatccagagccatctggtacatgtggctgggcgcgcggtttcttgagttcgaggctctggggtttctcaatgaagatcactggttcagccgcgagaactccctgagcggagtggagggcgaagggcttcataaactgggctacattctcagagacgtgtctaagaaagagggaggcgccatgtatgccgacgataccgctgggtgggacacacggatcaccctggaagatctgaagaatgaggaaatggtcacaaaccacatggagggagagcataaacgcctcgccgaagctatttttaagctgacctaccagaataaggtggttagagtgcagcggcccacgccgcgcggcacagtcatggacatcattagcagacgggatcaacgcgggtccggacaggtgggcacctatgggcttaacacattcaccaatatggaggcccagctgatcagacaaatggaaggcgagggaatcttcaaatctattcagcacctcacggttaccgaggaaatcgcggtgcagaactggctggcccgggtcggccgcgagagacttagccggatggctatttccggggacgattgcgtggttaagcctctggacgatagatttgcctctgctctcacagccctgaatgacatgggaaaagtgcgcaaggatatccagcaatgggaacccagcaaaggctggaacgactggacccaggtccccttctgctcccatcactttcacgatctgattatgaaggacgggcgggtgctcgtcgtgccttgtagaaatcaggacgagctgatcggacgcgcgcggatctctcagggcgccgggtggagccttaaggaaacagcttgcctgggcaaatcctacgcccaaatgtggagcctcatgtatttccatagacgcgatctgcggcttgctgccaacgctatttgttctgccgttccgtcccactgggtgcccaccagcagaacaacctggtctatccatgcgaagcacgagtggatgacgacagaggacatgctgaccgtctggaatcgcgtgtggattcaggaaaacccttggatggaggataaaacccccgtggaatcctgggaggaagttccttacctcggaaagcgggaggaccagtggtgcggcagcctgatcgggctgacatccagagccacctgggctaaaaacattcagacagccatcaatcaagtgcgctctctcattggaaacgaggaatatacggattacatgcccagcatgaagcggtttagacgggaggaagaggaagccggcgtcctgtggtga

SEQ ID NO: 20205 - RNA, 9876 nt, synthetic construct
  misc_feature 1..9876: note = derived and/or modified CDS sequence (opt5) from DENV-2__FM210230__SS-prME
  source 1..9876: mol_type = other RNA
accgctggcgtgatcattatgctgatccccaccgctatggccttccacctcacgacccggaacggggagcctcatatgattgtcggacggcaggaaaagggcaaaagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtgacggtcagctttgtgaccctgattacaggaaacatgtccttccgggaccttggcagagttatggtgatggtcggcgccgccatgaccgatgacatcgggatgggagtgacatacctggctctcctggccgcgtttaaggttcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctatgctgctcacgtcttcccagcagaaagccgactggattcccctggcgcttaccatcaagggcctgaacccgacagccatctttctcaccacactgagccgcacctctaaaaagagatcctggcctctgaatgaggctattatggccgtcgggatggttagcatccttgcttcttccctgctcaaaaacgacattcccatgacgggacctctggtggccggcggcctcctgacagtgtgctacgtccttaccgggcggagcgccgatctggaactggagcgcgctaccgacgtgaagtgggaggatcaagcggaaatctccggaagctctcccattctcagcatcacaattgccgaggacggctccatgtctatcaaaaatgaagaggaggaacagaccctgacaatccttattagaacggggctgctcgttatcagcggactgttcccggtgtccattcctatcaccgctgccgcctggtatctctgggaggtcaagaagcagcgggctggcgtgctgtgggatgttccctctcctccgcccgtggggaaagccgaacttgaggacggagcgtaccgcattaagcagaaaggcatcctgggctatagccaaatcggggctggagtctacaaggaaggcacatttcacaccatgtggcacgtgacaagaggggccgtcctgatgcatcggggaaaacgcattgagccttcctgggccgatgtgaagaaggacctcatctcttacggcgggggatggaaactggagggcgaatggaaggagggcgaagaggttcaggtgcttgctctggaaccggggaaaaaccccagagccgtccagaccaagcctggactcttcaaaacgaataccggcacaattggggcggtgagcctggatttttcccccggaaccagcggctctcctatcgttgaccggaaggggaaggtggtcggactctatggcaacggcgtggtgacaagatccggggcttacgttagcgccattgcccagaccgagaaatctatcgaggataatcccgaaatcgaggacgatattttccgcaagaaacggctgacaatcatggaccttcaccctggagctggcaagacgaaaagatatctgccggccattgtccgcgaagctatcaagcgggggctgagaaccctcattctggcccccacacgcgtggtggcggccgagatggaagaggcccttcggggactgcctatcagataccaaacccccgccattcgcgctgagcataccggccgggaaatcgtcgacctcatgtgtcacgccacattcacgatgagactgctctcccctgtgcgggttcccaactataacctgatcattatggatgaggcccattttaccgacccggctagcatcgcggcccgcgggtacatttccacaagagtggaaatgggcgaggctgccggaatcttcatgaccgccacacctcccggctctcgggatccctttcctcagagcaatgctcccattatggacgaggaacgcgagatccctgaaagatcctggaacagcgggcacgagtgggtcaccgatttcaagggaaaaacggtgtggtttgttccgtctatcaaggccggcaatgacattgcggcttgccttcggaaaaacgggaagaaagtgatccagctgtccagaaagacattcgatagcgaatatgtcaagacccgcaccaatgactgggattttgtggttacaaccgacatttctgagatgggagccaacttcaaagccgagcgggtgatcgatcccagacgctgtatgaagcctgtcattctgacagacggcgaagaacgggtgatcctcgctgggcccatgcctgtgacccacagctccgccgcgcaaagacgcggccggatcggaagaaatcccaaaaacgaaaatgaccagtacatttacatgggcgagccgctggaaaacgatgaggactgcgcccattggaaggaggctaaaatgcttctggataatatcaacacgcctgaagggattatcccctctatgtttgagcctgaacgcgagaaggtcgacgccattgatggagaatatagactccggggcgaggctcgcaaaacattcgttgacctgatgagaagaggggatctgcccgtgtggctcgcctaccgcgtggctgccgagggaatcaattatgcggacagacggtggtgttttgatggcgtcaagaacaatcagattcttgaagagaacgtggaagttgagatctggaccaaggagggggaacgcaagaagctgaaacctcgctggctggacgcccggatctacagcgatcccctcgctctgaaggagttcaaagagttcgccgctggcagaaagtcccttacactgaacctcattaccgagatgggacgcctgccgacgtttatgacccagaaggcccgggacgccctggataatctcgctgtgcttcacacagcggaagccggcgggagagcttataaccatgccctgtctgagctgcctgagaccctcgaaacactgcttctgctcaccctgctggccacagtcaccggaggcatcttcctctttcttatgagcgggaaaggagtgggcaagatgacgctgggcatgtgctgcattatcacagcttccattctgctctggtacgcccaaatccagccccactggatcgcggccagcattatcctggagttctttcttattgttctgctcatccccgaacctgagaaacagcggaccccgcaggacaatcaactgacctatgtggtcattgctatcctgacagtggtcgccgctaccatggccaacgaaatggggttcctcgagaagaccaagaaggaccttggactgggctctatcgcgacgcaggagcccgaatccaatattctggatatcgacctccgccctgccagcgcttggaccctgtacgccgtggctacaacctttgttacacccatgcttagacactccattgagaactctagcgtgaatgtgtccctgaccgccatcgctaaccaggccacggtcctcatggggctgggaaagggctggcctctgtctaaaatggatattggggttcccctccttgcgatcggatgttacagccaggtgaatcctattaccctgacagccgctctgctcctgcttgtggcccattatgctatcatcggcccgggcctgcaagccaaggccacccgggaagcgcagaaacgcgctgccgctgggattatgaagaaccccacagtcgacggagtgaccgttatcgatctcgaccctattccctacgatcctaaattcgagaagcagctgggccaggtgatgctgctcatcctttgcgtcacgcaagtgctgatgatgagaacaacctgggccctgtgtgaagccctcacactggctaccgggcccatttccaccctttgggagggaaatccgggccggttttggaacacaacgatcgccgtcagcatggcgaatatcttccgcgggtcttatctggccggagctggcctcctgttttccattatgaagaacaccacaaataccagacggggcacagggaacatcggagagaccctgggcgaaaaatggaaaagccgcctcaatgcccttgggaaatctgagttccagatttacaagaaatccggaatccaggaagtggacagaacgctggctaaggagggcattaaaagaggggaaacagatcaccatgccgttagcagaggatctgcgaagctgcgctggtttgtggaacggaacatggtcacccctgagggcaaggtggttgacctcggctgcgggagaggaggctggagctattactgtgggggactgaaagatgtgcgcgaagtcaagggccttaccaaagggggacccggccacgaggaacccatccctatgtccacatatggctggaacctggtgcggctccaatctggggtggacgttttcttcacaccccctgagaagtgcgataccctgctgtgtgacatcggagagagctccccgaatcccacgattgaagccggcagaaccctccgcgtccttagcctggtggagaactggctgaataacgacacacagttttgcatcaaagtgctcaatccttacatgccctccgtcattgaaaagatggagaccctgcagcggaagtacgggggagctcttgttagaaaccctctgtctcgcaatagcacacatgaaatgtattgggtgtccaacgccaccggcaatatcgtgtctagcgtcaacatgatttcccggatgctcatcaatagattcacgatgaaacacaagaaagctacctacgagcccgatgtggacctggggtctggaacacgcaacatcggcattgagagcgaaatcccgaatctggatattatcggcaagcggattgagaaaatcaagcaggaacacgagacctcctggcattatgaccaagatcacccttacaagacatgggcctatcatgggagctacgaaaccaaacagacaggatctgcttccagcatggttaacggcgtggtcagactccttaccaagccctgggacgtggttcctatggtgacgcagatggccatgacagataccaccccctttgggcagcaacgcgtcttcaaagagaaggtggacacaagaacgcaggagcctaaagaaggaaccaagaagctgatgaaaattacagcggagtggctgtggaaggaactcggcaaaaagaaaacaccccggatctgtacacgcgaggagtttaccagaaaggtgcggtctaatgccgctctgggggccatcttcacagatgaaaacaaatggaagtccgctagagaggccgtcgaagacagccggttttgggagcttgttgataaggaacgcaacctgcacctcgagggaaaatgcgagacctgtgtgtataatatgatgggcaagagagagaagaagctgggcgagttcgggaaagccaagggatctcgggcgatttggtacatgtggctgggcgctcgctttctcgagttcgaggccctggggtttcttaacgaagaccactggttctccagagagaatagcctgtccggagtggagggcgaagggctccataagctgggctacatccttcgggacgtcagcaaaaagggaggcggggccatgtatgctgatgacacggccggatgggatacccgcattacactggaggacctcaaaaacgaagagatggtgaccaatcacatggaaggcgagcataagaaactggctgaggccatctttaagctgacataccagaacaaggttgtgagagtccagcggccgacccctcgcgggacggtgatggatattatctctagacgggaccaacgcggaagcggccaggttgggacatatggcctcaataccttcacaaacatggaagcgcagctgatcagacaaatggagggagaaggcgtgttcaaatccattcagcggcttaccgtcacggaggagatcgccgtgcagaattggctggctcgcgttgggagagaacggctctctagaatggccattagcggagatgactgcgtggtcaagcccctggatgaccgctttgcttccgcccttaccgcgctgaacgatatgggcaaagtgcggaaggacatccagcaatgggagccctctagagggtggaatgattggacacaggtccctttctgcagccaccattttcacgaactcattatgaaagacggacgcgtgctggttgtgccgtgtcggaaccaggacgagctgatcggcagagcccgcatctcccagggggctggctggtctctcaaggaaaccgcctgcctgggaaagagctacgctcaaatgtggtcccttatgtatttccaccggagagatctgcgcctcgccgctaatgccatttgtagcgcggtcccctctcattgggtgcctacatcccggaccacatggagcatccacgccaaacatgagtggatgaccacggaggacatgctgacagtgtggaacagagtttggattcaggaaaatccctggatggaggataagacccctgtggaatcttgggaggaagtcccctaccttggcaaacgcgaggaccagtggtgcgggtccctgatcggactcaccagccgggctacatgggccaagaacattcagaccgccatcaaccaagtgagatccctgattggcaatgaggaatatacagattacatgccttctatgaaacggtttagacgcgaggaagaggaagctggggttctgtggtga

SEQ ID NO: 20206 - RNA, 9876 nt, synthetic construct
  misc_feature 1..9876: note = derived and/or modified CDS sequence (opt5) from DENV-2__KC762665__SS-prME
  source 1..9876: mol_type = other RNA
accgccggcatcattatcatgatgattcccacagtgatggctttccacctgacgaccagaaacggggagcctcatatgatcgtcagccggcaggaaaaggggaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcatggatctggaaaagcgccacgtgctcggacggctgattaccgtcaatcctatcgtgacagagaaagactctccggttaacattgaagccgagcccccttttggcgattcctacatcattatcggggtggaacccggccagctgaagctcagctggttcaaaaagggatctagcattggccagatgtttgagaccacaatgagaggggctaagcgcatggccatcctgggagacaccgcctgggatttcggctcccttgggggagtctttacgtctatcggcaaagctctgcatcaagtgttcggggccatttatggcgcggcttttagcggagtgtcctggacaatgaagatcctcattggcgttgtcatcacctggattgggatgaatagccggtctacctccctgagcgtgtctctggtgcttgtcggagtggttacactctacctgggcgtgatggtccaggccgactccgggtgtgtggttagctggaaaaacaaggagctgaaatgcggatccggcatcttcatcaccgataatgtgcacacatggacggaacagtataagtttcagcctgagtctcccagcaagctcgcctccgctattcaaaaagcccacgaagaggggatctgtggcattagatctgtcacccgcctggaaaaccttatgtggaagcagatcacaccggagctgaatcatattctcagcgagaacgaagtgaaactgaccatcatgacaggagacatcaagggcattatgcaggctgggaaacggtccctgagacctcagcccaccgagcttaagtacagctggaaaacgtggggaaaggccaagatgctctctaccgaactgcacaatcatacattcctgatcgatggccctgagaccgcggaatgccccaacgccaatcgcgcttggaactccctcgaggttgaggactatgggtttggagtgttcacaaccaatatttggctgaaacttaaggaacggcaagatgccttttgtgacagcaaactgatgtctgctgccatcaaggacaacagagcggtccacgccgatatgggctactggattgagtccgctctcaacgacacatggaaaatcgaaaaggccagcttcatcgaggtgaagtcttgccactggcctaaaagccataccctgtggtccaatggcgtgctggagagcgaaatgattatccccaagaacttcgctgggccggtctctcagcacaattatcgccctggataccatacgcagacagccggcccctggcaccttgggcggctcgagatggattttgacttctgtgaaggaaccaccgttgtggtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtcaactctctcgtgaccgctggacatggccagattgataattttagcctgggggttctgggaatggcgcttttcctcgaggaaatgctgcgcacacgggtgggcaccaagcacgccatcctgctcgtcgctgtgtcctttgttacgctgattaccgggaacatgtctttcagagaccttggacgcgtgatggtcatggtgggcgccacaatgaccgatgacatcggcatgggggttacatacctggccctcctggctgcctttaaggtgagacctaccttcgcggctggactgcttctgcggaaactcacgagcaaggagctgatgatgacaaccatcggcattacactcctgtcccaatctaccatccccgagaccattcttgaactgacagatgccctcgccctggggatgatggtcctgaaaatcgtgcgcaatatggagaagtatcagcttgctgtgacgattatggccatcctgtgcgtccctaacgcggttatcctccagaatgcttggaaagtgagctgtaccacactggccgtggtctccgtgagccccctcctgcttacctcttcccaacagaaggccgactggattcctctggctctcacaatcaagggactgaaccccaccgccatttttctgacgacacttagcagaacctctaaaaagcggtcctggccgctgaatgaagctatcatggccgttggcatggtgagcattctcgcgtcttccctgctcaaaaacgatatccctatgaccgggcccctggtcgccggaggccttctgacagtgtgctacgttctgaccggccgcagcgctgacctcgagctggaaagagccgctgacgtgcggtgggaggagcaggccgaaatctccgggagctctcctattcttagcatcacaatttccgaggatggatctatgagcatcaagaatgaagaggaggaacagacgctgaccattctcatccgcacaggcctgctcgtcatttccgggctgttccccgtgtctatcccgatcaccgccgctgcgtggtatctttgggaggtcaaaaagcaaagagccggagtgctgtgggacgttccttctccccctcccgtgggcaaagctgaactggaggatggggcctaccggattaagcagaagggaatcctcggctattcccagattggcgccggggtctacaaagaaggaacatttcacaccatgtggcatgtgacgcgcggcgctgttctgatgcacaaggggaaaagaatcgagccctcctgggccgacgtgaagaaagatcttattagctacggaggcgggtggaagctggagggagaatggaaggagggcgaagaggtccaggtgctcgcgctggaacctggcaaaaacccgcgggctgtgcaaaccaagcccggactcttcaaaacatccaccggaacaatcggcgccgttagcctggacttttctcctgggacctccggaagccccatcgtcgataagaaaggcaaggtggtggggctttatggaaacggcgtcgtgacaagatctggcacgtacgtttccgccattgctcagaccgaaaagagcatcgaggacaatcctgaaattgaggatgacatcttccgcaaaaagcggctgacaattatggatctgcatcccggggccggaaaaaccaagagatatctccctgcgatcgtgcgcgaagctatcaaacggggcctgagaacccttattctggccccgacacgcgtcgtggccgctgagatggaagaggccctccgggggctgcccatcagataccagacgcctgctattcgcgccgagcacaccggacgggaaatcgttgacctcatgtgtcatgcgacattcaccatgagactgctttcccccattcgggtgcctaactataatctgatcattatggatgaggcccactttacagaccccgcttctatcgccgctcgcggctacatcagcaccagagtcgaaatgggggaggccgccggcattttcatgacggctacaccgcctggatcccgggacccctttccccagagcaacgcgcctatcatggatgaggaacgcgagattcccgaaagatcttggaatagcggccacgagtgggtgaccgacttcaaggggaagaccgtttggtttgtgcctagcatcaaagccggaaacgatattgctgcctgcctgcggaagaatggcaaaaaggtcatccaactctctagaaaaacattcgactttgaatatatcaagacccgcacaaacgattgggacttcgtggtgaccacggatattagcgagatgggggccaattttaaggctgagcgggtcatcgacccgagacgctgtatgaaacccgttattctgacagatggagaagaacgggtgatccttgccggccctatgcccgtgacccattcctctgcggctcagagacgcgggcgggtcggcagaaaccctaagaatgaaaacgaccagtacatttacatgggagagcccctggaaaatgatgaggactgcgcccactggaaagaggccaagatgctcctggacaacatcaatacaccggaaggcatcattcctagcatgttcgagcccgaacgcgagaaagtggatgctatcgacggggaatatagactgcggggagaggcccgcaagacctttgttgatctcatgagacggggcgaccttcctgtgtggctggcgtaccgcgtcgccgctgaggggattaactatgccgatagacggtggtgtttcgacggagtgaaaaacaatcaaatcctggaagagaacgttgaagtggagatttggacgaaggagggcgaaagaaagaaactcaagccccgctggctggatgctcggatctactccgaccctcttgccctgaaagagttcaaggaatttgctgccgggagaaaatctctcaccctgaatctgattacagagatgggccgcctccccaccttcatgacacagaaggcgcggaacgcccttgataatctggctgtcctgcataccgccgaagctggaggcagagcctataaccacgccctcagcgagctgccggagacacttgaaaccctgctcctgctgacgctccttgctacagtgaccgggggaatctttctgttcctgatgtccggcaaggggatcggaaaaatgaccctcggcatgtgctgcattatcacagcgagcattctgctttggtacgcccagatccagcctcactggattgctgcctctatcatcctggagtttttcctcattgtcctgctgatccccgaacccgagaagcaacggacccctcaggacaatcagctcacatatgtggttattgccatccttacggtggtggctgccaccatggcgaacgaaatgggctttctggagaaaacaaagaaagatttcgggctgggatccattaccacacagcaaccggagagcaatatcctcgacatcgatctgcgccccgcctccgcttggaccctttacgccgtcgctacgacctttattacacctatgctgagacattctatcgaaaacagctccgttaatgtgtctctcaccgccattgcgaaccaggccacagtgctgatgggcctggggaagggatggcccctcagcaagatggacatcggcgtccctcttctggctattgggtgttactcccaggtgaatcccatcaccctgacggccgctctcctgcttctggttgcccactatgctattatcggacctggcctccaggccaaagcgacacgggaggcccaaaagcgcgctgccgctggcatcatgaaaaacccgaccgtggacgggattacagtcatcgatctggaccccattccttacgatcccaagttcgaaaaacagctgggacaggtgatgctccttgtcctgtgcgtgacccaggttctgatgatgagaaccacatgggccctctgtgaggccctgacgcttgcgaccggccctatcagcacactgtgggaagggaatcccggacggttttggaacaccacaattgctgtgtctatggccaatatcttccgcggctcctatctcgctggggccggactgctgtttagcatcatgaagaacaccgccaacacgagacggggcacaggcaataccggggagaccctcggagagaagtggaaaaaccgccttaatgctctgggcaagtctgagttccaaatttacaaaaagtccgggatccaggaggtcgacagaacactggccaaagaaggaattaagcggggcgagaccgatcatcacgcggtgagcagagggtctgccaaactccgctggttcgttgagcggaacctggtggctccggaaggaaaggtcgtggaccttggctgcggcagagggggatggagctattactgtggcgggctgaagaatgtgaaagaggttaagggactcacaaaaggcgggcctggacatgaggaacccatccccatgtccacgtatggctggaacctggtccgcctgcagtctggcgtggatgtgtttttcacccctcccgaaaagtgcgacacactcctttgtgatattggggagagctcccctaatccgaccgtcgaggccggacggacactgagagttctgaacctcgtggaaaattggctgaacaataacacccaattttgcatcaaagtgcttaatccctacatgcctagcgtcatcgagaagatggaagctctgcagcgcaagtacggcggggccctcgtgcggaaccccctgtccagaaattctacgcacgagatgtattgggttagcaacgcgtccggaaacattgtgtctagcgtcaatatgatctcccgcatgctgattaaccggttcaccatgagacacaaaaaggccacatacgaacctgacgtggatctcggctctgggacccgcaatatcggaattgagagcgagacacccaaccttgacatcatcggcaaacggattgaaaagatcaaacaggagcatgaaacctcctggcactatgatcaggaccatccgtacaagacatgggcttatcacggcagctacgagaccaagcaaacggggtctgcctccagcatggttaatggagtggtcagactgctgacaaaaccttgggacgtgattcccatggtgacccagatggctatgaccgatacaacgccttttggccagcagcgcgtcttcaaggaaaaagttgacaccagaacacaagagcccaaggaggggaccaaaaagctcatgaagatcacagccgaatggctgtggaaagagcttggaaagaaaaagacccctcggatgtgtacacgcgaagagtttaccagaaaagtgcggtctaacgctgccctgggcgcgattttcacggatgagaataagtggaaatccgccagagaagctgtggaggacagcgggttttgggaactcgtcgataaggagcggaacctgcacctggaaggaaagtgcgagacctgtgtgtataatatgatgggcaaacgcgagaagaaactcggcgagttcgggaaggccaaaggatctagagctatctggtacatgtggctgggcgcccggtttcttgagttcgaagccctggggtttctcaacgaggaccattggttctcccgcgaaaatagcctgtccggagttgagggcgaggggcttcacaagctgggctacattctcagagatgtgagcaagaaagaaggaggcgcgatgtatgctgacgatacagccgggtgggacacccggatcacactggaggatctgaagaacgaagagatggtcaccaatcatatggaaggagagcacaaaaagctcgccgaggctatcttcaaactgacgtaccagaacaaggtggttcgcgtgcagagacccacaccgcggggcaccgtcatggacattatctctcgcagagaccagcgggggagcggacaagtggttacatatggccttaatacctttacgaacatggaagcccagctgattcgccagatggagggggaaggcgtgttcaagtccatccaacagctcaccgtcacagaggagattgctgtgaaaaactggctggtcagagtgggacgggaacgcctttctagaatggccatcagcggcgatgactgcgttgtgaagcctctggatgaccggtttgcgtccgccctcaccgctctgaatgatatggggaaagtcagaaaggacatccagcagtgggagccctctcgcggatggaacgattggacacaagtgcccttctgcagccatcactttcacgaactgattatgaaagacggccgggtgctcgttgtgccttgtagaaatcaggatgagctgatcgggcgcgcccggatttcccagggagctggctggtctcttagagaaaccgcctgcctgggaaagagctacgcgcagatgtggtccctcatgtatttccatcgccgggacctgagacttgccgctaacgccatctgtagcgctgtcccgtctcactgggtgcccacatcccgcaccacgtggagcattcatgccacacacgagtggatgaccaccgaggatatgctgacagtttggaatcgggtgtggatccaagaaaacccttggatggaggacaagacccccgtcgaatcttgggaggaaatcccttacctcggcaaaagagaggatcagtggtgcggatccctgattggcctgacaagccgcgctacgtgggccaagaatatccagaccgcgattaaccaggtgcggtccctcatcgggaatgaggaatatacagactacatgccctctatgaaaagatttcggagagaggaagaggaagccggagtcctgtggtga

SEQ ID NO: 20207 - RNA, 9876 nt, synthetic construct
  misc_feature 1..9876: note = derived and/or modified CDS sequence (opt5) from DENV-2__KC762669__SS-prME
  source 1..9876: mol_type = other RNA
accgccggcatcattatcatggtgattcccaccgtcatggctttccacctgacgaccagaaacggggagcctcatatgatcgttagccggcaggaaaaggggaaaagcctcctgtttaagaccgagaatggcgtgaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtcgctctggtgcctcatgttgggatgggactcgagacaagaaccgaaacgtggatgtctagcgagggcgcctggaagcacgcccagcggatcgagacatgggtgctgcgccatcccggcttcaccattatggctgccatcctggcttacacaattgggaccacctattttcagagagtcctcatcttcattctgcttacagccgtggcgccttccatgacgatgcggtgcatcggaatttctaaccgcgactttgttgaaggcgtgagcgggggatcctgggtcgatatcgtgctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggatcgtgacctgcgcgatgtttacatgcaagaaaaatatggagggaaagattgtgcagcctgaaaacctggagtatacgatcgtcattacaccccactctggcgaagagaatgccgtggggaacgatacaggaaaacatggcaaggagatcaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggattcagaaagagacactggttaccttcaagaatcctcacgccaagaaacaggatgtggtcgtgctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtcgtgaaggagattgccgaaacccaacatggaacaatcgttattagagtgcagtacgagggcgacgggagcccctgcaaaatccccttcgagatcatggatctggaaaagcgccacgtcctcggacggctgattacggtgaatcctatcgttaccgagaaagactctccggtgaacattgaagctgagcccccttttggcgattcctacatcattatcggggtcgaacccggccagctgaagctcagctggttcaaaaagggatctagcattggccagatgtttgagacaaccatgagaggggccaagcgcatggccatcctgggagacacagcttgggatttcggctcccttgggggagtgtttacctctatcggcaaagccctgcatcaagtgttcggggcgatttatggcgctgcctttagcggagtttcctggacgatgaagatcctcattggcgtcgtgatcacatggattgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcatcttcatcacagataatgtccacacctggacagaacagtataagtttcagcctgagtctcccagcaagctcgcttccgccattcaaaaagctcacgaagaggggatctgtggcattagatctgtgacgcgcctggaaaaccttatgtggaagcagatcaccccggagctgaatcatattctcagcgagaacgaagttaaactgacaatcatgaccggagacatcaagggcattatgcaggccgggaaacggtccctgagacctcagcccacagagcttaagtacagctggaaagcgtggggaaaggccaagatgctctctaccgaactgcacaatcatacgttcctgatcgatggccctgagaccgctgaatgccccaacacaaatcgcgcctggaactccctcgaggtggaggactatgggtttggagtcttcaccacaaatatttggctgaaacttaaggaacggcaagatgtgttttgtgacagcaaactgatgtctgctgccatcaaggacaacagagcggtgcacgccgatatgggctactggattgagtccgctctcaacgacacctggaaaatcgaaaaggccagcttcatcgaggtcaagtcttgccactggcctaaaagccatacactgtggtccaatggcgttctggagagcgaaatgattatccccaagaacttcgctgggccggtgtctcagcacaattatcgccctggataccatacccagacggccggcccctggcaccttgggcggctcgagatggattttgacttctgtgaaggaacaaccgtggtcgtgaccgaggattgcggcaacagagggccctccctgcggacaaccacggccagcggaaaactgattacagaatggtgctgtcgctcctgcaccctccctccgctgagataccggggcgaggacggctgttggtatgggatggagatcagaccccttaaggaaaaagaggaaaatctggttaactctctcgtgacagctggacatggccagattgataattttagcctgggggtcctgggaatggcgcttttcctcgaggaaatgctgcgcacccgggtgggcacaaagcacgccatcctgctcgttgctgtgtcctttgtcaccctgattacggggaacatgtctttcagagaccttggacgcgtgatggttatggtgggcgccaccatgacagatgacatcggcatgggggtcacctacctggccctcctggctgcctttaaggtgagacctacattcgcggctggactgcttctgcggaaactcaccagcaaggagctgatgatgacgacaatcggcattgtgctcctgtcccaatctaccatccccgagacaattcttgaactgaccgatgccctcgccctggggatgatggtcctgaaaatcgttcgcaatatggagaagtatcagcttgctgtgaccattatggccatcctgtgcgtgcctaacgcggtcatcctccagaatgcttggaaagtgagctgtacaacgctggccgttgtgtccgtcagccccctcctgcttacctcttcccaacagaaggccgactggattcctctggctctcacaatcaagggactgaaccccaccgccatttttctgacaacccttagcagaacgtctaaaaagcggtcctggccgctgaatgaagctatcatggccgtgggcatggttagcattctcgcgtcttccctgctcaaaaacgatatccctatgacagggcccctggtggccggaggccttctgaccgtctgctacgtgctgaccggccgcagcgctgacctcgagctggaaagagccgctgacgtccggtgggaggagcaggccgaaatctccgggagctctcctattcttagcatcacaatttccgaggatggatctatgagcatcaagaatgaagaggaggaacagaccctgacaattctcatccgcacgggcctgctcgtgatttccgggctgttccccgtttctatcccgatcaccgccgctgcgtggtatctttgggaggtgaaaaagcaaagagccggagtcctgtgggacgtgccttctccccctcccgttggcaaagctgaactggaggatggggcctaccggattaagcagaagggaatcctcggctattcccagattggcgccggggtgtacaaagaaggaacatttcacaccatgtggcatgtcacacgcggcgctgtgctgatgcacaaggggaaaagaatcgagccctcctgggccgacgtgaagaaagatcttattagctacggaggcgggtggaagctggagggagaatggaaggagggcgaagaggttcaggtcctcgcgctggaacctggcaaaaacccgcgggctgtgcaaaccaagcccggactcttcaaaacgaacaccggaatcatcggcgccgtgtccctggactttagccctgggacatctggatcccccattgtcgataagaaaggcaaggtggttgggctttatggaaatggcgtggtcaccagaagcggcacatacgtgtctgccatcgctcagaccgagaagtccattgaggacaaccctgaaatcgaggatgacattttccgcaaaaagcggctgacaatcatggatctgcatcccggggccggaaaaacgaagagatatctccctgcgatcgttcgcgaagctattaaacggggcctgagaacccttatcctggccccgacacgcgtggtcgccgctgagatggaagaggccctccgggggctgcccattagataccagacccctgctatccgcgccgagcacaccggacgggaaattgtggacctcatgtgtcatgcgacattcacgatgagactgcttagccccatccgggttcctaattataacctgattatcatggatgaggcccactttaccgaccccgcttccatcgccgctcgcggctacatttctacaagagtggaaatgggggaggccgccggcatcttcatgaccgctacaccgcctggaagccgggacccctttccccagtccaatgcgcctattatggatgaggaacgcgagatccccgaaagaagctggaactctggccacgagtgggtcaccgacttcaaggggaagacggtgtggtttgtgccttccattaaagccggaaatgatatcgctgcctgcctgcggaagaacggcaaaaaggtcatccaactcagcagaaaaacattcgactttgaatatattaagacccgcaccaatgattgggacttcgttgtgacaaccgatatctctgagatgggggccaactttaaggctgagcgggtgattgacccgagacgctgtatgaaacccgtcatcctgacagatggagaagaacgggtgattcttgccggccctatgcccgttacccatagctccgcggctcagagacgcgggcgggtgggcagaaatcctaagaacgaaaatgaccagtacatctacatgggagagcccctggaaaacgatgaggactgcgcccactggaaagaggccaagatgctcctggacaatatcaacacgccggaaggcattatcccttctatgttcgagcccgaacgcgagaaagtcgatgctattgacggggaatatagactgcggggagaggcccgcaagacatttgtggatctcatgagacggggcgaccttcctgtttggctggcgtaccgcgtggccgctgaggggatcaactatgccgatagacggtggtgtttcgacggagtcaaaaataaccaaattctggaagagaatgtggaagtcgagatctggaccaaggagggcgaaagaaagaaactcaagccccgctggctggatgctcggatttacagcgaccctcttgccctgaaagagttcaaggaatttgctgccgggagaaaatccctcacactgaacctgatcaccgagatgggccgcctccccacgttcatgacccagaaggcgcggaatgcccttgataacctggctgtgctgcatacagccgaagctggaggcagagcctataatcacgccctctctgagctgccggagacccttgaaacactgctcctgctgaccctccttgctacagttaccgggggaatctttctgttcctgatgagcggcaaggggattggaaaaatgacgctcggcatgtgctgcatcattacagcgtccatcctgctttggtacgcccagattcagcctcactggatcgctgccagcatcattctggagtttttcctcatcgtgctgctgattcccgaacccgagaagcaacggacccctcaggacaaccagctcacctatgtggtcatcgccattcttacagttgtggctgccaccatggcgaatgaaatgggctttctggagaaaacaaagaaagatttcgggctgggatctatcacgacccagcaactcgagtccaacatcctggacattgatcttcgcccggccagcgcttggacactgtacgccgtggctaccacatttatcacccccatgctcagacattccattgaaaattctagcgtcaacgtgtccctgacggccatcgcgaatcaggccaccgttctgatgggcctcgggaagggatggcctctttctaagatggacattggcgtgcccctgctggctatcgggtgttacagccaggtcaaccctattacactcaccgccgctctgcttctgctcgtggcccactatgctatcatcggacccggcctgcaggccaaagcgacacgggaggcccaaaagcgcgctgccgctggcattatgaaaaatcctaccgtcgacgggatcacggtgattgatctggacccgatcccctacgatcctaagttcgaaaaacagctcggacaggttatgcttctggtgctgtgcgtcacacaggtgctcatgatgagaaccacatgggccctgtgtgaggcccttaccctggcgaccggccccatttccacactctgggaagggaaccctggacggttttggaatacgaccatcgctgttagcatggccaacatcttccgcggctcttatctggctggggccggactgctcttttccattatgaagaacacagccaataccagacggggcacaggcaacaccggggagacgcttggagagaagtggaaaaatcgcctgaacgctctgggcaagagcgagttccaaatctacaaaaagtctgggattcaggaggtggacagaacactcgccaaagaaggaatcaagcggggcgagaccgatcatcacgcggtctccagagggagcgccaaactgcgctggttcgtggagcggaatcttgtgacccccgaaggaaaggttgtcgacctgggctgcggcagagggggatggtcttattactgtggcgggctcaagaacgtgaaagaggtgaagggactgacaaaaggcgggccgggacatgaagaacctattcccatgagcacctatggctggaatctggtccgcctccagtccggcgttgatgtgtttttcacaccccctgaaaagtgcgacacgcttctgtgtgatatcggggagtctagccccaaccctaccgtggaggctggacggacactgagagtcctcaatctggtggaaaactggcttaataacaatacccaattttgcatcaaagttctgaacccgtacatgccctccgtgattgagaagatggaagccctccagcgcaagtacggcggggctctggtccggaatcctctgagcagaaactccacacacgagatgtattgggtgtctaacgccagcggaaatatcgtttcctctgtgaacatgattagccgcatgctcatcaatcggttcaccatgagacacaaaaaggcgacgtacgaacccgacgtcgatcttggctccgggacccgcaacattggaatcgagtctgagacacctaatctggacatcattggcaaacggatcgaaaagattaaacaggagcatgaaaccagctggcactatgatcaggaccatccctacaagacatgggcctatcacggctcctacgagaccaagcaaacagggagcgcttcttccatggtgaacggagtggtcagactgctcaccaaaccgtgggacgttatccctatggtgacgcagatggccatgacagataccaccccctttggccagcagcgcgtgttcaaggaaaaagtcgacacaagaacgcaagagcctaaggaggggaccaaaaagctgatgaagattacagctgaatggctttggaaagagctgggaaagaaaaagacaccccggatgtgtacacgcgaagagtttaccagaaaagtgcggagcaatgccgctctcggcgccatcttcacagatgagaacaagtggaaatctgcgagagaagccgttgaggactccgggttttgggaactggtggataaggagcggaatctgcacctcgaaggaaagtgcgagacctgtgtctataacatgatgggcaaacgcgagaagaaactgggcgagttcgggaaggctaaaggaagcagagccatttggtacatgtggcttggcgctcggtttctggagttcgaagccctcgggtttctgaatgaggaccattggttctctcgcgaaaactcccttagcggagtggagggcgaggggctgcacaagctcggctacatcctgagagatgtttccaagaaagaaggaggcgccatgtatgcggacgatacggctgggtgggacacccggatcacactggaggatctcaagaatgaagagatggtgaccaaccatatggaaggagagcacaaacgcctggccgaggccattttcagacttacataccagaataaggtcgtgcgggttcagcgccctacccccagaggcacggtgatggacatcattagccggcgcgaccagagagggtctggacaagtcgtgacatatggcctgaacacctttacaaacatggaagctcagctcatccggcagatggagggggaaggcgtcttcaaaagcattcaacatctgaccgtgacggaggagatcgccgttaagaattggcttgctcgcgtgggaagagaacggctgtccagaatggccatctctggcgatgactgcgtcgtgaagccgctcgatgaccgctttgcgagcgccctgaccgctctgaacgatatggggaaagtgcggaaggacattcagcagtgggagccttccagaggatggaatgattggacacaggttcccttctgctctcaccactttcatgaactcatcatgaaagacggccgcgtgctggtcgtgccctgtcggaaccaagatgagcttattgggagagcccgcatcagccagggagctggctggtccctgcgggaaaccgcctgcctcgggaagtcttacgcgcagatgtggagcctgatgtatttccacagacgcgaccttcggctggccgctaatgccatttgttccgctgttcctagccattgggtgccgacatctagaaccacatggtccatccacgccacccacgagtggatgacgacagaggatatgctcaccgtctggaaccgcgtgtggatccaggaaaatccctggatggaggacaaaacccctgtcgaaagctgggaggaaattccctacctgggcaagcgggaggatcaatggtgcggatctctgatcggcctcacatccagagctacctgggccaagaacattcagacagcgatcaatcaggtgcggagcctgattgggaacgaggaatatacggactacatgccttccatgaaaagatttcgccgggaggaagaggaagccggagttctttggtga

SEQ ID NO: 20208 - RNA, 9876 nt, synthetic construct
  misc_feature 1..9876: note = derived and/or modified CDS sequence (opt5) from DENV-2__KC762658__SS-prME
  source 1..9876: mol_type = other RNA
accgccggcatcattatcatgatgattcccaccgtgatggctttccacctgacgacccggaacggggagcctcatatgatcgtcagccggcaggaaaagggaaagtccctcctgtttaagaccgagaatggcgttaacatgtgcacccttatggccatggacctgggggaactctgtgaggataccattacctacaattgccccctgcttcgccaaaacgaacccgaggacatcgattgttggtgcaattctacaagcacctgggtgacgtatggaacctgtacagcgcctggcgagcaccggcgggaaaaacgctccgtggctctggttccccatgtggggatgggactcgagaccagaacagaaacctggatgtctagcgagggcgccggcaagcacgcccagcggatcgagacgtgggttctgcgccatcctgggttcacaattatggctgccatcctggcttacaccattggaacaacctattttcagagagtgctcatcttcattctgcttaccgccgtcacaccctccatgacgatgcggtgcatcggcatttctaaccgcgactttgtggaaggggttagcggaggctcctgggtggatatcgtcctggagcacgggagctgtgtgaccacaatggcgaaaaataagcctaccctcgacttcgaactgatcaagacagaggccaaacttccggctaccctgagaaagtactgcattgaagccaaactcacgaacacaaccaccgcttctcggtgtcccacacagggagagccttccctgaatgaggaacaagataagcgctttgtgtgcaaacacagcatggtcgacagaggctggggcaacgggtgtggactgttcggcaaaggcgggatcgttacctgcgccatgtttacatgcaagaaaaatatggaggggaagattgtgcagcccgaaaacctcgagtatacgatcgtgattacccctcattctggggaagagaatgcggtcggaaacgatacaggcaaacacggcaaggagatcaaagtgacaccccagtccagcatcacagaagccgagctgaccgggtacggaacggttaccatggaatgttctccgcggacaggccttgacttcaatgagatggtgctgctccagatggaaaacaaggcttggctggtccatcgccaatggtttcttgatctgcctctcccctggctgcctggggccgacacccagggatccaactggattcagaaagagacactggtgaccttcaagaatccccacgctaagaaacaggatgttgtggtcctcggcagccaagagggggccatgcacacggccctgacaggcgctaccgaaatccagatgtcctctggaaaccttctgtttacaggccatctcaagtgcagactgcggatggacaaacttcagctgaaggggatgagctattccatgtgtaccggaaaattcaaggtggtcaaggagattgcggaaacccaacacggcacaatcgtgattagagttcagtacgagggggacggaagcccctgcaaaatccctttcgagatcatggatctcgaaaagcgccatgtgctgggccggctgattacggtcaatccgatcgtgaccgagaaagactctcccgttaacattgaagccgagcctccctttggggattcctacatcattatcggcgtggaacctggacagctcaagctgagctggttcaaaaagggctctagcattgggcagatgtttgagacaaccatgagaggagctaagcgcatggccatccttggcgacacagcctgggatttcgggtccctgggaggcgtctttacctctatcgggaaagctctccaccaagtgttcggcgccatttatggagcggcttttagcggcgtgtcctggacgatgaagatcctgattggggttgtcatcacatggattggaatgaatagccggtctacctccctgagcgtgtctcttgtgctcgtcggcgtggttaccctgtacctgggggtgatggtccaggccgactccggatgtgtggttagctggaaaaacaaggagctcaaatgcggctccgggatcttcatcacagataatgtgcatacctggacagaacagtataagtttcagcccgagtctccgagcaagctggcctccgctattcaaaaagcccacgaagagggcatctgtggaattagatctgtcacgcgccttgaaaacctgatgtggaagcagatcacccctgagctcaatcacattctgagcgagaacgaagtgaaactgacaatcatgaccggcgacatcaaggggattatgcaggctggaaaacggtcccttagaccccagcctacagagctcaagtacagctggaaaacctggggcaaggccaagatgctgtctacggaactgcataatcacaccttcctcatcgatgggcccgagacagcggaatgccctaacaccaatcgcgcctggaactccctggaggttgaggactatggatttggcgtgttcacaaccaatatttggcttaaactgaaggaacggcaagatgtcttttgtgacagcaaactcatgtctgctgccatcaaggacaacagagctgtgcatgccgatatgggctactggattgagtccgcgctgaacgacacatggaaaatcgaaaaggccagcttcatcgaggtgaagtcttgccactggcccaaaagccacaccctgtggtccaatggggtccttgagagcgaaatgattatcccgaagaacttcgctggacctgtttctcagcataattatcgccccggctaccacacgcagacagccgggccctggcatctcggacggctggagatggattttgacttctgtgaaggcaccaccgtggtggtcacagaggattgcgggaacagaggaccttccctgcggaccacgacagctagcggcaaactcattaccgaatggtgctgtcgctcctgcacactgccgccccttagataccggggcgaggacgggtgttggtatggaatggagatcagacctctgaaggaaaaagaggaaaatctcgtgaactctctggttaccgccggccacgggcagattgataattttagcctgggagtgcttggcatggccctcttcctggaggaaatgctgcgcacacgggtcgggaccaagcatgctatcctcctggtggcggtttcctttgtgacgcttattaccggaaacatgtctttcagagacctgggccgcgtcatggtgatggttggcgccacaatgaccgatgacatcgggatgggagtgacatacctcgctctgctggccgcctttaaggtcagacccaccttcgctgccggccttctgctccggaaactgacgagcaaggagctcatgatgacaaccatcgggattgtgctgctttcccaatctacaatccctgagaccattctggaactcaccgatgcgctggctctgggaatgatggtgcttaaaatcgtccgcaatatggagaagtatcagctggccgttacaattatggccatcctctgcgtgcccaacgctgtgatcctgcagaatgcctggaaagtcagctgtacgaccctcgcggtggtttccgtgagccctctgcttctgacatcttcccaacagaaggctgactggattcccctcgccctgaccatcaagggcctgaacccgacagccatttttcttaccacgctgagcagaacatctaaaaagcggtcctggcctctcaatgaagctatcatggccgtcgggatggtgagcattctggcttcttccctcctgaaaaacgatatccccatgaccggacctcttgttgccggcggcctgctgaccgtgtgctacgtcctcacagggcgcagcgcggacctggagcttgaaagagccgctgacgtgcggtgggaggagcaggccgaaatctccggaagctctcccattctgagcatcaccatttccgaggatggctctatgagcatcaagaatgaagaggaggaacagacactcacgattctgatccgcaccgggctcctggtcatttccggacttttcccggtgtctatccctatcacagctgccgcctggtatctgtgggaggttaaaaagcaaagagctggcgtgctgtgggacgtccccagccctccgcccgtggggaaagcggaactcgaggatggagcctaccggattaagcagaagggcatcctgggctattcccagattggggctggagtttacaaagaaggcacctttcacacaatgtggcacgtgacccgcggggccgtccttatgcataagggaaaaagaatcgagccttcttgggccgacgtgaagaaagatctgattagctacggcgggggatggaagctcgagggcgaatggaaggagggcgaagaggtgcaggttctggctctcgaaccggggaaaaacccccgggccgtccaaacgaagcctggactgttcaaaaccaacacaggcaccatcggggcggtgtcccttgactttagccccggaacatctggctcccctatcgtggataagaaagggaaggtcgtgggactgtatggcaatggcgttgtgaccagaagcgggacatacgtctctgctattgcccagacggagaagtccatcgaggacaaccccgaaattgaggatgacatcttccgcaaaaagcggctgaccattatggatctccaccctggagccggcaaaacaaagagatatctgccggctatcgtgcgcgaagccatcaaacgggggcttagaaccctgattctcgcgcccacccgcgttgtggctgccgagatggaagaggccctgcggggactccctatcagataccagacacccgctattcgcgccgagcatacgggccgggaaatcgtcgacctgatgtgtcacgctaccttcacaatgagacttctgagccctattcgggtgcccaattataacctgatcattatggatgaggcccattttaccgacccggcgtccatcgccgctcgcgggtacatctctacaagagttgaaatgggcgaggccgctggaattttcatgaccgccacgcctcccggcagccgggacccctttcctcagtccaatgcccccatcatggatgaggaacgcgagattcctgaaagaagctggaactctgggcacgagtgggtgacagacttcaagggaaagaccgtctggtttgtgccgtccatcaaagctggcaatgatattgcggcctgcctccggaagaacgggaaaaaggtgatccaactgagcagaaaaaccttcgactttgaatatatcaagacacgcaccaatgattgggacttcgtcgttacaaccgatatttctgagatgggagctaactttaaggccgagcgggtgatcgaccccagacgctgtatgaaacctgtgattcttacggatggcgaggaacgggtcatcctggccgggcccatgcctgtgacacacagctccgctgcccagagacgcggccgggttggaagaaatcccaagaacgaaaatgaccagtacatttacatgggcgagccgctcgaaaacgatgaggactgcgcgcattggaaagaggctaagatgctgctggacaatatcaacacccctgaagggatcattccctctatgttcgagcctgaacgcgagaaagtggatgccatcgacggagaatatagactccggggcgaggcccgcaagacatttgtcgagcttatgagaagaggggatctgcccgtgtggctggcttaccgcgttgccgcggaaggaattaactatgccgacagacggtggtgtttcgatggcgtgaaaaataaccaaatcctcgaggaaaatgtcgaggtggagatttggaccaaggaaggggagagaaagaaactgaagcctcgctggcttgacgctcggatctacagcgatcccctggccctcaaagagttcaaggagtttgctgccggcagaaaatccctgacgctgaacctcattaccgaaatgggacgccttccgacattcatgacccagaaggctcggaatgccctggacaacctggcggtcctccacacagccgaggctggcgggagagcctataatcatgctctgtctgagcttcctgaaaccctggagacactcctgctgctcacccttctggccacggtgacaggaggcatctttctgttcctcatgagcgggaagggaatcggcaaaatgaccctgggcatgtgctgcattatcaccgcctccattcttctgtggtacgctcagatccagccccactggattgcggccagcatcatcctcgaatttttcctgattgttctgctcatccccgagcctgaaaagcaacggacaccgcaggataaccagcttacctatgtggtgattgctatcctgacagtcgttgccgccacgatggctaatgagatggggtttctggagaaaaccaagaaagacttcggactcggctctattacaacccagcaacccgaatccaacatcctggatatcgaccttcgccctgccagcgcgtggacactgtacgccgtggctaccacgtttattacccccatgctcagacactccatcgaaaattctagcgtgaacgtctccctgacagccattgctaatcaggccaccgtgctgatggggctcggaaagggctggcctctttctaagatggatatcggggttcccctgctggcgattggatgttacagccaggtgaaccctatcacactcaccgccgctctgcttctgctcgtcgcccattatgctattatcggcccgggcctgcaggccaaagctacgcgggaagcccaaaagcgcgcggccgctgggatcatgaaaaatcccacagtggacggaattaccgtcatcgacctggatcctattccctacgaccctaagttcgagaaacagctcggccaggtgatgcttctggttctgtgcgtgacacaggtcctcatgatgagaaccacctgggccctgtgtgaagctcttacactggccacggggcccatctccaccctctgggagggaaacccgggccggttttggaatacaaccattgccgtgagcatggcgaacatcttccgcgggtcttatctggctggagccggcctgctcttttccatcatgaagaacacagctaataccagacggggcacggggaacacaggagagacccttggcgaaaagtggaaaaatcgcctgaacgccctgggaaagagcgagttccaaatttacaaaaagtctggaatccaggaagttgatagaaccctcgccaaagagggcattaagagaggggaaacagaccaccatgctgtgtccagaggaagcgccaaactgcgctggttcgtcgaacggaatcttgtgacccctgagggcaaggtggttgatctgggctgcgggagaggaggctggtcttattactgtgggggactcaagaacgtcaaagaagtgaagggcctgacaaaagggggacccggccacgaggaacccatccctatgagcacgtatggctggaatctggtgcgcctccagtccggggtcgacgtctttttcacaccccctgagaagtgcgatacacttctgtgtgacattggagagtctagcccgaaccccaccgtggaagcgggccggacactgagagtgctcaatctggtcgagaactggcttaataacaatacccaattttgcatcaaagtgctgaacccttacatgccctccgttatcgaaaagatggaggccctccagcgcaagtacgggggagctctggtgcggaatcctctgagcagaaactccacgcatgaaatgtattgggtctctaacgccagcggcaatattgtgtcctctgttaacatgatcagccgcatgctcattaatcggttcaccatgagacacaaaaaggctacatacgagcccgatgtggaccttgggtccggaacccgcaacatcggcattgagtctgaaacaccgaatctggatatcatcggcaaacggattgagaagatcaaacaggaacacgagaccagctggcattatgaccaggatcacccttacaagacatgggcctatcatgggtcctacgaaaccaagcaaacgggaagcgcgtcttccatggtcaacggcgtggtgagactgctcacaaaaccctgggacgtcattcctatggttacccagatggccatgaccgacacaacgccctttgggcagcagcgcgtgttcaaggagaaagtggataccagaacacaagagcctaaggaaggaaccaaaaagctgatgaagatcacagctgagtggctttggaaagaactgggcaagaaaaagacaccccggatgtgtacacgcgaggagtttaccagaaaagtccggagcaatgccgctctcggggccattttcacggacgaaaacaagtggaaatctgctagagaggccgtggaagattccggattttgggagctggttgacaaggaacggaatctgcacctcgagggcaagtgcgagacctgtgtgtataacatgatgggcaaacgcgaaaagaaactgggggagttcggaaaggcgaaaggcagcagagccatctggtacatgtggcttggggctcggtttctggagttcgaggccctcggatttctgaatgaagatcactggttctctcgcgagaactcccttagcggcgtcgagggggaaggcctgcataagctcggatacattctgagagacgtgtccaagaaagagggcggggctatgtatgccgatgacacagccggatgggatacccggatcacactggaagacctcaagaatgaggaaatggttaccaaccacatggagggcgagcataaaaagctggcggaagctatcttcaaacttacgtaccagaataaggtggtccgcgtgcagagaccgacacctcgggggaccgttatggatattatcagccgcagagaccagcggggatctggccaagtggtcacatatgggctgaacacctttacgaacatggaggcccagctcattcgccagatggaaggcgagggagtgttcaagagcatccaacagctgaccgtcacagaggaaattgccgtgaaaaattggcttgttagagtgggccgggagcgcctgtccagaatggctatctctggggacgattgcgtcgtgaagcccctcgacgatcggtttgccagcgctctgaccgccctgaacgacatgggaaaagtgagaaaggatatccagcagtgggaaccctcccgcggctggaatgactggacacaagttcctttctgctctcaccattttcacgagctcattatgaaagatgggcgggtgctggtcgtgccgtgtagaaaccaggacgaacttatcggacgcgcgcggattagccagggcgccgggtggtccctgagagagaccgcttgcctcggcaagtcttacgcccagatgtggagcctgatgtatttccaccgccgggatcttagactggctgccaatgcgatctgttccgccgttcccagccattgggtgcctacatctcgcaccacgtggtccattcacgctacacatgagtggatgaccaccgaagacatgctcacagtctggaaccgggtgtggatccaagagaatccctggatggaagataagacccctgtcgagagctgggaagagatcccctacctgggaaaaagagaggaccagtggtgcggctctctgattgggctcacatcccgcgccacgtgggctaagaacatccagaccgccattaatcaggtgcggagcctgatcggaaacgaaaaatatacagattacatgccttccatgaagagatttcggagagaggaagaggaagctggcgttctttggtga

SEQ ID NO: 20209 - RNA, 9876 nt, synthetic construct
  misc_feature 1..9876: note = derived and/or modified CDS sequence (opt5) from DENV-2__KC762660__SS-prME
  source 1..9876: mol_type = other RNA
accgccggaatcattatcatgatgattcccacagtgatggctttccacctgacgaccagaaacggggagcctcatatgatcgtcagccggcaggaaaagggaaaatccctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaaggtggtgcagcctgaaaacctggagtataccattgtcatcacaccccactctggcgaagagaatgcggtggggaacgataccggaaaacatggcaaggagattaaagttacacctcagtccagcatcaccgaagccgagctcacgggctacgggaccgtgacaatggaatgttctccccggaccggactggacttcaatgagatggtccttctgcagatggaaaacaaggcttggctcgtgcaccgccaatggtttctggatcttccgctgccttggctccccggcgccgacacacaggggtccaactggatccagaaagagaccctggttacgttcaagaatcctcacgctaagaaacaggatgtggtcgtgctgggaagccaagagggcgccatgcatacagccctcaccggggctacagaaattcagatgtcctctggcaacctgctttttaccggacacctgaagtgcagactccggatggacaaactgcagcttaagggcatgagctattccatgtgtaccgggaaattcaaggtcgtgaaggagatcgcggaaacacaacatggaacgattgttatcagagtgcagtacgagggcgacgggagcccctgcaaaattcccttcgagatcatggatctggaaaagcgccacgtcctcggacggctgatcaccgtgaatcctattgttacagagaaagactctccggtgaacatcgaagccgagcccccttttggcgattcctacattatcattggggtcgaacccggccagctgaagctcagctggttcaaaaagggatctagcatcggccagatgtttgagaccacaatgagaggggctaagcgcatggccattctgggagacaccgcctgggatttcggctcccttgggggagtgtttacgtctatcggcaaagctctgcatcaagtgttcggggccatctatggcgcggcttttagcggagtttcctggacaatgaagattctcatcggcgtcgtgattacctggatcgggatgaatagccggtctacctccctgagcgtgtctctggtccttgtgggagttgtgacactctacctgggcgtcatggtgcaggccgactccgggtgtgttgtgagctggaaaaacaaggagctgaaatgcggatccggcattttcatcaccgataatgtccacacatggacggaacagtataagtttcagcctgagtctcccagcaagctcgcctccgctatccaaaaagcccacgaagaggggatttgtggcatcagatctgtgacccgcctggaaaaccttatgtggaagcagattacaccggagctgaatcatatcctcagcgagaacgaagttaaactgaccattatgacaggagacatcaagggcatcatgcaggctgggaaacggtccctgagacctcagcccaccgagcttaagtacagctggaaaacgtggggaaaggccaagatgctctctaccgaactgcacaatcatacattcctgattgatggccctgagaccgcggaatgccccaacacaaatcgcgcctggaactccctcgaggtggaggactatgggtttggagtcttcaccacaaatatctggctgaaacttaaggaacggcaagatgtgttttgtgacagcaaactgatgtctgctgccattaaggacaacagagctgtgcacgccgatatgggctactggatcgagtccgcgctcaacgacacctggaaaattgaaaaggccagcttcatcgaggtcaagtcttgccactggcctaaaagccatacgctgtggtccaatggcgttctggagagcgaaatgatcattcccaagaacttcgctgggccggtgtctcagcacaattatcgccctggataccatacacagaccgccggcccctggcaccttgggcggctcgagatggattttgacttctgtgaaggaaccacagtggtcgtgaccgaggattgcggcaacagagggccctccctgcggacgacaaccgctagcggaaaactgatcacagaatggtgctgtcgctcctgcaccctccctccgctgagataccggggcgaggacggctgttggtatgggatggagattagaccccttaaggaaaaagaggaaaatctggttaactctctcgtgacagccggacatggccagatcgataattttagcctgggggtcctgggaatggcccttttcctcgaggaaatgctgcgcacccgggtgggcacgaagcacgctattctgctcgttgcggtgtcctttgtcaccctgatcacagggaacatgtctttcagagaccttggacgcgtgatggttatggtgggcgccaccatgacagatgacattggcatgggggtcacctacctggctctcctggccgcctttaaggtgagacctacgttcgctgccggactgcttctgcggaaactcacaagcaaggagctgatgatgaccacaatcggcatcgtgctcctgtcccaatctaccattcccgagagcatccttgaactgaccgatgcgctcgctctggggatgatggtcctgaaaattgttcgcaatatggagaagtatcagcttgccgtgacaatcatggccattctgtgcgtgcctaacgctgtcatcctccagaatgcctggaaagtgtcctgtacgaccctggcggttgtgagcgtctctcccctcctgcttacatccagccaacagaaggctgactggatccctctggccctcaccattaagggactgaaccccacagccatctttctgaccacgctttctagaacatccaaaaagcggagctggccgctgaatgaagctattatggccgtgggcatggtttctatcctcgcttccagcctgctcaaaaacgatattcctatgaccgggcccctggtggccggaggccttctgaccgtctgctacgtgctgacaggccgctccgcggacctcgagctggaaagagccgctgacgtccggtgggaggagcaggccgaaatcagcgggtctagccctatcctttccattaccatctctgaggatggaagcatgtccattaagaatgaagaggaggaacagacactgacgatcctcattcgcaccggcctgctcgtgatctctgggctgttccccgttagcattccgatcacagctgccgcctggtatctttgggaggtgaaaaagcaaagagctggagtcctgtgggacgtgccttctccccctcccgttggcaaagcggaactggaggatggggcctaccggatcaagcagaagggcattctcggctatagccagatcggcgctggggtgtacaaagaaggaacctttcacacaatgtggcatgtcacccgcggcgccgtgctgatgcacaaggggaaaagaattgagcccagctgggccgacgtgaagaaagatcttatctcctacggaggcgggtggaagctggagggagaatggaaggagggcgaagaggttcaggtcctcgctctggaacctggcaaaaacccgcgggccgtgcaaacgaagcccggactcttcaaaaccaacacaggaaccattggcgcggtgagcctggacttttctcctgggacatccggaagccccatcgtcgataagaaaggcaaggtggttgggctttatggaaatggcgtggtcaccagatctggcacatacgtgtccgctatcgcccagacggaaaagagcattgaggacaaccctgaaatcgaggatgacattttccgcaaaaagcggctgaccatcatggatctgcatcccggggccggaaaaacaaagagatatctccctgctattgttcgcgaagccatcaaacggggcctgagaacccttatcctggcgccgacccgcgtggtcgctgccgagatggaagaggccctccgggggctgcccattagataccagacgcctgctatccgcgccgagcacacgggacgggaaattgtggacctcatgtgtcatgctaccttcacaatgagactgctttcccccatccgggttcctaattataacctgattatcatggatgaggcccactttattgaccccgcgtctatcgccgctcgcggctacatcagcaccagagtggaaatgggggaggccgctggcattttcatgacagccaccccgcctggatcccgggacccctttccccagagcaatgcccctatcatggatgaggaacgcgagattcccgaaagatcttggaactccggccacgagtgggtcacggacttcaaggggaagacagtgtggtttgtgcctagcatcaaagctggaaatgatattgcggcctgcctgcggaagaacggcaaaaaggtcatccaactctctagaaaaaccttcgactttgaatatatcaagacccgcacaaatgattgggacttcgttgtgaccacagatattagcgagatgggggctaactttaaggccgagcgggtgatcgacccgagacgctgtatgaaacccgtcattctgaccgatggagaagaacgggtgatccttgccggccctatgcccgttacgcattcctctgctgcccagagacgcgggcgggtgggcagaaatcctaagaacgaaaatgaccagtacatttacatgggagagcccctggaaaacgatgaggactgcgcgcactggaaagaggctaagatgctcctggacaatatcaacacaccggaaggcatcattcctagcatgttcgagcccgaacgcgagaaagtcgatgccatcgacggggaatatagactgcggggagaggcccgcaagacctttgtggatctcatgagacggggcgaccttcctgtttggctggcttaccgcgtggccgcggaggggattaactatgccgatagacggtggtgtttcgacggagtcaaaaataaccaaatcctggaagagaatgtggaagtcgagatttggacaaaggagggcgaaagaaagaaactcaagccccgctggctggatgctcggatctactccgaccctcttgccctgaaagagttcaaggaatttgctgccgggagaaaatctctcaccctgaacctgattacggagatgggccgcctccccaccttcatgacacagaaggctaagaatgcccttgataacctggcggtgctgcataccgccgaagctggaggccgggcctataatcacgctctcagcgagctgccggagacacttgaaaccctgctcctgctgacactccttgccaccgttacaggcgggatctttctgttcctgatgtccgggaaagggatcggaaagatgacactcggcatgtgctgcattatcaccgccagcattctgctttggtacgctcagatccagcctcactggattgcggcctctatcatcctggagtttttcctcattgtgctgctgatccccgaacccgagaaacaaagaacccctcaggacaaccagctcacatatgtggtcattgctatccttaccgttgtggccgccacaatggctaatgaaatgggctttctggagaagacgaaaaaggatttcgggctgggatccattaccacacagcaaccggagagcaacatcctcgacatcgatctgcggcccgcctccgcgtggaccctttacgccgtggctacaacctttattacgcctatgctgcgccattctatcgaaaatagctccgtcaacgtgtctctcaccgccattgctaatcaggccacagttctgatgggcctggggaagggatggcccctcagcaaaatggacatcggcgtgcctcttctggcgattgggtgttactcccaggtcaaccccatcaccctgacagccgctctcctgcttctggtggcccactatgctattatcggacctggcctccaggccaaggctaccagagaggcccaaaaacgggcggccgctggcatcatgaagaatccgacggtcgacgggattacagtgatcgatctggaccccattccttacgatcccaaattcgaaaagcagctgggacaggttatgctccttgtgctgtgcgtcacccaggtgctgatgatgcgcacaacctgggccctctgtgaggctctgacccttgccacaggccctatcagcacgctgtgggaagggaaccccggaagattttggaataccacaattgccgtttctatggcgaacatcttccggggctcctatctcgctggggccggactgctgtttagcatcatgaagaacaccgctaatacacgcagaggcaccggcaacacgggggagacactcggagagaaatggaagaatcggcttaacgccctgggcaaatctgagttccaaatttacaagaaatccgggatccaggaggtggaccgcaccctggccaaggaaggaattaaaagaggcgagaccgatcatcacgctgtcagccgggggtctgccaagctcagatggttcgtggagcgcaatctggtgacaccggaaggaaaggttgtcgaccttggctgcggcagagggggatggagctattactgtggcgggctgaaaaacgtgaaggaggtgaaaggactcaccaagggcgggcctggacatgaagaacccatccccatgtccacatatggctggaatctggtcagactgcagtctggcgttgatgtgtttttcacgcctcccgaaaaatgcgacaccctcctttgtgatattggggagagctcccctaacccgacagtggaggcgggacgcaccctgcgggtcctgaatctcgtggaaaactggctgaataacaatacacaattttgcatcaaggttcttaacccctacatgcctagcgtgatcgagaagatggaagccctgcagagaaaatacggcggggctctcgtccgcaatcccctgtcccggaactctacccacgagatgtattgggtgagcaacgcctccggaaatattgtttctagcgtgaacatgatctccagaatgctgattaatcgcttcacgatgcggcacaagaaagctacctacgaacctgacgtcgatctcggctctgggacaagaaacatcggaattgagagcgagacccccaatcttgacatcatcggcaagcgcattgagaaaatcaagcaggagcatgaaacatcctggcactatgatcaggaccatccgtacaagacctgggcctatcacggcagctacgagacaaaacaaaccgggtctgcgtccagcatggtgaacggagtggtccggctgctgacgaagccttgggacgttattcccatggtgacacagatggccatgaccgataccacaccttttggccagcagagagtgttcaaagaaaaggtcgacacgcgcacccaagagcccaaagaggggacaaagaagctcatgaaaatcaccgctgaatggctgtggaaggagcttggcaaaaagaaaacacctagaatgtgtacccgggaagagtttacacgcaaggtgagatctaatgccgctctgggcgccattttcaccgatgagaacaaatggaagtccgctcgggaagccgttgaggacagcgggttttgggaactcgtggataaggagagaaatctgcacctggaaggaaaatgcgagacgtgtgtctataacatgatgggcaagcgggagaaaaagctcggcgagttcgggaaagcgaagggatctcgcgccatctggtacatgtggctgggcgctagatttcttgagttcgaagccctggggtttctcaatgaggaccattggttctcccgggaaaacagcctgtccggagtggagggcgaggggcttcacaagctgggctacattctccgcgatgttagcaaaaaggaaggaggcgctatgtatgccgacgataccgccgggtgggacacaagaatcaccctggaggatctgaaaaatgaagagatggtgacaaaccatatggaaggagagcacaagaaactcgcggaggctatcttcaagctgacctaccagaataaggtcgtgcgggttcagcgccccacgccgagaggcacagtgatggacattatctctcggcgcgaccagagagggagcggacaagtcgtgacctatggccttaacacatttaccaacatggaagcccagctgattcggcagatggagggggaaggcgtcttcaaatccatccaacagctcacggtgaccgaggagattgccgttaagaattggctggtgcgcgtcggaagagaacggctttctcgcatggctatcagcggcgatgactgcgtggtgaaacctctggatgacagatttgcctccgctctcacagccctgaacgatatggggaaggttcggaaagacatccagcagtgggagccctctagaggatggaatgattggacccaagtgcccttctgcagccatcactttcacgaactgattatgaaggacggccgcgtcctcgtggttccttgtcggaaccaggatgagctgatcgggagagcgcgcatttcccagggagccggctggtctcttcaggaaacagcttgcctggggaagtcctacgcccaaatgtggtccctcatgtatttccatcggagagacctgcgccttgctgccaatgcgatctgtagcgccgtgccgtctcactgggtccccacctcccggacaacctggagcattcatgctacgcacgagtggatgacaaccgaggatatgctgaccgtgtggaacagagtctggatccaggaaaatccttggatggaggacaaaacacccgtggaatcttgggaggaaatcccttacctcggcaagcgcgaggatcagtggtgcggatccctgattggcctgaccagccgggccacatgggctaaaaacatccagacggccattaatcaagttagatccctcatcgggaacgaggaatataccgactacatgccctctatgaagcgctttcggagagaggaagaggaagctggagtgctgtggtga

SEQ ID NO: 20210 - RNA, 9876 nt, synthetic construct
  misc_feature 1..9876: note = derived and/or modified CDS sequence (opt5) from DENV-2__KC762676__SS-prME
  source 1..9876: mol_type = other RNA
accgccggaatcattatcatgatgattcccacagtgatggctttccacctgacgaccagaaacggggagcctcatatgatcgtgagccggcaggaaaagggaaaaagcctcctgtttaagaccgagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacccactttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacatcctgccacccttagaaagtattgcattgaagctaaactgacgaacacaaccaccgcctctcggtgtccgacacagggggagccctccctcaatgaggaacaagataagcgctttgtgtgcaaacacagcatggtcgacagaggatggggcaacggctgtgggctgttcggaaagggcgggatcgttacctgcgcgatgtttacatgcaagaaaaatatggagggaaagattgtgcagcctgaaaacctggagtacacgatcgtgattacaccccattctggcgaagagaatgccgtcgggaacgatacaggaaaacacggcaaggagatcaaagtgacccctcagtccagcatcacagaagctgagctcaccggctatgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcatgccaagaaacaggatgttgtggtcctgggaagccaagagggcgccatgcacacggctctcacaggggcgaccgaaatccagatgtcctctggcaacctgctttttacaggacatctgaagtgcagactccggatggacaaactgcagcttaagggcatgagctactccatgtgtaccgggaaattcaaggtggtcaaggagattgccgaaacccaacacggaacaatcgtgattagagttcagtatgagggcgacgggagcccctgcaaaatccccttcgagatcatggatctggaaaagcgccatgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcaccaagtgttcggggcgatttacggcgctgcctttagcggagtgtcctggacgatgaagatcctcattggcgttgtcatcacatggattgggatgaatagccggtctacctccctgagcgtgtctctggtgcttgtcggagtggttaccctctatctgggcgtgatggtccaggccgactccgggtgtgtggttagctggaaaaacaaggagctgaaatgcggatccggcatcttcatcacagataatgtgcacacctggacagaacagtacaagtttcagcctgagtctcccagcaagctcgcttccgccattcaaaaagctcatgaagaggggatctgtggcattagatctgtcacgcgcctggaaaaccttatgtggaagcagatcaccccggagctgaatcacattctcagcgagaacgaagtgaaactgacaatcatgaccggagacatcaagggcattatgcaggccgggaaacggtccctgagacctcagcccacagagcttaagtatagctggaaaacctggggaaaggcgaagatgctctctacggaactgcataatcacaccttcctgatcgatggccctgagacagccgaatgccccaacaccaatcgcgcttggaactccctcgaggttgaggactacgggtttggagtgttcacaaccaatatttggctgaaacttaaggaacggcaagatgtctattgtgacagcaaactgatgtctgccgctatcaaggacaacagagccgtgcacgcggatatgggctactggattgagtccgccctcaacgacacatggaaaatcgaaaaggctagctttatcgaggtgaagtcttgctattggcctaaaagccataccctgtggtccaatggcgtcctggagagcgaaatgattatccccaagaacttcgccgggccggtttctcagcacaattaccgccctggataccatacgcagacagctggcccctggcaccttgggcggctcgagatggatttcgacttttgtgaaggaaccaccgtggtggtcacagaggattgcggcaacagagggccctccctgcggaccacgacagccagcggaaaactgattaccgaatggtgctgtcgctcctgcacactccctccgctgagatatcggggcgaggacggctgttggtacgggatggagatcagaccccttaaggaaaaagaggaaaatctggtgaactctctcgttaccgccggacatggccagattgataatttcagcctgggggtgctgggaatggctctttttctcgaggaaatgctgcgcacacgggtcggcaccaagcacgcgatcctgctcgtggccgtttccttcgtgacgctgattaccgggaacatgtcttttagagaccttggacgcgtcatggtgatggttggcgctacaatgaccgatgacatcggcatgggggtgacatatctggccctcctggccgctttcaaggtcagacctacctttgccgcgggactgcttctgcggaaactcacgagcaaggagctgatgatgacaaccatcggcattgtgctcctgtcccaatctacaatccccgagaccattcttgaactgaccgatgctctcgccctggggatgatggccctgaaaatcgtgcgcaatatggagaagtaccagcttgctgtcacaattatggccatcctgtgcgttcctaacgcggtgatcctccagaatgcttggaaagtgagctgtacgaccctggccgtcgtgtccgttagccccctcctgcttacatcttcccaacagaaggccgactggattcctctggctctcaccatcaagggactgaaccccacagccattttcctgaccacgcttagcagaacatctaaaaagcggtcctggccgctgaatgaagctatcatggccgtgggcatggtcagcattctcgcgtcttccctgctcaaaaacgatatccctatgaccgggcccctggtggccggaggccttctgaccgtttgctatgtgctgacaggccgcagcgctgacctcgagctggaaagagccgctgacgtccggtgggaggagcaggccgaaatctccgggagctctcctattcttagcatcaccatttccgaggatggatctatgagcatcaagaatgaagaggaggaacagacactgacgattctcatccgcaccggcctgctcgtgatttccgggctgtttcccgtctctatcccgatcacagccgctgcgtggtacctttgggaggtgaaaaagcaaagagccggagttctgtgggacgtgccttctccccctcccgtcggcaaagctgaactggaggatggggcctatcggattaagcagaagggaatcctcggctactcccagattggcgccggggtgtacaaagaaggaaccttccacacaatgtggcatgttacccgcggcgctgtgctgatgcacaaggggaaaagaatcgagccctcctgggccgacgtcaagaaagatcttattagctatggaggcgggtggaagctggagggagaatggaaggagggcgaagaggtccaggtgctcgcgctggaacctggcaaaaacccgcgggctgttcaaacgaagcccgggctctttaaaaccaacacaggaaccatcggcgccgtctccctggacttcagccctgggacatctggatcccccatcgtggataagaaaggcaaggtggtcgggctttacggaaatggcgtggttaccagaagcggcacatatgtgtctgccattgctcagacggagaagtccatcgaggacaaccctgaaattgaggatgacatctttcgcaaaaagcggctgaccattatggatctgcatcccggggccggaaaaacaaagagatacctccctgcgatcgtccgcgaagctatcaaacggggcctgagaacccttattctggccccgacccgcgtggttgccgctgagatggaagaggccctccgggggctgcccatcagatatcagacccctgctattcgcgccgagcacacgggacgggaaatcgtggacctcatgtgtcatgcgaccttcacaatgagactgcttagccccattcgggtccctaattacaacctgatcattatggatgaggcccacttcaccgaccccgcttccatcgccgctcgcggctatatctctacaagagtggaaatgggggaggccgccggcatttttatgaccgctacgccgcctggaagccgggaccccttcccccagtccaatgcgcctatcatggatgaggaacgcgagattcccgaaagaagctggaactctggccacgagtgggttacagactttaaggggaagaccgtgtggttcgtcccttccatcaaagccggaaatgatattgctgcctgcctgcggaagaacggcaaaaaggtgatccaactcagcagaaaaacctttgacttcgaatacatcaagacacgcaccaatgattgggactttgtggtcacaaccgatatttctgagatgggggccaacttcaaggctgagcgggttatcgacccgagacgctgtatgaaacccgtgattctgacggatggagaagaacgggtgatccttgccggccctatgcccgtcacacatagctccgcggctcagagacgcgggcgggtgggcagaaatcctaagaacgaaaatgaccagtacatttatatgggagagcccctggaaaacgatgaggactgcgcccactggaaagaggccaagatgctcctggacaatatcaacaccccggaaggcatcattccttctatgtttgagcccgaacgcgagaaagttgatgctatcgacggggaatacagactgcggggagaggcccgcaagacattcgtggatctcatgagacggggcgaccttcctgtctggctggcgtatcgcgtggccgctgaggggattaactacgccgatagacggtggtgttttgacggagttaaaaataaccaaatcctggaagagaatgtggaagtcgagatttggaccaaggagggcgaaagaaagaaactcaagccccgctggctggatgctcggatctatagcgaccctcttgccctgaaagagttcaaggagttcgctgccgggagaaaatccctcacgctgaacctgattaccgagatgggccgcctccccacatttatgacccagaaggcgcggaatgcccttgataacctggctgtgctgcatacagccgaagctggaggcagagcctacaatcacgccctctctgagctgccggagacccttgaaacactgctcctgctgaccctccttgctacggtcacagggggaatcttcctgtttctgatgagcggcaaggggatcggaaaaatgaccctcggcatgtgctgcattatcaccgcgtccattctgctttggtatgcccagatccagcctcactggattgctgccagcatcatcctggagttctttctcattgtgctgctgatccccgaacccgagaagcaacggacacctcaggacaaccagctcacctacgttgtgattgccatccttacagtggtcgctgccacgatggcgaatgaaatgggcttcctggagaaaaccaagaaagattttgggctgggatctattacaacccagcaaccggagtccaacatcctcgacatcgatctgcgccccgccagcgcttggacactttacgccgttgctaccacgttcattacccctatgctgagacattccatcgaaaattctagcgtgaacgtgtccctcacagccattgcgaatcaggccaccgtcctgatgggcctggggaagggatggcccctctctaagatggacatcggcgtgagccttctggctattgggtgttattcccaggttaaccctatcacactgaccgccgctctcctgcttctggtggcccactacgctattatcggacccggcctccaggccaaagcgacgcgggaggcccaaaagcgcgctgccgctggcatcatgaaaaatcctacagtcgacgggattaccgtgatcgatctggacccgattccctatgatcctaagtttgaaaaacagctgggacaggtcatgctccttgtgctgtgcgttacacaggtgctgatgatgagaaccacctgggccctctgtgaggccctgacacttgcgacgggccccatcagcaccctgtgggaagggaaccctggacggttctggaatacaaccattgctgtctctatggccaacatctttcgcggctcctacctcgctggggccggactgctgttcagcatcatgaagaacacagccaataccagacggggcacgggcaacacaggggagaccctcggagagaagtggaaaaatcgccttaacgctctgggcaagtctgaatttcaaatttataaaaagtccgggatccaggaggtggacagaaccctggccaaagaaggaattaagcggggcgagacagatcatcacgcggttagcagagggtctgccaaactccgctggttcgtggagcggaatctggtcacccccgaaggaaaggtggtggaccttggctgcggcagagggggatggagctactattgtggcgggctgaagaacgttaaagaggtcaagggactcacaaaaggcgggccgggacatgaggaacctatccccatgtccacgtacggctggaatctggtgcgcctgcagtctggcgtggatgtcttctttacaccccctgaaaagtgcgacacactcctttgtgatattggggagagctcccccaaccctaccgttgaggctggacggacactgagagtgctgaatctcgtggaaaactggctgaataacaatacccaattctgcatcaaagtccttaacccgtacatgcccagcgtgatcgagaagatggaagccctgcagcgcaagtatggcggggctctcgttcggaatcctctgtccagaaactctacgcacgagatgtactgggtgagcaacgcctccggaaatattgtctctagcgtgaacatgatctcccgcatgctgattaatcggtttaccatgagacacaaaaaggcgacatatgaacccgacgttgatctcggctctgggacccgcaacatcggaattgagagcgagatccctaatcttgacatcattggcaaacggatcgaaaagattaaacaggagcatgaaacatcctggcactacgatcaggaccatccctatagaacctgggcctaccacggcagctatgagacaaagcaaaccgggtctgcttccagcatggtgaacggagtcgtgcgcctgctgacgaagccgtgggacgtgatccctatggtcacacagatggccatgaccgataccacacccttcggccagcagagagtttttaaagaaaaggtggacacgcggacccaagagcctaaagaggggacaaagaaactcatgaagattaccgctgaatggctgtggaaggagcttggcaaaaagaaaacaccccgcatgtgtaccagagaagagttcacacggaaggtgagatctaatgccgctctgggcgccatctttaccgatgagaacaaatggaagtccgcgcgggaagccgtcgaggacagcgggttctgggaactcgtggataaagagcgcaatctgcacctggaaggaaagtgcgagacgtgtgtttacaacatgatgggcaagagagagaaaaagctcggcgaatttgggaaagctaagggatctcgggccatttggtacatgtggctgggcgctcgcttccttgagtttgaagccctggggttcctcaatgaggaccattggttttccagagaaaacagcctgtccggagtggagggcgaggggcttcacaaactgggctatatcctccgggatgtcagcaagaaggaaggaggcgccatgtacgcggacgataccgctgggtgggacacacgcatcaccctggaggatctgaaaaatgaagagatggtgacaaaccatatggaaggagagcacaagaaactcgccgaggccattttcaagctgacctatcagaataaagttgtgagagtccagcggcctacgccccgcggcacagtgatggacatcatttctagacgggaccagcgcgggagcggacaagttgtgacctacggccttaacacattcaccaacatggaagctcagctgatcagacagatggagggggaaggcgtctttaagtccattcaacagctcacggtgaccgaggagatcgccgtcaagaattggctggtgcgggttggacgcgaaagactttctcggatggctatcagcggcgatgactgcgtggtcaaaccgctggatgacagattcgccaacgcgctcacagccctgaatgatatggggaaggtgcgcaaagacattcagcagtgggagccttcccggggatggaacgattggacccaagtgcccttttgctctcatcacttccacgaactgatcatgaaggacggcagagttctcgtggtcccctgtcgcaatcaggatgagctgattgggcgggctagaatcagccagggagccggctggtcccttcgcgaaacagcttgcctggggaaatcttatgcccagatgtggagcctcatgtactttcatcggagagacctgcgccttgcggccaacgctatttgttccgccgtgcctagccactgggttccgacctctcggacaacctggtccatccatgctacgcacgagtggatgacaaccgaggatatgctgaccgtgtggaatagagtctggatccaagaaaacccctggatggaggacaagacacctgtggaaagctgggaggaaattccctatctcggcaagcgcgaggatcagtggtgcggatctctgatcggcctgacctcccgggccacatgggctaaaaatattcagacggccatcaaccaggtcagaagcctcattgggaatgaggaatacaccgactacatgccttccatgaagcggttcagacgcgaggaagaggaagcgggagtgctgtggtga

SEQ ID NO: 20211 - RNA, 9876 nt, synthetic construct
  misc_feature 1..9876: note = derived and/or modified CDS sequence (opt5) from DENV-2__KC762662__SS-prME
  source 1..9876: mol_type = other RNA
acagccggcatcattatcatgatgattcccacagtgatggctttccacctgacgaccagaaacggggagcctcatatgatcgtcagccggcaggaaaaggggaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcatggatctggaaaagcgccacgtgctcggacggctgattaccgtcaatcctatcgtgacagagaaagactctccggttaacattgaagccgagcccccttttggcgattcctacatcattatcggggtggaacccggccagctgaagctcagctggttcaaaaagggatctagcattggccagatgtttgagaccacaatgagaggggctaagcgcatggccatcctgggagacaccgcctgggatttcggctcccttgggggagtctttacgtctatcggcaaagctctgcatcaagtgttcggggccatttatggcgcggcttttagcggagtgtcctggacaatgaagatcctcattggcgttgtcatcacctggattgggatgaatagccggtctacctccctgagcgtgtctctggtgcttgtcggagtggttacactctacctgggcgtgatggtccaggccgactccgggtgtgtggttagctggaaaaacaaggagctgaaatgcggatccggcatcttcatcaccgataatgtgcacacatggacggaacagtataagtttcagcctgagtctcccagcaagctcgcctccgctattcaaaaagcccacgaagaggggatctgtggcattagatctgtcacccgcctggaaaaccttatgtggaagcagatcacaccggagctgaatcatattctcagcgagaacgaagtgaaactgaccatcatgacaggagacatcaagggcattatgcaggctgggaaacggtccctgagacctcagcccaccgagcttaagtacagctggaaaacgtggggaaaggccaagatgctctctaccgaactgcacaatcatacattcctgatcgatggccctgagaccgcggaatgccccaacgccaatcgcgcttggaactccctcgaggttgaggactatgggtttggagtgttcacaaccaatatttggctgaaacttaaggaacggcaagatgccttttgtgacagcaaactgatgtctgctgccatcaaggacaacagagcggtccacgccgatatgggctactggattgagtccgctctcaacgacacatggaaaatcgaaaaggccagcttcatcgaggtgaagtcttgccactggcctaaaagccataccctgtggtccaatggcgtgctggagagcgaaatgattatccccaagaacttcgctgggccggtctctcagcacaattatcgccctggataccatacgcagacagccggcccctggcaccttgggcggctcgagatggattttgacttctgtgaaggaaccaccgttgtggtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtcaactctctcgtgaccgctggacatggccagattgataattttagcctgggggttctgggaatggcgcttttcctcgaggaaatgctgcgcacacgggtgggcaccaagcacgccatcctgctcgtcgctgtgtcctttgttacgctgattaccgggaacatgtctttcagagaccttggacgcgtgatggtcatggtgggcgccacaatgaccgatgacatcggcatgggggttacatacctggccctcctggctgcctttaaggtgagacctaccttcgcggctggactgcttctgcggaaactcacgagcaaggagctgatgatgacaaccatcggcattacactcctgtcccaatctaccatccccgagaccattcttgaactgacagatgccctcgccctggggatgatggtcctgaaaatcgtgcgcaatatggagaagtatcagcttgctgtgacgattatggccatcctgtgcgtccctaacgcggttatcctccagaatgcttggaaagtgagctgtaccacactggccgtggtctccgtgagccccctcctgcttacctcttcccaacagaaggccgactggattcctctggctctcacaatcaagggactgaaccccaccgccatttttctgacgacacttagcagaacctctaaaaagcggtcctggccgctgaatgaagctatcatggccgttggcatggtgagcattctcgcgtcttccctgctcaaaaacgatatccctatgaccgggcccctggtcgccggaggccttctgacagtgtgctacgttctgaccggccgcagcgctgacctcgagctggaaagagccgctgacgtgcggtgggaggagcaggccgaaatctccgggagctctcctattcttagcatcacaatttccgaggatggatctatgagcatcaagaatgaagaggaggaacagacgctgaccattctcatccgcacaggcctgctcgtcatttccgggctgttccccgtgtctatcccgatcaccgccgctgcgtggtatctttgggaggtcaaaaagcaaagagccggagtgctgtgggacgttccttctccccctcccgtgggcaaagctgaactggaggatggggcctaccggattaagcagaagggaatcctcggctattcccagattggcgccggggtctacaaagaaggaacatttcacaccatgtggcatgtgacgcgcggcgctgttctgatgcacaaggggaaaagaatcgagccctcctgggccgacgtgaagaaagatcttattagctacggaggcgggtggaagctggagggagaatggaaggagggcgaagaggtccaggtgctcgcgctggaacctggcaaaaacccgcgggctgtgcaaaccaagcccggactcttcaaaacatccaccggaacaatcggcgccgttagcctggacttttctcctgggacctccggaagccccatcgtcgataagaaaggcaaggtggtggggctttatggaaacggcgtcgtgacaagatctggcacgtacgtttccgccattgctcagaccgaaaagagcatcgaggacaatcctgaaattgaggatgacatcttccgcaaaaagcggctgacaattatggatctgcatcccggggccggaaaaaccaagagatatctccctgcgatcgtgcgcgaagctatcaaacggggcctgagaacccttattctggccccgacacgcgtcgtggccgctgagatggaagaggccctccgggggctgcccatcagataccagacgcctgctattcgcgccgagcacaccggacgggaaatcgttgacctcatgtgtcatgcgacattcaccatgagactgctttcccccattcgggtgcctaactataatctgatcattatggatgaggcccactttacagaccccgcttctatcgccgctcgcggctacatcagcaccagagtcgaaatgggggaggccgccggcattttcatgacggctacaccgcctggatcccgggacccctttccccagagcaacgcgcctatcatggatgaggaacgcgagattcccgaaagatcttggaatagcggccacgagtgggtgaccgacttcaaggggaagaccgtttggtttgtgcctagcatcaaagccggaaacgatattgctgcctgcctgcggaagaatggcaaaaaggtcatccaactctctagaaaaacattcgactttgaatatatcaagacccgcacaaacgattgggacttcgtggtgaccacggatattagcgagatgggggccaattttaaggctgagcgggtcatcgacccgagacgctgtatgaaacccgttattctgacagatggagaagaacgggtgatccttgccggccctatgcccgtgacccattcctctgcggctcagagacgcgggcgggtcggcagaaaccctaagaatgaaaacgaccagtacatttacatgggagagcccctggaaaatgatgaggactgcgcccactggaaagaggccaagatgctcctggacaacatcaatacaccggaaggcatcattcctagcatgttcgagcccgaacgcgagaaagtggatgctatcgacggggaatatagactgcggggagaggcccgcaagacctttgttgatctcatgagacggggcgaccttcctgtgtggctggcgtaccgcgtcgccgctgaggggattaactatgccgatagacggtggtgtttcgacggagtgaaaaacaatcaaatcctggaagagaacgttgaagtggagatttggacgaaggagggcgaaagaaagaaactcaagccccgctggctggatgctcggatctactccgaccctcttgccctgaaagagttcaaggaatttgctgccgggagaaaatctctcaccctgaatctgattacagagatgggccgcctccccaccttcatgacacagaaggcgcggaacgcccttgataatctggctgtcctgcataccgccgaagctggaggcagagcctataaccacgccctcagcgagctgccggagacacttgaaaccctgctcctgctgacgctccttgctacagtgaccgggggaatctttctgttcctgatgtccggcaagggggtcggaaaaatgaccctcggcatgtgctgcatcattacagcgagcatcctgctttggtacgcccagattcagcctcactggatcgctgcctctattatcctggagtttttcctcatcgtgctgctgattcccgaacccgagaagcaacggacccctcaggacaatcagctcacatatgttgtgatcgccattcttacggtggtcgctgccaccatggcgaacgaaatgggctttctggagaaaacaaagaaagatttcgggctgggatccatcaccacacagcaaccggagagcaatattctcgacatcgatctgcgccccgcctccgcttggaccctttacgccgttgctacgacctttatcacacctatgctgagacattctattgaaaacagctccgtgaatgtgtctctcaccgccatcgcgaaccaggccacagtcctgatgggcctggggaagggatggcccctcagcaagatggacattggcgtgcctcttctggctatcgggtgttactcccaggttaatcccattaccctgacggccgctctcctgcttctggtggcccactatgctatcattggacctggcctccaggccaaagcgacacgggaggcccaaaagcgcgctgccgctggcatcatgaaaaacccgaccgtcgacgggatcacagtgattgatctggaccccatcccttacgatcccaagttcgaaaaacagctgggacaggtcatgctccttgtgctgtgcgttacccaggtgctgatgatgagaaccacatgggccctctgtgaggccctgacgcttgcgaccggccctattagcacactgtgggaagggaatcccggacggttttggaacaccacaatcgctgtctctatggccaatattttccgcggctcctatctcgctggggccggactgctgtttagcatcatgaagaacaccgccaacacgagacggggcacaggcaataccggggagaccctcggagagaagtggaaaaaccgccttaatgctctgggcaagtctgagttccaaatctacaaaaagtccgggattcaggaggtggacagaacactggccaaagaaggaatcaagcggggcgagaccgatcatcacgcggttagcagagggtctgccaaactccgctggttcgtggagcggaacctggtcacaccggaaggaaaggtggtggaccttggctgcggcagagggggatggagctattactgtggcgggctgaagaatgttaaagaggtcaagggactcacgaaaggcgggcctggacatgaggaacccattcccatgtccacctatggctggaacctggtgcgcctgcagtctggcgtggatgtctttttcacacctcccgaaaagtgcgacaccctcctttgtgatatcggggagagctcccctaatccgacagttgaggctggacggaccctgagagtgctgaacctcgtggaaaattggctgaacaataacacgcaattttgcattaaagtccttaatccctacatgcctagcgtgatcgagaagatggaagccctgcagcgcaagtacggcggggctctcgttcggaaccccctgtccagaaattctacccacgagatgtattgggtgagcaacgcctccggaaacatcgtctctagcgtgaatatgatttcccgcatgctgatcaaccggttcacaatgagacacaaaaaggcgacctacgaacctgacgttgatctcggctctgggacacgcaatattggaatcgagagcgagacccccaaccttgacattatcggcaaacggatcgaaaagattaaacaggagcatgaaacatcctggcactatgatcaggaccatccgtacaagacctgggcctatcacggcagctacgagacgaagcaaacagggtctgcttccagcatggtgaatggagtcgtgagactgctgaccaaaccttgggacgtgatccccatggtcacccagatggccatgacagatacgaccccttttggccagcagcgcgttttcaaggaaaaagtggacacaagaacccaagagcccaaggaggggaccaaaaagctcatgaagattaccgctgaatggctgtggaaagagcttggaaagaaaaagacacctcggatgtgtacccgcgaagagtttacgagaaaagtgcggtctaacgccgctctgggcgccatcttcaccgatgagaataagtggaaatccgcgagagaagccgtcgaggacagcgggttttgggaactcgtggataaggagcggaacctgcacctggaaggaaagtgcgagacatgtgtttataatatgatgggcaaacgcgagaagaaactcggcgagttcgggaaggctaaaggatctagagccatttggtacatgtggctgggcgctcggtttcttgagttcgaagccctggggtttctcaacgaggaccattggttctcccgcgaaaatagcctgtccggagtggagggcgaggggcttcacaagctgggctacatcctcagagatgtcagcaagaaagaaggaggcgccatgtatgcggacgataccgctgggtgggacacacggattaccctggaggatctgaagaacgaagagatggtgacgaatcatatggaaggagagcacaaaaagctcgccgaggccatcttcaaactgacataccagaacaaggttgtgcgcgtccagagacccaccccgcggggcacagtgatggacatcatttctcgcagagaccagcgggggagcggacaagttgtgacctatggccttaatacgtttaccaacatggaagctcagctgatccgccagatggagggggaaggcgtcttcaagtccattcaacagctcacagtgaccgaggagatcgccgtcaaaaactggctggtgacagttggaagagaacggctttctcgcatggctattagcggcgatgactgcgtggtcaagcctctggatgacagatttgcctccgcgctcaccgccctgaatgatatggggaaagtgcggaaggacatccagcagtgggagccctctagaggatggaacgattggacacaagtgcccttctgcagccatcactttcacgaactgatcatgaaagacggccgcgttctcgtggtcccttgtcggaatcaggatgagctgattgggagagctcgcatctcccagggagccggctggtctcttcgggaaaccgcttgcctgggaaagagctacgcccagatgtggtccctcatgtatttccatagacgcgacctgcggcttgcggccaacgctatttgtagcgccgtgccgtctcactgggttcccacgtccagaacaacctggagcatccatgctacccacgagtggatgacaaccgaggatatgctgacagtgtggaatcgcgtctggattcaagaaaacccttggatggaggacaagacgcccgtggaatcttgggaggaaatcccttacctcggcaaacgggaggatcagtggtgcggatccctgatcggcctgaccagcagagccacatgggctaagaatattcagaccgccatcaaccaggtccgctccctcattgggaatgaggaatatacagactacatgccctctatgaaacggtttagacgggaggaagaggaagcgggagtgctgtggtga

SEQ ID NO: 20212 - RNA, 9876 nt, synthetic construct
  misc_feature 1..9876: note = derived and/or modified CDS sequence (opt5) from DENV-2__KC762661__SS-prME
  source 1..9876: mol_type = other RNA
acagccggcatcattatcatgatgattcccacagtgatggctttccacctgacgaccagaaacggggagcctcatatgatcgtcagccggcaggaaaaggggaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcatggatctggaaaagcgccacgtgctcggacggctgattaccgtcaatcctatcgtgacagagaaagactctccggttaacattgaagccgagcccccttttggcgattcctacatcattatcggggtggaacccggccagctgaagctcagctggttcaaaaagggatctagcattggccagatgtttgagaccacaatgagaggggctaagcgcatggccatcctgggagacaccgcctgggatttcggctcccttgggggagtctttacgtctatcggcaaagctctgcatcaagtgttcggggccatttatggcgcggcttttagcggagtgtcctggacaatgaagatcctcattggcgttgtcatcacctggattgggatgaatagccggtctacctccctgagcgtgtctctggtgcttgtcggagtggttacactctacctgggcgtgatggtccaggccgactccgggtgtgtggttagctggaaaaacaaggagctgaaatgcggatccggcatcttcatcaccgataatgtgcacacatggacggaacagtataagtttcagcctgagtctcccagcaagctcgcctccgctattcaaaaagcccacgaagaggggatctgtggcattagatctgtcacccgcctggaaaaccttatgtggaagcagatcacaccggagctgaatcatattctcagcgagaacgaagtgaaactgaccatcatgacaggagacatcaagggcattatgcaggctgggaaacggtccctgagacctcagcccaccgagcttaagtacagctggaaaacgtggggaaaggccaagatgctctctaccgaactgcacaatcatacattcctgatcgatggccctgagaccgcggaatgccccaacgccaatcgcgcttggaactccctcgaggttgaggactatgggtttggagtgttcacaaccaatatttggctgaaacttaaggaacggcaagatgccttttgtgacagcaaactgatgtctgctgccatcaaggacaacagagcggtccacgccgatatgggctactggattgagtccgctctcaacgacacatggaaaatcgaaaaggccagcttcatcgaggtgaagtcttgccactggcctaaaagccataccctgtggtccaatggcgtgctggagagcgaaatgattatccccaagaacttcgctgggccggtctctcagcacaattatcgccctggataccagacgcagacagccggcccctggcatcttgggcggctcgagatggattttgacttctgtgaaggaaccaccgttgtggtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtcaactctctcgtgaccgctggacacggccaaattgataattttagcctgggggttctgggaatggcgcttttcctcgaggaaatgctgcgcacacgggtgggcaccaagcatgccatcctgctcgtcgctgtgtcctttgttacgctgattaccgggaacatgtctttcagagaccttggacgcgtgatggtcatggtgggcgccacaatgaccgatgacatcggcatgggggttacatacctggccctcctggctgcctttaaggtgagacctaccttcgcggctggactgcttctgcggaaactcacgagcaaggagctgatgatgacaaccatcggcattacactcctgtcccagtctaccatccccgagaccattcttgaactgacagatgccctcgccctggggatgatggtcctgaaaatcgtgcgcaatatggagaagtatcagcttgctgtgacgattatggccatcctgtgcgtccctaacgcggttatcctccaaaatgcttggaaagtgagctgtaccacactggccgtggtctccgtgagccccctcctgcttacctcttcccagcagaaggccgactggattcctctggctctcacaatcaagggactgaaccccaccgccatttttctgacgacacttagcagaacctctaaaaagcggtcctggccgctgaatgaagctatcatggccgttggcatggtgagcattctcgcgtcttccctgctcaaaaacgatatccctatgaccgggcccctggtcgccggaggccttctgacagtgtgctacgttctgaccggccgcagcgctgacctcgagctggaaagagccgctgacgtgcggtgggaggagcaggccgaaatctccgggagctctcctattcttagcatcacaatttccgaggatggatctatgagcatcaagaatgaagaggaggaacaaacgctgaccattctcatccgcacaggcctgctcgtcatttccgggctgttccccgtgtctatcccgatcaccgccgctgcgtggtatctttgggaggtcaaaaagcagagagccggagtgctgtgggacgttccttctccccctcccgtgggcaaagctgaactggaggatggggcctaccggattaagcagaagggaatcctcggctattcccagattggcgccggggtctacaaagaaggaacatttcacaccatgtggcacgtgacgcgcggcgctgttctgatgcataaggggaaaagaatcgagccctcctgggccgacgtgaagaaagatcttattagctacggaggcgggtggaagctggagggagaatggaaggagggcgaagaggtccaagtgctcgcgctggaacctggcaaaaacccgcgggctgtgcagaccaagcccggactcttcaaaacatccaccggaacaatcggcgccgttagcctggacttttctcctgggacctccggaagccccatcgtcgataagaaaggcaaggtggtggggctttatggaaacggcgtcgtgacaagatctggcacgtacgtttccgccattgctcagaccgaaaagagcatcgaggacaatcctgaaattgaggatgacatcttccgcaaaaagcggctgacaattatggatctgcaccccggggccggaaaaaccaagagatatctccctgcgatcgtgcgcgaagctatcaaacggggcctgagaacccttattctggccccgacacgcgtcgtggccgctgagatggaagaggccctccgggggctgcccatcagataccagacgcctgctattcgcgccgagcataccggacgggaaatcgttgacctcatgtgtcacgcgacattcaccatgagactgctttcccccattcgggtgcctaactataatctgatcattatggatgaggcccattttacagaccccgcttctatcgccgctcgcggctacatcagcaccagagtcgaaatgggggaggccgccggcattttcatgacggctacaccgcctggatcccgggacccctttccccaaagcaacgcgcctatcatggatgaggaacgcgagattcccgaaagatcttggaatagcggccacgagtgggtgaccgacttcaaggggaagaccgtttggtttgtgcctagcatcaaagccggaaacgatattgctgcctgcctgcggaagaatggcaaaaaggtcatccagctctctagaaaaacattcgactttgaatatatcaagacccgcacaaacgattgggacttcgtggtgaccacggatattagcgagatgggggccaattttaaggctgagcgggtcatcgacccgagacgctgtatgaaacccgttattctgacagatggagaagaacgggtgatccttgccggccctatgcccgtgacccactcctctgcggctcagagacgcgggcgggtcggcagaaaccctaagaatgaaaacgaccaatacatttacatgggagagcccctggaaaatgatgaggactgcgcccattggaaagaggccaagatgctcctggacaacatcaatacaccggaaggcatcattcctagcatgttcgagcccgaacgcgagaaagtggatgctatcgacggggaatatagactgcggggagaggcccgcaagacctttgttgatctcatgagacggggcgaccttcctgtgtggctggcgtaccgcgtcgccgctgaggggattaactatgccgatagacggtggtgtttcgacggagtgaaaaacaatcagatcctggaagagaacgttgaagtggagatttggacgaaggagggcgaaagaaagaaactcaagccccgctggctggatgctcggatctactccgaccctcttgccctgaaagagttcaaggaatttgctgccgggagaaaatctctcaccctgaatctgattacagagatgggccgcctccccaccttcatgacacagaaggcgcggaacgcccttgataatctggctgtcctgcacaccgccgaagctggaggcagagcctataaccatgccctcagcgagctgccggagacacttgaaaccctgctcctgctgacgctccttgctacagtgaccgggggaatctttctgttcctgatgtccggcaaggggatcggaaaaatgaccctcggcatgtgctgcattatcacagcgagcattctgctttggtacgcccagatccaacctcactggattgctgcctctatcatcctggagtttttcctcattgtcctgctgatccccgaacccgagaagcagcggacccctcaggacaatcagctcacatatgtggttattgccatccttacggtggtggctgccaccatggcgaacgaaatgggctttctggagaaaacaaagaaagatttcgggctgggatccattaccacacaacagccggagagcaatatcctcgacatcgatctgcgccccgcctccgcttggaccctttacgccgtcgctacgacctttattacacctatgctgagacactctatcgaaaacagctccgttaatgtgtctctcaccgccattgcgaaccaggccacagtgctgatgggcctggggaagggatggcccctcagcaagatggacatcggcgtccctcttctggctattgggtgttactcccaggtgaatcccatcaccctgacggccgctctcctgcttctggttgcccattatgctattatcggacctggcctccaagccaaagcgacacgggaggcccagaagcgcgctgccgctggcatcatgaaaaacccgaccgtggacgggattacagtcatcgatctggaccccattccttacgatcccaagttcgaaaaacagctgggacaggtgatgctccttgtcctgtgcgtgacccaagttctgatgatgagaaccacatgggccctctgtgaggccctgacgcttgcgaccggccctatcagcacactgtgggaagggaatcccggacggttttggaacaccacaattgctgtgtctatggccaatatcttccgcggctcctatctcgctggggccggactgctgtttagcatcatgaagaacaccgccaacacgagacggggcacaggcaataccggggagaccctcggagagaagtggaaaaaccgccttaatgctctgggcaagtctgagttccagatttacaaaaagtccgggatccaggaggtcgacagaacactggccaaagaaggaattaagcggggcgagaccgatcaccatgcggtgagcagagggtctgccaaactccgctggttcgttgagcggaacctggtgacaccggaaggaaaggtcgtggaccttggctgcggcagagggggatggagctattactgtggcgggctgaagaatgtgaaagaggttaagggactcacgaaaggcgggcctggacacgaggaacccatccccatgtccacctatggctggaacctggtccgcctgcaatctggcgtggatgtgtttttcacacctcccgaaaagtgcgacaccctcctttgtgatattggggagagctcccctaatccgacagtcgaggctggacggaccctgagagttctgaacctcgtggaaaattggctgaacaataacacgcagttttgcatcaaagtgcttaatccctacatgcctagcgtcatcgagaagatggaagccctgcagcgcaagtacggcggggctctcgtgcggaaccccctgtccagaaattctacccatgagatgtattgggttagcaacgcctccggaaacattgtgtctagcgtcaatatgatctcccgcatgctgattaaccggttcacaatgagacacaaaaaggcgacctacgaacctgacgtggatctcggctctgggacacgcaatatcggaattgagagcgagacccccaaccttgacatcatcggcaaacggattgaaaagatcaaacaggagcacgaaacatcctggcattatgatcaagaccacccgtacaagacctgggcctatcatggcagctacgagacgaagcagacagggtctgcttccagcatggttaatggagtggtcagactgctgaccaaaccttgggacgtgattcccatggtgacccagatggccatgacagatacgaccccttttggccagcaacgcgtcttcaaggaaaaagttgacacaagaacccaggagcccaaggaggggaccaaaaagctcatgaagatcaccgctgaatggctgtggaaagagcttggaaagaaaaagacacctcggatgtgtacccgcgaagagtttacgagaaaagtgcggtctaacgccgctctgggcgccattttcaccgatgagaataagtggaaatccgcgagagaagccgtggaggacagcgggttttgggaactcgtcgataaggagcggaacctgcacctggaaggaaagtgcgagacatgtgtgtataatatgatgggcaaacgcgagaagaaactcggcgagttcgggaaggctaaaggatctagagccatctggtacatgtggctgggcgctcggtttcttgagttcgaagccctggggtttctcaacgaggaccactggttctcccgcgaaaatagcctgtccggagttgagggcgaggggcttcataagctgggctacattctcagagatgtgagcaagaaagaaggaggcgccatgtatgcggacgataccgctgggtgggacacacggatcaccctggaggatctgaagaacgaagagatggtcacgaatcacatggaaggagagcataaaaagctcgccgaggccatcttcaaactgacataccagaacaaggtggttcgcgtgcagagacccaccccgcggggcacagtcatggacattatctctcgcagagaccaacgggggagcggacaggtggttacctatggccttaatacgtttaccaacatggaagctcagctgattcgccaaatggagggggaaggcgtgttcaagtccatccagcagctcacagtcaccgaggagattgccgtgaaaaactggctggtcagagtgggacgggaacgcctttctagaatggctatcagcggcgatgactgcgttgtgaagcctctggatgaccggtttgcctccgcgctcacagccctgaatgatatggggaaagtcagaaaggacatccagcaatgggagccctctcgcggatggaacgattggacccaggtgcccttctgcagccaccattttcacgaactgattatgaaagacggccgggtgctcgttgtgccttgtagaaatcaggatgagctgatcgggcgcgctcggatttcccagggagccggctggtctcttagagaaacagcttgcctgggaaagagctacgcccaaatgtggtccctcatgtatttccaccgccgggacctgagacttgcggccaacgctatctgtagcgccgtcccgtctcattgggtgcccacctcccgcacgacatggagcattcacgctacccatgagtggatgaccacagaggatatgctgaccgtttggaatcgggtgtggatccaggaaaacccttggatggaggacaagacacccgtcgaatcttgggaggaaatcccttacctcggcaaaagagaggatcagtggtgcggatccctgattggcctgacgagccgcgccacctgggctaagaatatccagacagccattaaccaagtgcggtccctcatcgggaatgaggaatataccgactacatgccctctatgaaaagatttcggagagaggaagaggaagcgggagtcctgtggtga

SEQ ID NO: 20213 - RNA, 9876 nt, synthetic construct
  misc_feature 1..9876: note = derived and/or modified CDS sequence (opt5) from DENV-2__KC762655__SS-prME
  source 1..9876: mol_type = other RNA
acagccggaatcattatcatgatgattcccacagtgatggctttccacctgacgaccagaaacggggaacctcatatgatcgtcagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaaggtggtgcagcctgaaaacctggagtataccattgtcatcacaccccactctggcgaagagaatgcggtggggaacgataccggaaaacatggcaaggagattaaagttacacctcagtccagcatcaccgaagccgagctcacgggctacgggaccgtgacaatggaatgttctccccggaccggactggacttcaatgagatggtccttctgcagatggaaaacaaggcttggctcgtgcaccgccaatggtttctggatcttccgctgccttggctccccggcgccgacacacaggggtccaactggatccagaaagagaccctggttacgttcaagaatcctcacgctaagaaacaggatgtggtcgtgctgggaagccaagagggcgccatgcatacagccctcaccggggctacagaaattcagatgtcctctggcaacctgctttttaccggacacctgaagtgcagactccggatggacaaactgcagcttaagggcatgagctattccatgtgtaccgggaaattcaaggtcgtgaaggagatcgcggaaacacaacatggaacgattgttatcagagtgcagtacgagggcgacgggagcccctgcaaaattcccttcgagatcatggatctggaaaagcgccacgtcctcggacggctgatcaccgtgaatcctattgttacagagaaagactctccggtgaacatcgaagccgagcccccttttggcgattcctacattatcattggggtcgaacccggccagctgaagctcagctggttcaaaaagggatctagcatcggccagatgtttgagaccacaatgagaggggctaagcgcatggccattctgggagacaccgcctgggatttcggctcccttgggggagtgtttacgtctatcggcaaagctctgcatcaagtgttcggggccgtttatggcgcggcttttagcggagtctcctggacaatgaagatcctcattggcgtggtgatcacctggattgggatgaatagccggtctacctccctgagcgtctctctggtgcttgttggagtggtcacactctacctgggcgtgatggttcaggccgactccgggtgtgtggtcagctggaaaaacaaggagctgaaatgcggatccggcatcttcattaccgataatgtgcacacatggacggaacagtataagtttcagcctgagtctcccagcaagctcgcctccgctatccaaaaagcccacgaagaggggatctgtggcattagatctgttacccgcctggaaaaccttatgtggaagcagatcacaccggagctgaatcatattctcagcgagaacgaagtgaaactgaccatcatgacaggagacattaagggcatcatgcaggctgggaaacggtccctgagacctcagcccaccgagcttaagtacagctggaaagcctggggaaaggcgaagatgctctctacggaactgcacaatcataccttcctgatcgatggccctgagacagccgaatgccccaacaccaatcgcgcttggaactccctcgaggtcgaggactatgggtttggagtgttcacaaccaatatttggctgaaacttaaggaacggcaagatgtgttttgtgacagcaaactgatgtctgccgctatcaaggacaacaaagccgtccacgcggatatgggctactggattgagtccgccctcaacgacacatggaagatcgaaaaggctagcttcattgaggttaaatcttgccactggcctaagagccataccctgtggtccaatggcgtgctggagagcgaaatgatcatccccaaaaacttcgccgggccggtgtctcagcacaattatagacctggataccatacgcagacagctggcccctggcaccttgggcgcctcgagatggattttgacttctgtgaaggaaccaccgtcgtggttacagaggattgcggcaaccgggggccctccctgagaaccacgacagccagcggaaagctgattaccgaatggtgctgtcggtcctgcacactccctccgctgcgctacagaggcgaggacggctgttggtatgggatggagatccggccccttaaagaaaaggaggaaaatctggtgaactctctcgtcaccgccggacatggccagattgataattttagcctgggggtgctgggaatggctcttttcctcgaggaaatgctgagaacacgcgttggcaccaagcacgcgatcctgctcgtggccgtctcctttgtgacgctgattaccgggaacatgtctttccgggaccttggaagagttatggtgatggtcggcgctacaatgaccgatgacatcggcatgggggtgacatacctggccctcctggccgcttttaaagtgcgccctaccttcgccgcgggactgcttctgagaaagctcacgagcaaagagctgatgatgacaaccattggcatcgtcctcctgtcccaatctacaatccccgagaccattcttgaactgaccgatgctctcgccctggggatgatggttctgaagatcgtgcggaatatggagaaatatcagcttgccgtgacaattatggctatcctgtgcgtccctaacgccgtgattctccagaatgcgtggaaggttagctgtacgaccctggctgtggtctccgtgagccccctcctgcttacatcttcccaacagaaggccgactggatccctctggccctcaccatcaaaggactgaaccccacagctatttttctgaccacgcttagccgcacatctaagaaaagatcctggccgctgaatgaagccatcatggctgttggcatggtgagcattctcgcctcttccctgctcaagaacgatatccctatgaccgggcccctggtcgcgggaggccttctgaccgtgtgctacgtcctgacaggccggagcgccgacctcgagctggaacgcgctgccgacgtgagatgggaggagcaggctgaaatttccgggagctctcctatccttagcatcaccatttccgaggatggatctatgagcatcaaaaatgaagaggaggaacagacactgacgattctcatccggaccggcctgctcgttatttccgggctgttccccgtgtctatcccgattacagccaccgcctggtatctttgggaggtcaagaaacaacgcgctggagtgctgtgggacgttccttctccccctcccgtgggcaaggcggaactggaggatggggcctacagaatcaagcagaaaggaatcctcggctattcccagattggcgctggggtctacaaggaaggaacatttcacaccatgtggcatgtgacgcggggcgccgtgctgatgcacaaagggaagcgcatcgagccctcctgggccgacgttaaaaaggatcttattagctacggaggcgggtggaagctggagggagaatggaaagagggcgaagaggtccaggtgctcgctctggaacctggcaagaacccgagagccgtgcaaaccaaacccggactcttcaagacaaacaccggaacaatcggcgcggtctccctggactttagccctgggacctctggatcccccattgtggataaaaagggcaaggttgtggggctttatggaaatggcgtcgtgacacggagcggcacgtacgtttctgctatcgcccagaccgagaaatccatcgaggacaaccctgaaattgaggatgacatcttcagaaagaaacgcctgacaattatggatctgcatcccggggccggaaagaccaaacggtatctccctgctatcgtgagagaagccattaagcgcggcctgcggacccttatcctggcgccgacaagagtcgtggctgccgagatggaagaggccctccgcgggctgcccatccggtaccagacgcctgctattagagccgagcacaccggacgcgaaatcgttgacctcatgtgtcatgctacattcaccatgcggctgcttagccccattagagtgcctaattataacctgatcattatggatgaggcccactttacagaccccgcgtccatcgccgctcggggctacatttctacccgcgtcgaaatgggggaggccgctggcatcttcatgacggccacaccgcctggaagcagagacccctttccccagtccaatgcccctatcatggatgaggaacgggagattcccgaacgcagctggaactctggccacgagtgggtgaccgacttcaaggggaaaaccgtgtggtttgtcccttccatcaaggctggaaatgatattgcggcctgcctgcgcaaaaacggcaagaaagttatccaactcagccggaagacattcgactttgaatatattaagaccagaacaaatgattgggacttcgtggtgaccacggatatctctgagatgggggctaactttaaagccgagcgcgtcatcgacccgcggagatgtatgaagcccgtgattctgacagatggagaagaaagagttatccttgccggccctatgcccgtgacccatagctccgctgcccagcggagagggcgcgtcggccggaatcctaaaaacgaaaatgaccagtacatttacatgggagagcccctggaaaacgatgaggactgcgcgcactggaaggaggctaaaatgctcctggacaatatcaacacaccggaaggcattatcccttctatgttcgagcccgaaagagagaaggtggatgccatcgacggggaatatcgcctgagaggagaggcccggaaaacctttgttgatctcatgcgcagaggcgaccttcctgtgtggctggcttaccgggtcgccgcggaggggattaactatgccgatcgcagatggtgtttcgacggagtgaagaataaccaaatcctggaagagaatgtcgaagtggagatttggacgaaggagggcgaacggaaaaagctcaaacccagatggctggatgctcgcatctacagcgaccctcttgccctgaaggagttcaaagaatttgctgccgggcggaagtccctcaccctgaacctgattacagagatgggcagactccccaccttcatgacacagaaggctcgcaatgcccttgataacctggcggttctgcataccgccgaagctggaggccgggcctataatcacgctctctctgagctgccggagacacttgaaaccctgctcctgctgacgctccttgccacagtgaccgggggaatctttctgttcctgatgagcggcaaagggattggaaagatgaccctcggcatgtgctgcatcatcacagcctccattctgctttggtacgctcagatccagcctcactggattgcggccagcatcattctggagtttttcctcatcgtgctgctgatccccgaacccgagaaacaaagaacccctcaggacaaccagctcacatatgtcgttattgctatccttacggtggtggccgccaccatggctaatgaaatgggctttctggagaagaccaaaaaggatttcgggctgggatctattgccacccagcaaccggagtccaacatcctcgacattgatctgcggcccgcgagcgcctggacactttacgctgtcgccaccacgtttatcacccctatgctgcgccattccatcgaaaattctagcgtgaacgtttccctcacagctattgccaatcaggcgaccgtgctgatgggcctggggaagggatggcccctctctaaaatggacatcggcgtccctcttctggccattgggtgttacagccaggtgaaccccatcacactgaccgctgccctcctgcttctggtcgctcactatgccattatcggacctggcctccaggctaaggccacgagagaggcgcaaaaacgggccgctgccggcattatgaagaatccgacagtggacgggatcaccgttatcgatctggaccccattccttacgatcccaaattcgaaaagcagctgggacaggtgatgctccttgtcctgtgcgtgacacaggttctgatgatgcgcaccacctgggctctctgtgaggccctgacacttgccacgggccctatctccaccctgtgggaagggaaccccggaagattttggaatacaaccattgcggtgagcatggctaacatcttccggggctcttatctcgccggggctggactgctgttttccattatgaagaacacagccaatacccgcagaggcacgggcaacacaggggagaccctcggagagaaatggaagaatcggcttaacgccctgggcaaaagcgagttccaaatctacaagaaatctgggatccaggaggtcgaccgcaccctggctaaggaaggaattaaaagaggcgagacagatcatcacgccgtgtcccgggggagcgcgaagctcagatggttcgtggagcgcaatctggttaccccggaaggaaaggtcgtggaccttggctgcggcagaggcgggtggtcttattactgtggagggctgaaaaacgtgaaggaggtcaaagggctcacaaagggcgggcctggacatgaagaacccatccccatgagcacgtatggctggaatctggttagactgcagtccggcgtggatgtgtttttcacccctcccgaaaaatgcgacacactcctttgtgatattggggagtctagccctaacccgaccgtcgaggccggacgcacactgcgggtgctgaatctcgttgaaaactggctgaataacaatacccaattttgcatcaaggtgcttaacccctacatgccttccgtcattgagaagatggaagctctgcagagaaaatacggcggggccctcgtgcgcaatcccctgagccggaactccacgcacgagatgtattgggtttctaacgctagcggaaatatcgtgtcctctgtcaacatgatcagcagaatgctgattaatcgcttcaccatgcggcacaagaaagccacatacgaacctgacgtggatctcggctccgggaccagaaacatcggaattgagtctgagacacccaatcttgacatcattggcaagcgcatcgagaaaatcaagcaggagcatgaaaccagctggcactatgatcaggaccatccgtacaagacatgggcgtatcacggctcctacgagaccaaacaaacggggagcgcctcttccatggtgaacggagtcgttcggctgctgacaaagccttgggacgtgattcccatggtgacccagatggctatgaccgatacaacgccttttggccagcagagagtcttcaaagaaaaggtggacacccgcacacaagagcccaaagaggggaccaagaagctcatgaaaatcacagccgaatggctgtggaaggagcttggcaaaaagaaaacccctagaatgtgtacacgggaagagtttacccgcaaggttagaagcaatgctgccctgggcgctattttcacggatgagaacaaatggaagtctgcccgggaagcggtggaggactccgggttttgggaactcgtcgataaggagagaagcctgcacctggaaggaaaatgcgagacctgtgtgtataatatgatgggcaagcgggagaaaaagctcggcgagttcgggaaagccaagggatctcgcgctatctggtacatgtggctgggcgccagatttcttgagttcgaagctctggggtttctcaacgaggaccattggttctcccgggaaaatagcctgtccggagttgagggcgaggggcttcacaagctgggctacattctccgcgatgtgagcaaaaaggaaggaggcgccatgtatgccgacgatacagcggggtgggacaccagaatcacactggaggatctgaaaaacgaagagatggtcaccaatcatatggaaggagagcacaagaaactcgctgaggccattttcaagctgacgtaccagaacaaggtggttcgggtgcagcgccccacaccgagaggcatcgtcatggacatcatttctcggcgcgaccagagagggagcggacaagtggtcacctatggccttaatacatttaccaacatggaagcccagctgatccggcagatggagggggaaggcgtgttcaaatccattcaacagctcacggttaccgaggagatcgctgtgaagaactggctggcccgcgtcggaagagaacggctttctcgcatggctattagcggcgatgactgcgtggtgaaacctctggatgacagatttgcctccgcgctcacagccctgaatgatatggggaaggttcggaaagacatccagcagtgggagccctctagaggatggaacgattggacccaagtgcccttctgcagccatcactttcacgaactgatcatgaaggacggccgcgtcctcgtggttccttgtcggaatcaggatgagctgattgggagagctcgcatctcccagggagccggctggtctcttcgggaaacagcttgcctgggaaagagctacgcccagatgtggtccctcatgtatttccatagacgcgacctgcggcttgcggccaacgctatttgtagcgccgtgccgtctcactgggtccccacctccagaacaacctggagcatccatgctacgcacgagtggatgacaaccgaggatatgctgaccgtgtggaatcgcgtctggattcaagaaaacccttggatggaggacaaaacacccgtggaatcttgggaggaaatcccttacctcggcaagcgggaggatcagtggtgcggatccctgatcggcctgaccagcagagccacatgggctcgcaatattcagacggccatcaaccaggttcggtccctcattgggaatgaggaatataccgactacatgccctctatgaaaagatttcggagagaggaagaggaagcgggagtgctgtggtga

SEQ ID NO: 20214 - RNA, 9876 nt, synthetic construct
  misc_feature 1..9876: note = derived and/or modified CDS sequence (opt5) from DENV-2__KC762656__SS-prME
  source 1..9876: mol_type = other RNA
acagccggcatcattatcatgatgattcccacagtgatggctttccacctgacgaccagaaacggggagcctcatatgatcgtcagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagagccgaaacctggatgtctagcgagggcgcctggaagcacgctcagcggatcgagacgtgggttctgcgccatcccggcttcacaattatggccgctatcctggcctacaccattgggacaacctattttcagagagtgctcatcttcattctgcttaccgcggtcacaccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcgggacgatctatggcgcggcttttagcggagtttcctggacaatgaagattctcatcggcgtcgtgattacctggatcgggatgaatagccggtctacctccctgagcgtgtctctggtccttgtgggagttgtgacactctacctgggcgtcatggtgcaggccgactccgggtgtgttgtgagctggaaaaacaaggagctgaaatgcggatccggcattttcatcaccgataatgtccacacatggacggaacagtataagtttcagcctgagtctcccagcaagctcgcctccgctatccaaaaagcccacgaagaggggatttgtggcatcagatctgtgacccgcctggaaaaccttatgtggaagcagattacaccggagctgaatcatatcctcagcgagaacgaagttaaactgaccattatgacaggagacatcaagggcatcatgcaggctgggaaacggtccctgagacctcagcccaccgagcttaagtacagctggaaagcctggggaaaggcgaagatgctctctacggaactgcacaatcataccttcctgattgatggccctgagacagccgaatgccccaacaccaatcgcgcttggaactccctcgaggtggaggactatgggtttggagtcttcacaaccaatatctggctgaaacttaaggaacggcaagatgtgttttgtgacagcaaactgatgtctgccgctattaaggacaacagagccgtgcacgcggatatgggctactggatcgagtccgccctcaacgacacatggaaaattgaaaaggctagcttcatcgaggtcaagtcttgccagtggcctaaaagccacaccctgtggtccaatggcgttctggagagcgaaatgatcattcccaagaacttcgccgggccggtgtctcagcataattatcgccctggataccacacgcagacagctggcccctggcatcttgggcggctcgagatggattttgacttctgtgaaggaaccaccgtggtcgtgacagaggattgcggcaacagagggccctccctgcggaccacgacagccagcggaaaactgatcaccgaatggtgctgtcgctcctgcacactccctccgctgagataccggggcgaggacggctgttggtatgggatggagattagaccccttaaggaaaaagaggaaaatctggttaactctctcgtgaccgccggacacggccaaatcgataattttagcctgggggtcctgggaatggctcttttcctcgaggaaatgctgcgcacacgggtgggcaccaagcatgcgattctgctcgttgccgtgtcctttgtcacgctgatcaccgggaacatgtctttcagagaccttggacgcgtgatggttatggtgggcgctacaatgaccgatgacattggcatgggggtcacatacctggccctcctggccgcttttaaggtgagacctaccttcgccgcgggactgcttctgcggaaactcacgagcaaggagctgatgatgacaaccatcggcatcgtgctcctgtcccagtctacaattcccgagaccatccttgaactgaccgatgctctcgccctggggatgatggtcctgaaaattgttcgcaatatggagaagtatcagcttgccgtgacaatcatggctattctgtgcgtgcctaacgccgtcatcctccaaaatgcgtggaaagtgagctgtacgaccctggctgttgtgtccgtcagccccctcctgcttacatcttcccagcagaaggccgactggatccctctggccctcaccattaagggactgaaccccacagctatctttctgaccacgcttagcagaacatctaaaaagcggtcctggccgctgaatgaagccattatggctgtgggcatggttagcatcctcgcctcttccctgctcaaaaacgatattcctatgaccgggcccctggtggcgggaggccttctgaccgtctgctacgtgctgacaggccgcagcgccgacctcgagctggaaagagctgccgacgtccggtgggaggagcaggctgaaatctccgggagctctcctatccttagcattaccatctccgaggatggatctatgagcattaagaatgaagaggaggaacaaacactgacgatcctcattcgcaccggcctgctcgtggtttccgggctgttccccgtgtctatcccgattacagccgccgcttggtatctttgggaggtcaaaaagcagagagcgggagtgctgtgggacgttccttctccccctcccgtgggcaaagccgaactggaggatggggcttaccggatcaagcagaagggaatcctcggctattcccagattggcgccggggtctacaaagaaggaacctttcacacaatgtggcacgtgacccgcggcgccgtgctgatgcataaggggaaaagaatcgagccctcctgggctgacgttaagaaagatcttattagctacggaggcgggtggaagctggagggagaatggaaggagggcgaagaggtccaagtgctcgccctggaacctggcaaaaacccgcgggcggtgcagacgaagcccggactcttcaaaaccaacacaggaaccatcggcgctgtctccctggactttagccctgggacatctggatcccccattgtggataagaaaggcaaggttgtggggctttatggaaatggcgtcgtgaccagaagcggcacatacgtttctgccatcgcccagacggagaagtccatcgaggacaaccctgaaattgaggatgacatcttccgcaaaaagcggctgaccattatggatctgcaccccggggctggaaaaacaaagagatatctccctgccatcgtgcgcgaagcgattaaacggggcctgagaacccttatcctggctccgacccgcgtcgtggccgccgagatggaagaggctctccgggggctgcccatcagataccagacccctgccattcgcgctgagcatacgggacgggaaatcgttgacctcatgtgtcacgccaccttcacaatgagactgcttagccccattcgggtgcctaattataacctgatcattatggatgaggcgcattttaccgaccccgcctccatcgctgcccgcggctacatttctacaagagtcgaaatgggggaggctgccggcatcttcatgaccgccacgccgcctggaagccgggacccctttccccaatccaatgctcctatcatggatgaggaacgcgagattcccgaaagaagctggaactctggccacgagtgggtgacagacttcaaggggaagaccgtgtggtttgtcccttccatcaaagcgggaaatgatattgccgcttgcctgcggaagaacggcaaaaaggttatccagctcagcagaaaaaccttcgactttgaatatattaagacacgcaccaatgattgggacttcgtggtgacaaccgatatctctgagatgggggccaactttaaggccgagcgggtcatcgacccgagacgctgtatgaaacccgtgattctgacggatggagaagaacgggttatccttgctggccctatgcccgtgacacacagctccgccgcgcagagacgcgggcgggtcggcagaaatcctaagaacgaaaatgaccaatacatttacatgggagagcccctggaaaacgatgaggactgcgctcattggaaagaggccaagatgctcctggacaatatcaacaccccggaaggcattatcccttctatgttcgagcccgaacgcgagaaagtggatgccatcgacggggaatatagactgcggggagaggctcgcaagacatttgttgatctcatgagacggggcgaccttcctgtgtggctggcctaccgcgtcgcggccgaggggattaactatgctgatagacggtggtgtttcgacggagtgaaaaataaccagatcctggaagagaatgtcgaagtggagatttggaccaaggagggcgaaagaaagaaactcaagccccgctggctggatgcccggatctacagcgaccctcttgctctgaaagagttcaaggaatttgccgctgggagaaaatccctcacgctgaacctgattaccgagatgggccgcctccccacattcatgacccagaaggcccggaatgcgcttgataacctggccgttctgcacacagctgaagccggaggcagagcttataatcatgccctctctgagctgccggagacccttgaaacactgctcctgctgaccctccttgccacggtgacagggggaatctttctgttcctgatgagcggcaaggggattggaaaaatgaccctcggcatgtgctgcatcatcaccgcttccattctgctttggtacgcgcagatccaacctcactggattgccgctagcatcattctggagtttttcctcatcgtgctgctgatccccgaacccgagaagcagcggacacctcaggacaaccagctcacctatgtcgttattgccatccttacagtggtggccgctacgatggccaatgaaatgggctttctggagaaaaccaagaaagatttcgggctgggatctattgcgacacaacagccggagtccaacatcctcgacattgatctgcgccccgccagcgcttggaccctttacgccgtcgctacaacctttatcacgcctatgctgagacactccatcgaaaattctagcgtgaacgtttccctcaccgccattgcgaatcaggccacagtgctgatgggcctggggaagggatggcccctctctaagatggacatcggcgtccctcttctggctattgggtgttacagccaggtgaaccccatcaccctgacagccgctctcctgcttctggtcgcccattatgctattatcggacctggcctccaagccaaagcgacccgggaggcccagaagcgcgctgccgctggcattatgaaaaatccgacggtggacgggatcacagttatcgatctggaccccattccttacgatcccaagttcgaaaaacagctgggacaggtgatgctccttgtcctgtgcgtgacccaagttctgatgatgagaacaacctgggccctctgtgaggccctgacccttgcgacaggccctatctccacgctgtgggaagggaaccccggacggttttggaataccacaattgctgtgagcatggccaacatcttccgcggctcttatctcgctggggccggactgctgttttccattatgaagaacaccgccaatacaagacggggcaccggcaacacgggggagacactcggagagaagtggaaaaatcgccttaacgctctgggcaagagcgagttccagatctacaaaaagtctgggatccaggaggtcgacagaaccctggccaaagaaggaattaagcggggcgagaccgatcaccatgcggtgtccagagggagcgccaaactccgctggttcgtggagcggaatctggttacaccggaaggaaaggtcgtggaccttggctgcggcagagggggatggtcttattactgtggcgggctgaagaacgtgaaagaggtcaagggactcaccaaaggcgggcctggacacgaagaacccatccccatgagcacatatggctggaatctggttcgcctgcaatccggcgtggatgtgtttttcacgcctcccgaaaagtgcgacaccctcctttgtgatattggggagtctagccctaacccgacagtcgaggctggacggaccctgagagtgctgaatctcgttgaaaactggctgaataacaatacacagttttgcatcaaagtgcttaacccctacatgccttccgtcattgagaagatggaagccctgcagcgcaagtacggcggggctctcgtgcggaatcccctgagcagaaactccacccatgagatgtattgggtttctaacgccagcggaaatatcgtgtcctctgtcaacatgatcagccgcatgctgattaatcggttcacgatgagacacaaaaaggcgacctacgaacctgacgtggatctcggctccgggacacgcaacatcggaattgagtctgagacccccaatcttgacatcattggcaaacggatcgaaaagatcaaacaggagcacgaaacaagctggcattatgatcaagaccacccgtacaagacctgggcctatcatggctcctacgagacaaagcagaccgggagcgcttcttccatggtgaacggagtcgttagactgctgacgaaaccttgggacgtgattcccatggtgacacagatggccatgaccgataccacaccttttggccagcaacgcgtcttcaaggaaaaagtggacacgagaacccaggagcccaaggaggggaccaaaaagctcatgaagatcaccgctgaatggctgtggaaagagcttggaaagaaaaagacacctcggatgtgtacccgcgaagagtttacaagaaaagttcggagcaatgccgctctgggcgccattttcaccgatgagaacaagtggaaatctgcgagagaagccgtggaggactccgggttttgggaactcgtcgataaggagcggaatctgcacctggaaggaaagtgcgagacgtgtgtgtataacatgatgggcaaacgcgagaagaaactcggcgagttcgggaaggctaaaggaagcagagccatctggtacatgtggctgggcgctcggtttcttgagttcgaagccctggggtttctcaatgaggaccactggttctctcgcgaaaactccctgagcggagttgagggcgaggggcttcataagctgggctacattctcagagatgtgtccaagaaagaaggaggcgccatgtatgcggacgataccgctgggtgggacacacggatcaccctggaggatctgaagaatgaagagatggtcacaaaccacatggaaggagagcataaaaagctcgccgaggccattttcaaactgacctaccagaataaggtggttcgcgtgcagagacccacgccgcggggcacagtcatggacatcatcagccgcagagaccaacgggggtctggacaggtggtcacctatggccttaacacatttaccaacatggaagctcagctgattcgccaaatggagggggaaggcgtgttcaagagcatccagcagctcacggttaccgaggagattgccgtgaaaaattggctggtcagagtgggacgggaacgcctttccagaatggctatctctggcgatgactgcgtggttaagcctctggatgaccggtttgccagcgcgctcacagccctgaacgatatggggaaagtgagaaaggacattcagcaatgggagccctcccgcggatggaatgattggacccaggtccccttctgctctcaccattttcacgaactgatcatgaaagacggccgggtgctcgttgtgccttgtagaaaccaggatgagctgatcgggcgcgctcggattagccagggagccggctggtcccttagagaaacagcttgcctggggaagtcttacgcccaaatgtggagcctcatgtatttccaccgccgggacctgagacttgcggccaatgctatctgttccgccgtcccgagccattgggtgcccacctctcgcacaacctggtccattcacgctacgcatgagtggatgacaaccgaggatatgctgaccgtctggaaccgggtgtggatccaggaaaatccttggatggaggacaagacacccgttgaaagctgggaggaaattccttacctcggcaaaagagaggatcagtggtgcggatctctgatcggcctgacctcccgcgccacatgggctaagaacatccagacggccattaatcaagtgcggagcctcatcgggaacgaggaatataccgactacatgccctccatgaaaagatttcggagagaggaagaggaagcgggagtcctgtggtga

SEQ ID NO: 20215 - RNA, 9876 nt, synthetic construct
  misc_feature 1..9876: note = derived and/or modified CDS sequence (opt5) from DENV-2__KC762673__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacccactttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacatcctgccacccttagaaagtattgcattgaagctaaactgacgaacacaaccaccgcctctcggtgtccgacacagggggagccctccctcaatgaggaacaagataagcgctttgtgtgcaaacacagcatggtcgacagaggatggggcaacggctgtgggctgttcggaaagggcgggatcgttacctgcgcgatgtttacatgcaagaaaaatatggagggaaagattgtgcagcctgaaaacctggagtacacgatcgtgattaccccccattctggcgaagagaatgccgtcgggaacgatacaggaaaacacggcaaggagatcaaagtgacccctcagtccagcatcacagaagctgagctcaccggctatgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcatgccaagaaacaggatgttgtggtcctgggaagccaagagggcgccatgcacacggctctcacaggggcgaccgaaatccagatgtcctctggcaacctgctttttacaggacatctgaagtgcagactccggatggacaaactgcagcttaagggcatgagctactccatgtgtaccgggaaattcaaggtggtcaaggagattgccgaaacccaacacggaacaatcgtgattagagttcagtatgagggcgacgggagcccctgcaaaatccccttcgagatcatggatctggaaaagcgccatgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcaccaagtgttcggggcgatttacggcgctgcctttagcggagtgtcctggacgatgaagatcctcattggcgttgtcatcacatggattgggatgaatagccggtctacccctctgtccgtgagcctggtgcttgtcggagtggttaccctctatctgggcgtgatggtccaggccgactctgggtgtgtggtttcctggaaaaacaaggagctgaaatgcggaagcggcatcttcatcacagataatgtgcacacctggacagaacagtacaagtttcagcccgagtccccgtctaagctcgctagcgccattcaaaaagctcatgaagaggggatctgtggcattagatccgtcacgcgcctggaaaaccttatgtggaagcagatcacccctgagctgaatcacattctctctgagaacgaagtgaaactgacaatcatgaccggagacatcaagggcattatgcaggccgggaaacggagcctgagaccccagcctacagagcttaagtattcctggaaaacctggggaaaggcgaagatgctcagcacggaactgcataatcacaccttcctgatcgatggccccgagacagccgaatgccctaacaccaatcgcgcttggaactctctcgaggttgaggactacgggtttggagtgttcacaaccaatatttggctgaaacttaaggaacggcaagatgtctattgtgactccaaactgatgagcgccgctatcaaggacaacagagccgtgcacgcggatatgggctactggattgagtctgccctcaacgacacatggaaaatcgaaaaggcttcctttatcgaggtgaagagctgctattggcccaaatctcataccctgtggagcaatggcgtcctggagtccgaaatgattatcccgaagaacttcgccgggcctgttagccagcacaattaccgccccggataccatacgcagacagctggcccctggcaccttgggcggctcgagatggatttcgacttttgtgaaggaaccaccgtggtggtcacagaggattgcggcaacagagggccttctctgcggaccacgacagcctccggaaaactgattaccgaatggtgctgtcgcagctgcacactcccgcccctgagatatcggggcgaggacggctgttggtacgggatggagatcagacctcttaaggaaaaagaggaaaatctggtgaactccctcgttaccgccggacatggccagattgataatttctctctgggggtgctgggaatggctctttttctcgaggaaatgctgcgcacacgggtcggcaccaagcacgcgatcctgctcgtggccgttagcttcgtgacgctgattaccgggaacatgtcctttagagaccttggacgcgtcatggtgatggttggcgctacaatgaccgatgacatcggcatgggggtgacatatctggccctcctggccgctttcaaggtcagacccacctttgccgcgggactgcttctgcggaaactcacgtctaaggagctgatgatgacaaccatcggcattgtgctcctgagccaatccacaatccctgagaccattcttgaactgaccgatgctctcgccctggggatgatggccctgaaaatcgtgcgcaatatggagaagtaccagcttgctgtcacaattatggccatcctgtgcgttcccaacgcggtgatcctccagaatgcttggaaagtgtcttgtacgaccctggccgtcgtgagcgtttcccctctcctgcttacaagctctcaacagaaggccgactggattcccctggctctcaccatcaagggactgaacccgacagccattttcctgaccacgctttccagaacaagcaaaaagcggtcttggcctctgaatgaagctatcatggccgtgggcatggtctccattctcgcgagctctctgctcaaaaacgatatccccatgaccgggcctctggtggccggaggccttctgaccgtttgctatgtgctgacaggccgctccgctgacctcgagctggaaagagccgctgacgtccggtgggaggagcaggccgaaatcagcgggtccagccccattctttctatcaccattagcgaggatggatccatgtctatcaagaatgaagaggaggaacagacactgacgattctcatccgcaccggcctgctcgtgattagcgggctgtttccggtctccatccctatcacagccgctgcgtggtacctttgggaggtgaaaaagcaaagagccggagttctgtgggacgtgccctctcctccccccgtcggcaaagctgaactggaggatggggcctatcggattaagcagaagggaatcctcggctacagccagattggcgccggggtgtacaaagaaggaaccttccacacaatgtggcatgttacccgcggcgctgtgctgatgcacaaggggaaaagaatcgagccttcctgggccgacgtcaagaaagatcttatttcttatggaggcgggtggaagctggagggagaatggaaggagggcgaagaggtgcaggtgctcgcgctggaaccgggcaaaaacccccgggctgttcaaacgaagcctgggctctttaaaaccaacacaggaaccatcggcgccgtcagcctggacttctcccccgggacaagcggatctcctatcgtggataagaaaggcaaggtggtcgggctttacggaaatggcgtggttaccagatccggcacatatgtgagcgccattgctcagacggagaagtctatcgaggacaaccccgaaattgaggatgacatctttcgcaaaaagcggctgaccattatggatctgcatcctggggccggaaaaacaaagagatacctcccggcgatcgtccgcgaagctatcaaacggggcctgagaacccttattctggcccccacccgcgtggttgccgctgagatggaagaggccctccgggggctgcctatcagatatcagacacccgctattaaggccgagcacacgggacgcgaaatcgtggacctcatgtgtcatgcgaccttcacaatgcggctgctttcccctattagagtccccaattacaacctgatcattatggatgaggcccacttcaccgacccggctagcatcgccgctcggggctatatctccacacgcgtggaaatgggggaggccgccggcatttttatgaccgctacgcctcccggatctagagaccccttccctcagagcaatgcgcccatcatggatgaggaacgggagattcctgaacgctcctggaacagcggccacgagtgggttacagactttaaggggaaaaccgtgtggttcgtcccgtctatcaaggccggaaatgatattgctgcctgcctgagaaaaaacggcaagaaagtgatccaactctcccggaagacctttgacttcgaatacatcaagacaagaaccaatgattgggactttgtggtcacaaccgatattagcgagatgggggccaacttcaaagctgagcgcgttatcgacccccggagatgtatgaagcctgtgattctgacggatggagaagagcgcgtgatccttgccggccccatgcctgtcacacattctagcgcggctcagcggagagggcgcgtgggccggaatcccaaaaacgaaaatgaccagtacatttatatgggagagccgctggaaaacgatgaggactgcgcccactggaaggaggccaaaatgctcctggacaatatcaacacccctgaaggcatcattccctccatgtttgagcctgaaagagagaaggttgatgctatcgacggggaataccgcctgagaggagaggcccggaaaacattcgtggatctcatgcgcagaggcgaccttcccgtctggctggcgtatcgggtggccgctgaggggattaactacgccgatcgcagatggtgttttgacggagttaagaataaccaaatcctggaagagaatgtggaagtcgagatttggaccaaggagggcgaacggaaaaagctcaaacctagatggctggatgctcgcatctattctgacccccttgccctgaaggagttcaaagaattcgctgccgggcggaagagcctcacgctgaacctgattaccgagatgggcagactcccgacatttatgacccagaaggcgcgcaatgcccttgataacctggctgtgctgcatacagccgaagctggaggccgggcctacaatcacgccctctccgagctgcctgagacccttgaaacactgctcctgctgaccctccttgctacggtcacagggggaatcttcctgtttctgatgtctggcaaagggatcggaaagatgaccctcggcatgtgctgcattatcaccgcgagcattctgctttggtatgcccagatccagccccactggattgctgcctccatcatcctggagttctttctcattgtgctgctgatccccgaacctgagaaacaaagaacaccgcaggacaaccagctcacctacgttgtgattgccatccttacagtggtcgctgccacgatggcgaatgaaatgggcttcctggagaagaccaaaaaggattttgggctgggaagcattacaacccagcaacccgagtctaacatcctcgacatcgatctgcggcctgcctccgcttggacactttacgccgttgctaccacgttcattacccccatgctgcgccatagcatcgaaaattcctctgtgaacgtgagcctcacagccattgcgaatcaggccaccgtcctgatgggcctggggaagggatggcctctctccaaaatggacatcggcgtgccccttctggctattgggtgttattctcaggttaaccctatcacactgaccgccgctctcctgcttctggtggcccactacgctattatcggaccgggcctccaggccaaggcgacgagagaggcccaaaaacgggctgccgctggcatcatgaagaatcccacagtcgacgggattaccgtgatcgatctggaccctattccctatgatcctaaatttgaaaagcagctgggacaggtcatgctccttgtgctgtgcgttacacaggtgctgatgatgcgcaccacctgggccctctgtgaggccctgacacttgcgacgggccccatcagcaccctgtgggaagggaacccgggaagattctggaatacaaccattgctgtctccatggccaacatctttcggggcagctacctcgctggggccggactgctgttctctatcatgaagaacacagccaatacccgcagaggcacgggcaacacaggggagaccctcggagagaaatggaagaatcggcttaacgctctgggcaaatccgaatttcaaatttataagaaaagcgggatccaggaggtggaccgcaccctggccaaggaaggaattaaaagaggcgagacagatcatcacgcggtttctcgggggtccgccaagctcagatggttcgtggagcgcaatctggtcacccctgaaggaaaggtggtggaccttggctgcggccgggggggatggagctactattgtggcgggctgaaaaacgttaaggaggtcaaaggactcacaaagggcgggcccggacatgaagagcccatccctatgtctacgtacggctggaatctggtgagactgcagagcggcgtggatgtcttctttaccccccctgaaaaatgcgacacactcctttgtgatattggggagtcctctccgaaccccaccgttgaggctggacgcacactgcgggtgctgaatctcgtggaaaactggctgaataacaatacccaattctgcatcaaggtccttaacccttacatgcccagcgtgatcgagaagatggaagccctgcagagaaaatatggcggggctctcgttcgcaatcctctgtcccggaacagcacgcacgagatgtactgggtgtccaacgcctctggaaatattgtcagctccgtgaacatgatctctagaatgctgattaatcgctttaccatgcggcacaagaaagcgacatatgaacccgacgttgatctcggcagcgggaccagaaacatcggaattgagtccgagatcccgaatcttgacatcattggcaagcgcatcgaaaaaattaagcaggagcatgaaacatcttggcactacgatcaggaccatccttatcggacctgggcctaccacggcagctatgagacaaagcaaaccgggtccgctagctctatggtgaacggagtcgtgagactgctgacgaaaccctgggacgtgatccctatggtcacacagatggccatgaccgataccacacccttcggccagcagcgcgtttttaaggaaaaagtggacacgagaacccaagagcctaaggaggggacaaaaaagctcatgaagattaccgctgaatggctgtggaaagagcttggaaagaaaaagacaccccggatgtgtacccgcgaagagttcacaagaaaagtgcggtccaatgccgctctgggcgccatctttaccgatgagaacaagtggaaaagcgcgagagaagccgtcgaggactctgggttctgggaactcgtggataaggagcggaatctgcacctggaaggaaagtgcgagacgtgtgtttacaacatgatgggcaaacgcgagaagaaactcggcgaatttgggaaggctaaaggatccagagccatttggtacatgtggctgggcgctcggttccttgagtttgaagccctggggttcctcaatgaggaccattggtttagccgcgaaaactctctgtccggagtggagggcgaggggcttcacaagctgggctatatcctcagagatgtcagcaagaaagaaggaggcgccatgtacgcggacgataccgctgggtgggacacacggatcaccctggaggatctgaagaatgaagagatggtgacaaaccatatggaaggagagcacaaaaagctcgccgaggccattttcaaactgacctatcagaataaggttgtgcgcgtccagagaccgacgcctcggggcacagtgatggacatcatttcccgcagagaccagcgggggagcggacaagttgtgacctacggccttaacacattcaccaacatggaagctcagctgatccgccagatggagggggaaggcgtctttaagtctattcaacagctcacggtgaccgaggagatcgccgtcaaaaattggctggtgagagttggacgggaacgccttagcagaatggctatctccggcgatgactgcgtggtcaagcccctggatgaccggttcgcctctgcgctcacagccctgaacgatatggggaaagtgagaaaggacattcagcagtgggagcccagccgcggatggaatgattggacccaagtgcctttttgctcccatcacttccacgaactgatcatgaaagacggccgggttctcgtggtcccgtgtagaaaccaggatgagctgattgggcgcgctcggatctctcagggagccggctggagccttagagaaacagcttgcctggggaagtcctatgcccagatgtggtctctcatgtactttcatcgccgggacctgagacttgcggccaatgctatttgtagcgccgtgccctcccactgggttcctaccagccgcacaacctggtctatccatgctacgcacgagtggatgacaaccgaggatatgctgaccgtgtggaaccgggtctggatccaagaaaatccctggatggaggacaagacacctgtggaatcctgggaggaaattccctatctcggcaaaagagaggatcagtggtgcggaagcctgatcggcctgacctctcgcgccacatgggctaagaacattcagacggccatcaatcaggtccggtccctcattgggaacgaggaatacaccgactacatgcctagcatgaaaagattccggagagaggaagaggaagcgggagtgctgtggtga

SEQ ID NO: 20216 - RNA, 9876 nt, synthetic construct
  misc_feature 1..9876: note = derived and/or modified CDS sequence (opt5) from DENV-2__KC762663__SS-prME
  source 1..9876: mol_type = other RNA
accgccggaatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcaccgatctggaaaagcgccacgtgctcggacggctgattacagtcaatcctatcgtgaccgagaaagactctccggttaacattgaagccgagcccccttttggcgattcctacatcattatcggggtggaacccggccagctgaagctcagctggttcaaaaagggatctagcattggccagatgtttgagacaaccatgagaggggctaagcgcatggccatcctgggagacacggcctgggatttcggctcccttgggggagtctttacatctatcggcaaagctctgcatcaagtgttcggggccatttatggcgcggcttttagcggagtgtcctggaccatgaagatcctcattggcgttgtcatcacctggattgggatgaatagccggtctacatccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacgtggaccgaacagtataagtttcagcctgagtctcccagcaagctcgcctccgctattcaaaaagcccacgaagaggggatctgtggcattagatctgtcacacgcctggaaaaccttatgtggaagcagatcaccccggagctgaatcatattctcagcgagaacgaagtgaaactgacaatcatgaccggagacatcaagggcattatgcaggctgggaaacggtccctgagacctcagcccacggagcttaagtacagctggaaaacctggggaaaggccaagatgctctctacagaactgcacaatcataccttcctgatcgatggccctgagacagcggaatgccccaacgccaatcgcgcttggaactccctcgaggttgaggactatgggtttggagtgttcaccacaaatatttggctgaaacttaaggaacggcaagatgccttttgtgacagcaaactgatgtctgctgccatcaaggacaacagagcggtccacgccgatatgggctactggattgagtccgctctcaacgacacctggaaaatcgaaaaggccagcttcatcgaggtgaagtcttgccactggcctaaaagccatacgctgtggtccaatggcgtgctggagagcgaaatgattatccccaagaacttcgctgggccggtctctcagcacaattatcgccctggataccatacacagaccgccggcccctggcaccttgggcggctcgagatggattttgacttctgtgaaggaaccacagttgtggtgaccgaggattgcggcaacagagggccctccctgcggacgacaaccgccagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagctggacatggccagattgataattttagcctgggggttctgggaatggcgcttttcctcgaggaaatgctgcgcacccgggtgggcacgaagcacgccatcctgctcgtcgctgtgtcctttgttaccctgattacagggaacatgtctttcagagaccttggacgcgtgatggtcatggtgggcgccaccatgacagatgacatcggcatgggggttacctacctggccctcctggctgcctttaaggtgagacctacgttcgcggctggactgcttctgcggaaactcacaagcaaggagctgatgatgaccacaatcggcattaccctcctgtcccaatctaccatccccgagacaattcttgaactgacggatgccctcgccctggggatgatggtcctgaaaatcgtgcgcaatatggagaagtatcagcttgctgtgaccattatggccatcctgtgcgtccctaacgcggttatcctccagaatgcttggaaagtgagctgtacaaccctggccgtggtctccgtgagccccctcctgcttacatcttcccaacagaaggccgactggattcctctggctctcaccatcaagggactgaaccccacggccatttttctgacaacccttagcagaacctctaaaaagcggtcctggccgctgaatgaagctatcatggccgttggcatggtgagcattctcgcgtcttccctgctcaaaaacgatatccctatgacagggcccctggtcgccggaggccttctgaccgtgtgctacgttctgacaggccgcagcgctgacctcgagctggaaagagccgctgacgtgcggtgggaggagcaggccgaaatctccgggagctctcctattcttagcatcacgatttccgaggatggatctatgagcatcaagaatgaagaggaggaacagaccctgacaattctcatccgcaccggcctgctcgtcatttccgggctgttccccgtgtctatcccgatcacagccgctgcgtggtatctttgggaggtcaaaaagcaaagagccggagtgctgtgggacgttccttctccccctcccgtggaaaaagctgagctggaagatggcgcctaccggattaagcagaaggggatcctcggatattcccagattggcgccggcgtctacaaagaggggacctttcacacgatgtggcatgtgacccgcggagctgttctgatgcacaagggcaaaagaatcgagccctcctgggccgacgtgaagaaagatcttattagctacgggggaggctggaagctggaaggggagtggaaggaaggagaggaagtccaggtgctcgcgctggagcctggcaaaaacccgcgggctgtgcaaacaaagcccggcctcttcaaaacctccacagggaccatcggagccgttagcctggacttttctcctggcacatccgggagccccatcgtcgataagaaaggaaaggtggtgggcctttatgggaacggagtcgtgacgagatctggcacctacgtttccgccattgctcagacagaaaagagcatcgaagacaatcctgagattgaagatgacatcttccgcaaaaagcggctgaccattatggatctgcatcccggcgccgggaaaaccaagagatatctccctgcgatcgtgcgcgaggctatcaaacggggactgagaacacttattctggccccgacgcgcgtcgtggccgctgaaatggaggaggccctccggggcctgcccatcagataccagacccctgctattcgcgccgaacacacagggcgggagatcgttgacctcatgtgtcatgcgaccttcacaatgagactgctttcccccattcgggtgcctaactataatctgatcattatggatgaagcccactttaccgaccccgcttctatcgccgctcgcggatacatcagcacgagagtcgagatgggcgaggccgccgggattttcatgacagctaccccgcctggctcccgggacccctttccccagagcaacgcgcctatcatggatgaagaacgcgaaattcccgagagatcttggaatagcggacacgaatgggtgaccgacttcaagggcaagacagtttggtttgtgcctagcatcaaagccgggaacgatattgctgcctgcctgcggaagaatggcaaaaaggtcatccaactctctagaaaaaccttcgactttgagtatatcaagacacgcaccaacgattgggacttcgtggtgacgacagatattagcgagatgggcgccaattttaaggctgaacgggtcatcgacccgagacgctgtatgaaacccgttattctgaccgatggggaggaacgggtgatccttgccggacctatgcccgtgacacattcctctgcggctcagagacgcggccgggtcgggagaaaccctaagaatgagaacgaccagtacatttacatgggcgaacccctggagaatgatgaggactgcgcccactggaaagaagccaagatgctcctggacaacatcaataccccggagggaatcattcctagcatgttcgaacccgagcgcgaaaaagtggatgctatcgacggcgagtatagactgagaggggaggcccgcaagacgtttgttgatctcatgagacggggagaccttcctgtgtggctggcgtaccgcgtcgccgctgaaggcattaactatgccgatagacggtggtgtttcgacggggtgaaaaacaatcaaatcctggaggaaaacgttgaggtggagatttggaccaaggaaggagagagaaagaaactcaagccccgctggctggatgctcggatctactccgaccctcttgccctgaaagagttcaaggagtttgctgccggcagaaaatctctcacactgaatctgattaccgaaatggggcgcctccccacattcatgacccagaaggcgcggaacgcccttgataatctggctgtcctgcatacagccgaggctggcgggcgggcctataaccacgccctcagcgagctgccggaaacccttgagacgctgctcctgctgacactccttgctaccgtgaccggcgggatctttctgttcctgatgtccggaaagggcatcgggaaaatgacactcggaatgtgctgcattatcaccgcgagcattctgctttggtacgcccagatccagcctcactggattgctgcctctatcatcctggaatttttcctcattgtcctgctgatccccgagcccgaaaagcaacggacacctcaggacaatcagctcacgtatgtggttattgccatccttaccgtggtggctgccacaatggcgaacgagatgggctttctggagaaaaccaagaaagatttcggcctggggtccattacaacccagcaaccggaaagcaatatcctcgacatcgatctgcgccccgcctccgcttggacgctttacgccgtcgctaccacatttattacccctatgctgagacattctatcgagaacagctccgttaatgtgtctctcacagccattgcgaaccaggccaccgtgctgatgggactgggcaaggggtggcccctcagcaagatggacatcggagtccctcttctggctattggctgttactcccaggtgaatcccatcacgctgacagccgctctcctgcttctggttgcccactatgctattatcgggcctggactccaggccaaagcgacccgggaagcccaaaagcgcgctgccgctggcatcatgaaaaacccgacagtggacggcattaccgtcatcgatctggaccccattccttacgatcccaagttcgagaaacagctgggacaggtgatgctccttgtcctgtgcgtgacccaggttctgatgatgagaacaacgtgggccctctgtgaagccctgacccttgcgacaggacctatcagcaccctgtgggagggcaatcccgggcggttttggaacacaaccattgctgtgtctatggccaatatcttccgcggatcctatctcgctggcgccgggctgctgtttagcatcatgaagaacacggccaacacaagacggggaaccggcaataccggcgagacactcggggaaaagtggaaaaaccgccttaatgctctgggaaagtctgagttccaaatttacaaaaagtccggcatccaggaagtcgacagaaccctggccaaagaggggattaagcggggagagacagatcatcacgcggtgagcagaggctctgccaaactccgctggttcgttgaacggaacctggtgacgccggaggggaaggtcgtggaccttggatgcggcagaggcgggtggagctattactgtggaggcctgaagaatgtgaaagaagttaaggggctcaccaaaggaggccctgggcatgaggaacccatccccatgtccacatatggatggaacctggtccgcctgcagtctggcgtggatgtgtttttcacccctcccgagaagtgcgacacactcctttgtgatattggcgagagctcccctaatccgaccgtcgaagctgggcggacgctgagagttctgaacctcgtggagaattggctgaacaataacacccaattttgcatcaaagtgcttaatccctacatgcctagcgtcatcgaaaagatggaggccctgcagcgcaagtacggaggcgctctcgtgcggaaccccctgtccagaaattctacacacgaaatgtattgggttagcaacgcctccgggaacattgtgtctagcgtcaatatgatctcccgcatgctgattaaccggttcaccatgagacacaaaaaggcgacatacgagcctgacgtggatctcggatctggcacccgcaatatcgggattgagagcgaaacacccaaccttgacatcatcggaaaacggattgagaagatcaaacaggaacatgagacctcctggcactatgatcaggaccatccgtacaagacgtgggcctatcacggcagctacgaaacaaagcaaaccggctctgcttccagcatggttaatggggtggtcagactgctgaccaaaccttgggacgtgattcccatggtgacacagatggccatgacggataccacaccttttggacagcagcgcgtcttcaaggagaaagttgacaccagaacacaagagcccaaggaaggcaccaaaaagctcatgaagatcacagctgagtggctgtggaaagaacttgggaagaaaaagacccctcggatgtgtacgcgcgaggagtttaccagaaaagtgcggtctaacgccgctctgggagccattttcacagatgaaaataagtggaaatccgcgagagaggccgtggaagacagcggcttttgggagctcgtcgataaggaacggaacctgcacctggaggggaagtgcgagacctgtgtgtataatatgatgggaaaacgcgaaaagaaactcggcgagttcggcaaggctaaagggtctagagccatctggtacatgtggctgggagctcggtttcttgagttcgaggccctgggctttctcaacgaagaccattggttctcccgcgagaatagcctgtccggggttgagggagaaggccttcacaagctggggtacattctcagagatgtgagcaagaaagagggcggagccatgtatgcggacgatacagctggctgggacacccggatcacgctggaagatctgaagaacgaggaaatggtcacaaatcatatggagggggagcacaaaaagctcgccgaagccatcttcaaactgacctaccagaacaaggtggttcgcgtgcagagacccacaccgcggggaaccgtcatggacattatctctcgcagagaccagcggggcagcgggcaagtggttacgtatggacttaatacctttacaaacatggaggctcagctgattcgccagatggaaggcgagggggtgttcaagtccatccaacagctcaccgtcacagaggaaattgccgtgaaaaactggctggtcaccgtgggcagagagcggctttctcgcatggctatcagcggagatgactgcgttgtgaagcctctggatgacagatttgcctccgcgctcacagccctgaatgatatgggcaaagtccggaaggacatccagcagtgggaaccctctagagggtggaacgattggacccaagtgcccttctgcagccatcactttcacgagctgattatgaaagacggacgcgtgctcgttgtgccttgtcggaatcaggatgaactgatcggcagagctcgcatttcccagggggccggatggtctcttcgggagacggcttgcctgggcaagagctacgcccagatgtggtccctcatgtatttccatagacgcgacctgcggcttgcggccaacgctatctgtagcgccgtcccgtctcactgggtgcccacatccagaaccacctggagcattcatgctacacacgagtggatgaccacagaagatatgctgacggtttggaatcgcgtgtggatccaagagaacccttggatggaagacaagacccccgtcgagtcttgggaagagatcccttacctcgggaaacgggaggatcagtggtgcggctccctgattggactgacaagcagagccacctgggctaagaatatccagacagccattaaccaggtgcgctccctcatcggcaatgaagagtataccgactacatgccctctatgaaacggtttagacgggaagaggaagaggcgggggtcctgtggtga

SEQ ID NO: 20217 - RNA, 9876 nt, synthetic construct
  misc_feature 1..9876: note = derived and/or modified CDS sequence (opt5) from DENV-2__KC762675__SS-prME
  source 1..9876: mol_type = other RNA
acagccggcatcattatcatgatgattcccacagtgatggctttccacctgacgaccagaaacggggagcctcatatgatcgtgagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacccactttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacatcctgccacccttagaaagtattgcattgaagctaaactgacgaacacaaccaccgcctctcggtgtccgacacagggggagccctccctcaatgaggaacaagataagcgctttgtgtgcaaacacagcatggtcgacagaggatggggcaacggctgtgggctgttcggaaagggcgggatcgttacctgcgcgatgtttacatgcaagaaaaatatggagggaaagattgtgcagcctgaaaacctggagtacacgatcgtgattacaccccattctggcgaagagaatgccgtcgggaacgatacaggaaaacacggcaaggagatcaaagtgacccctcagtccagcatcacagaagctgagctcaccggctatgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcatgccaagaaacaggatgttgtggtcctgggaagccaagagggcgccatgcacacggctctcacaggggcgaccgaaatccagatgtcctctggcaacctgctttttacaggacatctgaagtgcagactccggatggacaaactgcagcttaagggcatgagctactccatgtgtaccgggaaattcaaggtggtcaaggagattgccgaaacccaacacggaacaatcgtgattagagttcagtatgagggcgacgggagcccctgcaaaatccccttcgagatcatggatctggaaaagcgccatgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcaccaagtgttcggggcgatttacggcgctgcctttagcggagtgtcctggacgatgaagatcctcattggcgttgtcatcacatggattgggatgaatagccggtctacctccctgagcgtgtctctggtgcttgtcggagtggttaccctctatctgggcgtgatggtccaggccgactccgggtgtgtggttagctggaaaaacaaggagctgaaatgcggatccggcatcttcatcacagataatgtgcacacctggacagaacagtacaagtttcagcctgagtctcccagcaagctcgcttccgccattcaaaaagctcatgaagaggggatctgtggcattagatctgtcacgcgcctggaaaaccttatgtggaagcagatcaccccggagctgaatcacattctcagcgagaacgaagtgaaactgacaatcatgaccggagacatcaagggcattatgcaggccgggaaacggtccctgagacctcagcccacagagcttaagtatagctggaaaacctggggaaaggcgaagatgctctctacggaactgcataatcacaccttcctgatcgatggccctgagacagccgaatgccccaacaccaatcgcgcttggaactccctcgaggttgaggactacgggtttggagtgttcacaaccaatatttggctgaaacttaaggaacggcaagatgtctattgtgacagcaaactgatgtctgccgctatcaaggacaacagagccgtgcacgcggatatgggctactggattgagtccgccctcaacgacacatggaaaatcgaaaaggctagctttatcgaggtgaagtcttgctattggcctaaaagccataccctgtggtccaatggcgtcctggagagcgaaatgattatccccaagaacttcgccgggccggtttctcagcacaattaccgccctggataccatacgcagacagctggcccctggcaccttgggcggctcgagatggatttcgacttttgtgaaggaaccaccgtggtggtcacagaggattgcggcaacagagggccctccctgcggaccacgacagccagcggaaaactgattaccgaatggtgctgtcgctcctgcacactccctccgctgagatatcggggcgaggacggctgttggtacgggatggagatcagaccccttaaggaaaaagaggaaaatctggtgaactctctcgttaccgccggacatggccagattgataatttcagcctgggggtgctgggaatggctctttttctcgaggaaatgctgcgcacacgggtcggcaccaagcacgcgatcctgctcgtggccgtttccttcgtgacgctgattaccgggaacatgtcttttagagaccttggacgcgtcatggtgatggttggcgctacaatgaccgatgacatcggcatgggggtgacatatctggccctcctggccgctttcaaggtcagacctacctttgccgcgggactgcttctgcggaaactcacgagcaaggagctgatgatgacaaccatcggcattgtgctcctgtcccaatctacaatccccgagaccattcttgaactgaccgatgctctcgccctggggatgatggccctgaaaatcgtgcgcaatatggagaagtaccagcttgctgtcacaattatggccatcctgtgcgttcctaacgcggtgatcctccagaatgcttggaaagtgagctgtacgaccctggccgtcgtgtccgttagccccctcctgcttacatcttcccaacagaaggccgactggattcctctggctctcaccatcaagggactgaaccccacagccattttcctgaccacgcttagcagaacatctaaaaagcggtcctggccgctgaatgaagctatcatggccgtgggcatggtcagcattctcgcgtcttccctgctcaaaaacgatatccctatgaccgggcccctggtggccggaggccttctgaccgtttgctatgtgctgacaggccgcagcgctgacctcgagctggaaagagccgctgacgtccggtgggaggagcaggccgaaatctccgggagctctcctattcttagcatcaccatttccgaggatggatctatgagcatcaagaatgaagaggaggaacagacactgacgattctcatccgcaccggcctgctcgtgatttccgggctgtttcccgtctctatcccgatcacagccgctgcgtggtacctttgggaggtgaaaaagcaaagagccggagttctgtgggacgtgccttctccccctcccgtcggcaaagctgaactggaggatggggcctatcggattaagcagaagggaatcctcggctactcccagattggcgccggggtgtacaaagaaggaaccttccacacaatgtggcatgttacccgcggcgctgtgctgatgcacaaggggaaaagaatcgagccctcctgggccgacgtcaagaaagatcttattagctatggaggcgggtggaagctggagggagaatggaaggagggcgaagaggtccaggtgctcgcgctggaacctggcaaaaacccgcgggctgttcaaacgaagcccgggctctttaaaaccaacacaggaaccatcggcgccgtctccctggacttcagccctgggacatctggatcccccatcgtggataagaaaggcaaggtggtcgggctttacggaaatggcgtggttaccagaagcggcacatatgtgtctgccattgctcagacggagaagtccatcgaggacaaccctgaaattgaggatgacatctttcgcaaaaagcggctgaccattatggatctgcatcccggggccggaaaaacaaagagatacctccctgcgatcgtccgcgaagctatcaaacggggcctgagaacccttattctggccccgacccgcgtggttgccgctgagatggaagaggccctccgggggctgcccatcagatatcagacccctgctattcgcgccgagcacacgggacgggaaatcgtggacctcatgtgtcatgcgaccttcacaatgagactgcttagccccattcgggtccctaattacaacctgatcattatggatgaggcccacttcaccgaccccgcttccatcgccgctcgcggctatatctctacaagagtggaaatgggggaggccgccggcatttttatgaccgctacgccgcctggaagccgggaccccttcccccagtccaatgcgcctatcatggatgaggaacgcgagattcccgaaagaagctggaactctggccacgagtgggttacagactttaaggggaagaccgtgtggttcgtcccttccatcaaagccggaaatgatattgctgcctgcctgcggaagaacggcaaaaaggtgatccaactcagcagaaaaacctttgacttcgaatacatcaagacacgcaccaatgattgggactttgtggtcacaaccgatatttctgagatgggggccaacttcaaggctgagcgggttatcgacccgagacgctgtatgaaacccgtgattctgacggatggagaagaacgggtgatccttgccggccctatgcccgtcacacatagctccgcggctcagagacgcgggcgggtgggcagaaatcctaagaacgaaaatgaccagtacatttatatgggagagcccctggaaaacgatgaggactgcgcccactggaaagaggccaagatgctcctggacaatatcaacaccccggaaggcatcattccttctatgtttgagcccgaacgcgagaaagttgatgctatcgacggggaatacagactgcggggagaggcccgcaagacattcgtggatctcatgagacggggcgaccttcctgtctggctggcgtatcgcgtggccgctgaggggattaactacgccgatagacggtggtgttttgacggagttaaaaataaccaaatcctggaagagaatgtggaagtcgagatttggaccaaggagggcgaaagaaagaaactcaagccccgctggctggatgctcggatctatagcgaccctcttgccctgaaagagttcaaggagttcgctgccgggagaaaatccctcacgctgaacctgattaccgagatgggccgcctccccacatttatgacccagaaggcgcggaatgcccttgataacctggctgtgctgcatacagccgaagctggaggcagagcctacaatcacgccctctctgagctgccggagacccttgaaacactgctcctgctgaccctccttgctacggtcacagggggaatcttcctgtttctgatgagcggcaaggggatcggaaaaatgaccctcggcatgtgctgcattatcaccgcgtccattctgctttggtatgcccagatccagcctcactggattgctgccagcatcatcctggagttctttctcattgtgctgctgatccccgaacccgagaagcaacggacacctcaggacaaccagctcacctacgttgtgattgccatccttacagtggtcgctgccacgatggcgaatgaaatgggcttcctggagaaaaccaagaaagattttgggctgggatctattacaacccagcaaccggagtccaacatcctcgacatcgatctgcgccccgccagcgcttggacactttacgccgttgctaccacgttcattacccctatgctgagacattccatcgaaaattctagcgtgaacgtgtccctcacagccattgcgaatcaggccaccgtcctgatgggcctggggaagggatggcccctctctaagatggacatcggcgtgcctcttctggctattgggtgttatagccaggttaaccccatcacactgaccgccgctctcctgcttctggtggcccactacgctattatcggacctggcctccaggccaaagcgacgcgggaggcccaaaagcgcgctgccgctggcatcatgaaaaatccgacagtcgacgggattaccgtgatcgatctggaccccattccttatgatcccaagtttgaaaaacagctgggacaggtcatgctccttgtgctgtgcgttacacaggtgctgatgatgagaaccacctgggccctctgtgaggccctgacacttgcgacgggccctatctccaccctgtgggaagggaaccccggacggttctggaatacaaccattgctgtcagcatggccaacatctttcgcggctcttacctcgctggggccggactgctgttctccatcatgaagaacacagccaataccagacggggcacgggcaacacaggggagaccctcggagagaagtggaaaaatcgccttaacgctctgggcaagagcgaatttcaaatttataaaaagtctgggatccaggaggtggacagaaccctggccaaagaaggaattaagcggggcgagacagatcatcacgcggtttccagagggagcgccaaactccgctggttcgtggagcggaatctggtcaccccggaaggaaaggtggtggaccttggctgcggcagagggggatggtcttactattgtggcgggctgaagaacgttaaagaggtcaagggactcacaaaaggcgggcctggacatgaggaacccatccccatgagcacgtacggctggaatctggtgcgcctgcagtccggcgtggatgtcttctttacccctcccgaaaagtgcgacacactcctttgtgatattggggagtctagccctaacccgaccgttgaggctggacggacactgagagtgctgaatctcgtggaaaactggctgaataacaatacccaattctgcatcaaagtccttaacccctacatgccttccgtgatcgagaagatggaagccctgcagcgcaagtatggcggggctctcgttcggaatcccctgagcagaaactccacgcacgagatgtactgggtgtctaacgccagcggaaatattgtctcctctgtgaacatgatcagccgcatgctgattaatcggtttaccatgagacacaaaaaggcgacatatgaacctgacgttgatctcggctccgggacccgcaacatcggaattgagtctgagatccccaatcttgacatcattggcaaacggatcgaaaagattcagcaggagcatgaaacaagctggcactacgatcaagaccatccgtatagaacctgggcctaccacggctcctatgagacaaaacagaccgggagcgcttcttccatggtgaacggagtcgtgcgcctgctgacgaagccttgggacgtgatccccatggtcacacagatggccatgaccgataccacacctttcggccagcaaagagtttttaaggaaaaagtggacacgcggacccaggagcccaaggaggggaccaaaaagctcatgaaaattaccgctgaatggctgtggaaggagcttggaaagaaaaagacacctcgcatgtgtaccagagaagagttcacacggaaagtgagaagcaatgccgctctgggcgccatctttaccgatgagaacaagtggaaatctgcgcgggaagccgtcgaggactccgggttctgggaactcgtggataaggagcgcaatctgcacctggaaggaaaatgcgagacgtgtgtttacaacatgatgggcaagagagagaagaaactcggcgaatttgggaaggctaaaggaagccgggccatttggtacatgtggctgggcgctcgcttccttgagtttgaagccctggggttcctcaatgaggaccattggttttctagagaaaactccctgagcggagtggagggcgaggggcttcacaagctgggctatatcctccgggatgtctccaaaaaggaaggaggcgccatgtacgcggacgataccgctgggtgggacacacgcatcaccctggaggatctgaagaaagaagagatggtgacaaatcatatggaaggagagcacaagaaactcgccgaggccattttcaagctgacctatcagaacaaagttgtgagagtccagcggcccacgccgcgcggcacagtgatggacatcattagcagacgggaccaacgcgggtctggacaggttgtgacctacggccttaatacattcaccaacatggaagctcagctgatcagacaaatggagggggaaggcgtctttaagagcattcagcagctcacggtgaccgaggagatcgccgtcaagaactggctggtgcgggttggacgcgaaagactttcccggatggctatctctggcgatgactgcgtggtcaaacctctggatgacagattcgccagcgcgctcacagccctgaatgatatggggaaggtgcgcaaagacattcagcaatgggagccctcccggggatggaacgattggacccaggtgcccttttgctctcatcacttccacgaactgatcatgaaggacggcagagttctcgtggtcccttgtcgcaatcaggatgagctgattgggcgggctagaatcagccagggagccggctggtcccttcgcgaaacagcttgcctggggaaatcttatgcccaaatgtggagcctcatgtactttcatcggagagacctgcgccttgcggccaacgctatttgttccgccgtgccgagccactgggttcccacctctcggacaacctggtccatccatgctacgcacgagtggatgacaaccgaggatatgctgaccgtgtggaatagagtctggatccaggaaaacccttggatggaggacaagacacccgtggaaagctgggaggaaattccttatctcggcaagcgcgaggatcagtggtgcggatctctgatcggcctgacctcccgggccacatgggctaaaaatattcagacggccatcaaccaagtcagaagcctcattgggaatgaggaatacaccgactacatgccctccatgaagcggttcagacgcgaggaagaggaagcgggagtgctgtggtga

SEQ ID NO: 20218 - RNA, 9876 nt, synthetic construct
  misc_feature 1..9876: note = derived and/or modified CDS sequence (opt5) from DENV-2__KC762671__SS-prME
  source 1..9876: mol_type = other RNA
accgccggcatcattatcatgatgattcccacggtgatggctttccacctgacgaccagaaatggggagcctcatatgatcgtgagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaagcgtggggaaaggccaagatgctctctaccgaactgcacaatcatacgttcctgatcgatggccctgagaccgctgaatgccccaacacaaatcgcgcctggaactccctcgaggttgaggactatgggtttggagtgttcaccacaaatatttggctgaaacttaaggaacggcaagatgtcttttgtgacagcaaactgatgtctgctgccatcaaggactccagagcggtgcacgccgatatgggctactggattgagagcgctctcaacgacacctggaaaatcgaaaaggcctctttcatcgaggtcaagagctgccactggcctaaatcccatacactgtggagcaacggcgtcctggagtctgaaatgattatccccaagaatttcgctgggccggtttcccagcacaactatcgccctggataccatacccagacggccggcccctggcaccttgggcggctcgagatggattttgacttctgtgaaggaacaaccgtggtggtcaccgaggattgcggcaatagagggcccagcctgcggacaaccacggcctccggaaaactgattacagaatggtgctgtcgctcttgcaccctccctccgctgagataccggggcgaggacggctgttggtatgggatggagatcagaccccttaaggaaaaagaggaaaacctggtgaatagcctcgttacagctggacatggccagattgataacttttccctgggggtgctgggaatggcgcttttcctcgaggaaatgctgcgcacccgggtcggcacaaagcacgccatcctgctcgtggctgtttcttttgtgaccctgattacggggaatatgagcttcagagaccttggacgcgtcatggtgatggttggcgccaccatgacagatgacatcggcatgggggtgacctacctggccctcctggctgcctttaaggtcagacctacattcgcggctggactgcttctgcggaaactcacctccaaggagctgatgatgacgacaatcggcattgtgctcctgtctcaagccaccatccccgagacaattcttgaactgaccgatgccctcgctctggggatgatggtgctgaaaatcgtccgcaacatggagaagtatcagcttgccgttaccattatggcgatcctgtgcgtgcctaatgctgtgatcctccagaacgcctggaaagtcagctgtacaacgctggccgtggtttccgtgagccccctcctgcttacctcttcccaacagaaggctgactggattcctctggccctcacaatcaagggactgaatcccaccgctatttttctgacaacccttagcagaacgtctaaaaagcggtcctggccgctgaacgaagccatcatggcggtcggcatggtgagcattctcgcctcttccctgctcaaaaatgatatccctatgacagggcccctggttgctggaggccttctgaccgtgtgctacgtcctgaccggccgcagcgccgacctcgagctggaaagagctgccgacgtgcggtgggaggagcaggccgaaatctccgggagctctcctattcttagcatcacaatttccgaggatggatctatgagcatcaagaacgaagaggaggaacagaccctgacaattctcatccgcacgggcctgctcgtcatttccgggctgttccccgtgtctatcccgatcaccgctgcggcctggtatctttgggaggttaaaaagcaaagagctggagtgctgtgggacgtcccttctccccctcccgtgggcaaagccgaactggaggatggggcctaccggattaagcagaagggaatcctcggctattcccagattggcgctggggtttacaaagaaggaacatttcacaccatgtggcatgtgacacgcggcgccgtcctgatgcacaaggggaaaagaatcgagccctcctgggcggacgtgaagaaagatcttattagctacggaggcgggtggaagctggagggagaatggaaggagggcgaagaggtgcaggttctcgctctggaacctggcaaaaatccgcgggccgtccaaaccaagcccggactcttcaaaacgaacaccggaacaatcggcgccgtgtccctggactttagccctgggacctctggatcccccatcgtggataagaaaggcaaggtcgtggggctttatggaaacggcgttgtgacaagaagcggcacctacgtctctgctattgcccagacagagaagtccatcgaggacaatcctgaaattgaggatgacatcttccgcaaaaagcggctgacgattatggatctgcatcccggggcgggaaaaaccaagagatatctccctgctatcgtgcgcgaagccatcaaacggggcctgagaacacttattctggccccgacccgcgttgtggctgccgagatggaagaggctctccgggggctgcccatcagataccagacccctgccattcgcgcggagcacacaggacgggaaatcgtcgacctcatgtgtcatgccacgttcaccatgagactgcttagccccattcgggtgcctaactataatctgatcattatggatgaggctcactttacagaccccgcctccatcgctgcccgcggctacatctctaccagagttgaaatgggggaggccgctggcattttcatgacagcgaccccgcctggaagccgggacccctttccccagtccaacgcccctatcatggatgaggaacgcgagattcccgaaagaagctggaactctggccacgagtgggtgacggacttcaaggggaagacagtctggtttgtgccttccatcaaagctggaaacgatattgccgcctgcctgcggaagaatggcaaaaaggtgatccaactcagcagaaaaaccttcgactttgaatatatcaagacccgcacaaacgattgggacttcgtcgttaccacagatatttctgagatgggggctaattttaaggccgagcgggtgatcgacccgagacgctgtatgaaacccgtgattctgaccgatggagaagaacgggtcatccttgcgggccctatgcccgtgacgcatagctccgctgcccagagacgcgggcgggttggcagaaaccctaagaatgaaaacgaccagtacatttacatgggagagcccctggaaaatgatgaggactgcgcccactggaaagaggctaagatgctcctggacaacatcaatacaccggaaggcatcattccttctatgttcgagcccgaacgcgagaaagtggatgccatcgacggggaatatagactgcggggagaggcgcgcaagacctttgtcgatctcatgagacggggcgaccttcctgtgtggctggcctaccgcgttgctgccgaggggattaactatgctgatagacggtggtgtttcgacggagtgaaaaacaatcaaatcctggaagagaacgtcgaagtggagatttggacaaaggagggcgaaagaaagaaactcaagccccgctggctggatgcccggatctacagcgaccctcttgctctgaaagagttcaaggaatttgccgcggggagaaaatccctcaccctgaatctgattacggagatgggccgcctccccaccttcatgacacagaaggcccggaacgctcttgataatctggccgtcctgcataccgctgaagccggaggcagagcctataaccacgctctctctgagctgccggagacacttgaaaccctgctcctgctgacactccttgcgaccgtgacaggcgggatctttctgttcctgatgagcgggaaggggatcggaaaaatgacactcggcatgtgctgcattatcaccgcctccattctgctttggtacgctcagatccagcctcactggattgccgccagcatcatcctggagtttttcctcattgttctgctgatccccgaacccgagaagcaacggacccctcaggacaatcagctcacatatgtggtgattgctatccttaccgtcgttgccgcgacaatggccaacgaaatgggctttctggagaaaacgaagaaagatttcgggctgggatctattaccacacagcaaccggagtccaatatcctcgacatcgatctgcgccccgctagcgcctggaccctttacgctgtggccacaacctttattacgcctatgctgagacattccatcgaaaactctagcgtgaatgtctccctcaccgcgattgccaaccaggctacagtgctgatgggcctggggaagggatggcccctctctaagatggacatcggcgttcctcttctggccattgggtgttacagccaggtgaatcccatcaccctgacagctgccctcctgcttctggtcgctcactatgccattatcggacctggcctccaggcgaaagccacccgggaggctcaaaagcgcgccgctgccggcatcatgaaaaacccgacggtggacgggattacagtcatcgatctggaccccattccttacgatcccaagttcgaaaaacagctgggacaggtgatgctccttgttctgtgcgtgacccaggtcctgatgatgagaacaacctgggccctctgtgaggcgctgacccttgctacaggccctatctccacgctgtgggaagggaatcccggacggttttggaacaccacaattgccgtgagcatggctaatatcttccgcggctcttatctcgccggggccggactgctgttttccatcatgaagaacaccgctaacacaagacggggcaccggcaatacgggggagacactcggagagaagtggaaaaaccgccttaatgccctgggcaagagcgagttccaaatttacaaaaagtctgggatccaggaggttgacagaaccctggcgaaagaaggaattaagcggggcgagaccgatcatcacgccgtgtccagagggagcgctaaactccgctggttcgtcgagcggaacctggtgacaccggaaggaaaggtggttgaccttggctgcggcagagggggatggtcttattactgtggcgggctgaagaatgtcaaagaggtgaagggactcaccaaaggcgggcctggacatgaagaacccatccccatgagcacatatggctggaacctggtgcgcctgcagtccggcgtcgatgtctttttcacgcctcccgaaaagtgcgacaccctcctttgtgatattggggagtctagccctaatccgacagtggaggccggacggaccctgagagtgctgaacctcgtcgaaaattggctgaacaataacacacaattttgcatcaaagtgcttaatccctacatgccttccgttatcgagaagatggaagctctgcagcgcaagtacggcggggccctcgtgcggaaccccctgagcagaaattccacccacgagatgtattgggtctctaacgcgagcggaaacattgtgtcctctgttaatatgatcagccgcatgctgattaaccggttcacgatgagacacaaaaaggccacctacgaacctgacgtggatctcggctccgggacacgcaatatcggaattgagtctgagacccccaaccttgacatcatcggcaaacggattgaaaagatcaaacaggagcatgaaacaagctggcactatgatcaggaccatccgtacaagacctgggcttatcacggctcctacgagacaaagcaaaccgggagcgcctcttccatggtcaatggagtggtgagactgctgacgaaaccttgggacgtcattcccatggttacacagatggctatgaccgataccacaccttttggccagcagcgcgtgttcaaggaaaaagtggacacgagaacccaagagcccaaggaggggaccaaaaagctcatgaagatcaccgccgaatggctgtggaaagagcttggaaagaaaaagacacctcggatgtgtacccgcgaagagtttgctagaaaagtccggagcaacgccgcgctgggcgccattttcacagatgagaataagtggaaatctgctagagaagccgtggaggactccgggttttgggaactcgttgataaggagcggaacctgcacctggaaggaaagtgcgagacctgtgtgtataatatgatgggcaaacgcgagaagaaactcggcgagttcgggaaggctaaaggaagcagagccatctggtacatgtggctgggcgcccggtttcttgagttcgaagcgctggggtttctcaacgaggaccattggttctctcgcgaaaattccctgagcggagtcgagggcgaggggcttcacaagctgggctacattctcagagatgtgtccatgaaggaaggaggcgctatgtatgccgacgatacggccgggtgggacacccggatcacactggaggatctgaaaaacgaagagatggttaccaatcatatggaaggagagcacaagaaactcgctgaggccatcttcaagctgacataccagaacaaagtggtccgcgtgcagagacccaccccgcggggcacggttatggacattatcagccgcagagaccagcgggggtctggacaagtggtcacatatggccttaatacctttacaaacatggaagctcagctgattcgccagatggagggggaaggcgtgttcaagagcatccaacagctcaccgtcacggaggagattgccgtgaagaactggctggttagagtgggacgggaacgcctttccagaatggcgatctctggcgatgactgcgtcgtgaaacctctggatgaccggtttgccagcgctctcaccgccctgaatgatatggggaaggtgagaaaagacatccagcagtgggagccctcccgcggatggaacgattggacacaagttcccttctgctctcatcactttcacgaactgattatgaaggacggccgggtgctcgtcgtgccttgtagaaatcaggatgagctgatcgggcgcgctcggattagccagggagccggctggtcccttagagaaaccgcgtgcctggggaaatcttacgcccagatgtggagcctcatgtatttccatcgccgggacctgagacttgctgccaacgctatctgttccgccgttccgagccactgggtgcccacatctcgcaccacatggtccattcatgctacccacgagtggatgacgacagaggatatgctgaccgtctggaatcgggtgtggatccaagaaaacccttggatggaggacaagacccccgtcgaaagctgggaggaaatcccttacctcggcaagagagaggatcagtggtgcggatctctgattggcctgacatcccgcgccacctgggcgaaaaatatccagacagccattaaccaggtgcggagcctcatcgggaatgaggaatatacggactacatgccctccatgaagagatttcggagagaggaagaggaagctggagttctgtggtga

SEQ ID NO: 20219 - RNA, 9876 nt, synthetic construct
  misc_feature 1..9876: note = derived and/or modified CDS sequence (opt5) from DENV-2__KC762664__SS-prME
  source 1..9876: mol_type = other RNA
accgccggaatcattatcatgatgattcccacagtgatggctttccacctgacgaccagaaacggggagcctcatatgatcgtcagccggcaggaaaaggggaaatccctcctgtttaagacagagaatggcgttaacatgtgcacccttatggccatggacctgggggaactctgtgaggatacaattacctacaattgcccgctgcttagacaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcaccgatctggaaaagcgccacggactcggccggctgattacagtgaatcctatcgtcaccgagaaagactctccggtgaacattgaagccgagcccccttttggggattcctacatcattatcggcgttgaacccggacagctgaagctcagctggttcaaaaagggctctagcattgggcagatgtttgagacaaccatgagaggagctaagcgcatggccatcctgggcgacacggcctgggatttcgggtcccttggaggcgtgtttacatctatcgggaaagctctgcatcaagtcttcggcgccatttatggagcggcttttagcggcgtgtcctggaccatgaagatcctcattggggtggttatcacctggattggaatgaatagccggtctacatccctgagcgtctctctggtgcttgtgggcgtcgtgaccctctacctgggggttatggtgcaggccgactccggatgtgtcgtgagctggaaaaacaaggagctgaaatgcggctccgggatcttcatcacagataatgttcacacgtggaccgaacagtataagtttcagcctgagtctcccagcaagctcgcctccgctattcaaaaagcccacgaagagggcatctgtggaattagatctgtgacacgcctggaaaaccttatgtggaagcagatcaccccggagctgaatcatattctcagcgagaacgaagtcaaactgacaatcatgaccggcgacatcaaggggattatgcaggctggaaaacggtccctgagacctcagcccacggagcttaagtacagctggaaaacctggggcaaggccaagatgctctctacagaactgcacaatcataccttcctgatcgatgggcctgagacagcggaatgccccaacgccaatcgcgcttggaactccctcgaggtggaggactatggatttggcgttttcaccacaaatatttggctgaaacttaaggaacggcaagatgccttttgtgacagcaaactgatgtctgctgccatcaaggacaacagagcggtgcacgccgatatgggctactggattgagtccgctctcaacgacacctggaaaatcgaaaaggccagcttcatcgaggtcaagtcttgccactggcctaaaagccatacgctgtggtccaatggggtgctggagagcgaaatgattatccccaagaacttcgctggaccggtgtctcagcacaattatcgccctggctaccatacacagaccgccgggccctggcaccttggacggctcgagatggattttgacttctgtgaaggcaccacagtcgttgtgaccgaggattgcgggaacagaggaccctccctgcggacgacaaccgccagcggcaaactgattacagaatggtgctgtcgctcctgcaccctccctccgctgagataccggggcgaggacgggtgttggtatggaatggagatcagaccccttaaggaaaaagaggaaaatctggtgaactctctcgtcacagctggccatgggcagattgataattttagcctgggagtgctgggcatggcgcttttcctcgaggaaatgctgcgcacccgggttgggacgaagcacgccatcctgctcgtggctgtctcctttgtgaccctgattacaggaaacatgtctttcagagaccttggccgcgttatggtgatggtcggcgccaccatgacagatgacatcgggatgggagtgacctacctggccctcctggctgcctttaaggttagacctacgttcgcggctggcctgcttctgcggaaactcacaagcaaggagctgatgatgaccacaatcgggattaccctcctgtcccaatctaccatccccgagacaattcttgaactgacggatgccctcgccctgggaatgatggtgctgaaaatcgtccgcaatatggagaagtatcagcttgctgtgaccattatggccatcctgtgcgtgcctaacgcggtcatcctccagaatgcttggaaagttagctgtacaaccctggccgtggtgtccgtcagccccctcctgcttacatcttcccaacagaaggccgactggattcctctggctctcaccatcaagggcctgaaccccacggccatttttctgacaacccttagcagaacctctaaaaagcggtcctggccgctgaatgaagctatcatggccgtggggatggttagcattctcgcgtcttccctgctcaaaaacgatatccctatgacaggacccctggtggccggcggccttctgaccgtctgctacgtgctgacagggcgcagcgctgacctcgagctggaaagagccgctgacgttcggtgggaggagcaggccgaaatctccggaagctctcctattcttagcatcacgatttccgaggatggctctatgagcatcaagaatgaagaggaggaacagaccctgacaattctcatccgcaccgggctgctcgtgatttccggactgttccccgtctctatcccgatcacagccgctgcgtggtatctttgggaggtgaaaaagcaaagagccggcgtcctgtgggacgtgccttctccccctcccgttgaaaaagctgagctggaagatggggcctaccggattaagcagaagggaatcctcggctattcccagattggcgccggggtgtacaaagagggaacctttcacacgatgtggcatgtcacccgcggcgctgtgctgatgcacaaggggaaaagaatcgagccctcctgggccgacgttaagaaagatcttattagctacggaggcgggtggaagctggaaggagagtggaaggaaggcgaggaagtgcaggtcctcgcgctggagcctggcaaaaacccgcgggctgtgcaaacaaagcccggactcttcaaaacctccacaggaaccatcggcgccgtgagcctggacttttctcctgggacatccggaagccccatcgttgataagaaaggcaaggtcgtggggctttatggaaacggcgtggtcacgagatctggcacctacgtgtccgccattgctcagacagaaaagagcatcgaagacaatcctgagattgaagatgacatcttccgcaaaaagcggctgaccattatggatctgcatcccggggccggaaaaaccaagagatatctccctgcgatcgttcgcgaggctatcaaacggggcctgagaacacttattctggccccgacgcgcgtggtcgccgctgaaatggaggaggccctccgggggctgcccatcagataccagacccctgctattcgcgccgaacacacaggacgggagatcgtggacctcatgtgtcatgcgaccttcacaatgagactgctttcccccattcgggttcctaactataatctgatcattatggatgaagcccactttaccgaccccgcttctatcgccgctcgcggctacatcagcacgagagtggagatggggaaggccgccggcattttcatgacagctaccccgcctggatcccgggacccctttccccagagcaacgcgcctatcatggatgaggaacgcgagattcccgaaagatcttggaatagcggccacgagtgggtcaccgacttcaaggggaaaacagtgtggtttgttcctagcatcaaggccggaaacgatattgctgcctgcctgcggaaaaatggcaagaaagtgatccaactctctagaaagaccttcgactttgaatatatcaagacacgcaccaacgattgggacttcgtcgtgacgacagatattagcgagatgggggccaattttaaagctgagcgggtgatcgacccgagacgctgtatgaagcccgtcattctgaccgatggagaagaacgggttatccttgccggccctatgcccgtgacacattcctctgcggctcagagacgcgggcgggtgggcagaaaccctaaaaatgaaaacgaccagtacatttacatgggagagcccctggaaaatgatgaggactgcgcccactggaaggaggccaaaatgctcctggacaacatcaataccccggaaggcatcattcctagcatgttcgagcccgaacgcgagaaggtcgatgctatcgacggggaatatagactgcggggagaggcccgcaaaacgtttgtggatctcatgagacggggcgaccttcctgtttggctggcgtaccgcgtggccgctgaggggattaactatgccgatagacggtggtgtttcgacggagtcaagaacaatcaaatcctggaagagaacgtggaagttgagatttggaccaaggagggcgaacgcaaaaagctcaaaccccgctggctggatgctcggatctactccgaccctcttgccctgaaggagttcaaagaatttgctgccgggagaaagtctctcacactgaatctgattaccgagatgggccgcctccccacattcatgacccagaaggcgcggaacgcccttgataatctggctgtgctgcatacagccgaagctggaggcagagcctataaccacgccctcagcgagctgccggagacccttgaaacgctgctcctgctgacactccttgctaccgtcaccgggggaatctttctgttcctgatgtccggcaaagggatcggaaagatgacactcggcatgtgctgcattatcaccgcgagcattctgctttggtacgcccagatccagcctcactggattgctgcctctatcatcctggagtttttcctcattgtgctgctgatccccgaacccgagaaacaacggacacctcaggacaatcagctcacgtatgtcgtgattgccatccttaccgttgtggctgccacaatggcgaacgaaatgggctttctggagaagaccaaaaaggatttcgggctgggatccattacaacccagcaaccggagagcaatatcctcgacatcgatctgcgccccgcctccgcttggacgctttacgccgtggctaccacatttattacccctatgctgagacattctatcgaaaacagctccgtcaatgtttctctcacagccattgcgaaccaggccaccgtgctgatgggcctggggaagggatggcccctcagcaaaatggacatcggcgtgcctcttctggctattgggtgttactcccaggtcaatcccatcacgctgacagccgctctcctgcttctggtggcccactatgctattatcggacctggcctccaggccaaggcgacccgggaggcccaaaaacgcgctgccgctggcatcatgaagaacccgacagttgacgggattaccgtgatcgatctggaccccattccttacgatcccaaattcgaaaagcagctgggacaggtcatgctccttgtgctgtgcgtcacccaggtgctgatgatgagaacaacgtgggccctctgtgaggccctgacccttgcgacaggccctatcagcaccctgtgggaagggaatcccggacggttttggaacacaaccattgctgtttctatggccaatatcttccgcggctcctatctcgctggggccggactgctgtttagcatcatgaagaacacggccaacacaagacggggcaccggcaataccggggagacactcggagagaaatggaagaaccgccttaatgctctgggcaaatctgagttccaaatttacaagaaatccgggatccaggaggtggacagaaccctggccaaggaaggaattaaacggggcgagacagatcatcacgcggtcagcagagggtctgccaagctccgctggttcgtggagcggaacctggttacgccggaaggaaaggtggtcgaccttggctgcggcagagggggatggagctattactgtggcgggctgaaaaatgtgaaggaggtgaaaggactcaccaagggcgggcctggacatgaagaacccatccccatgtccacatatggctggaacctggttcgcctgcagtctggcgtcgatgtgtttttcacccctcccgaaaaatgcgacacactcctttgtgatattggggagagctcccctaatccgaccgtggaggctggacggacgctgagagtcctgaacctcgttgaaaattggctgaacaataacacccaattttgcatcaaggtgcttaatccctacatgcctagcgtgatcgagaagatggaagccctgcagcgcaaatacggcggggctctcgtccggaaccccctgtccagaaattctacacacgagatgtattgggtgagcaacgcctccggaaacattgtttctagcgtgaatatgatctcccgcatgctgattaaccggttcaccatgagacacaagaaagcgacatacgaacctgacgtcgatctcggctctgggacccgcaatatcggaattgagagcgagacacccaaccttgacatcatcggcaagcggattgagaaaatcaagcaggagcatgaaacctcctggcactatgatcaggaccatccgtacaagacgtgggcctatcacggcagctacgagacaaaacaaaccgggtctgcttccagcatggtgaatggagttgtgagactgctgaccaagccttgggacgtcattcccatggtgacacagatggccatgacggataccacaccttttggccagcagcgcgtgttcaaagaaaaggtcgacaccagaacacaagagcccaaagaggggaccaagaagctcatgaaaatcacagctgaatggctgtggaaggagcttggcaaaaagaaaacccctcggatgtgtacgcgcgaagagtttaccagaaaggttcggtctaacgccgctctgggcgccattttcacagatgagaataaatggaagtccgcgagagaagccgtggaggacagcgggttttgggaactcgtggataaggagcggaacctgcacctggaaggaaaatgcgagacctgtgtctataatatgatgggcaagcgcgagaaaaagctcggcgagttcgggaaagctaagggatctagagccatctggtacatgtggctgggcgctcggtttcttgagttcgaagccctggggtttctcaacgaggaccattggttctcccgcgaaaatagcctgtccggagtggagggcgaggggcttcacaagctgggctacattctcagagatgttagcaaaaaggaaggaggcgccatgtatgcggacgatacagctgggtgggacacccggatcacgctggaggatctgaaaaacgaagagatggtgacaaatcatatggaaggagagcacaagaaactcgccgaggccatcttcaagctgacctaccagaacaaggtcgtgcgcgttcagagacccacaccgcggggcaccgtgatggacattatctctcgcagagaccagcgggggagcggacaagtcgtgacgtatggccttaatacctttacaaacatggaagctcagctgattcgccagatggagggggaaggcgttttcaaatccatccaacagctcaccgtgacagaggagattgccgtcaagaactggctggtgaccgtcggaagagaacggctttctcgcatggctatcagcggcgatgactgcgtggttaaacctctggatgacagatttgcctccgcgctcacagccctgaatgatatggggaaggtgcggaaagacatccagcagtgggagccctctagaggatggaacgattggacccaagtccccttctgcagccatcactttcacgaactgattatgaaggacggccgcgtgctcgtggttccttgtcggaatcaggatgagctgatcgggagagctcgcatttcccagggagccggctggtctcttcgggaaacggcttgcctgggaaagagctacgcccagatgtggtccctcatgtatttccatagacgcgacctgcggcttgcggccaacgctatctgtagcgccgtgccgtctcactgggtccccacatccagaaccacctggagcattcatgctacacacgagtggatgaccacagaggatatgctgacggtgtggaatcgcgtttggatccaagaaaacccttggatggaggacaaaacccccgtgggctcttgggaagagatcccttacctcggaaagcgggaagatcagtggtgcggctccctgattgggctgacaagcagagccacctgggctaaaaatatccagacagccattaaccaggtccgctccctcatcggaaatgaggagtataccgactacatgccctctatgaagcggtttagacgggaagaggaagaggcgggcgtgctgtggtga

SEQ ID NO: 20220 - RNA, 9876 nt, synthetic construct
  misc_feature 1..9876: note = derived and/or modified CDS sequence (opt5) from DENV-2__KC762674__SS-prME
  source 1..9876: mol_type = other RNA
acagccggcatcattatcatgatgattcccacagtgatggctttccacctgacgaccagaaacggggagcctcatatgatcgtgagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacccactttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacatcctgccacccttagaaagtattgcattgaagctaaactgacgaacacaaccaccgcctctcggtgtccgacacagggggagccctccctcaatgaggaacaagataagcgctttgtgtgcaaacacagcatggtcgacagaggatggggcaacggctgtgggctgttcggaaagggcgggatcgttacctgcgcgatgtttacatgcaagaaaaatatggagggaaagattgtgcagcctgaaaacctggagtacacgatcgtgattacaccccattctggcgaagagaatgccgtcgggaacgatacaggaaaacacggcaaggagatcaaagtgacccctcagtccagcatcacagaagctgagctcaccggctatgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcatgccaagaaacaggatgttgtggtcctgggaagccaagagggcgccatgcacacggctctcacaggggcgaccgaaatccagatgtcctctggcaacctgctttttacaggacatctgaagtgcagactccggatggacaaactgcagcttaagggcatgagctactccatgtgtaccgggaaattcaaggtggtcaaggagattgccgaaacccaacacggaacaatcgtgattagagttcagtatgagggcgacgggagcccctgcaaaatccccttcgagatcatggatctggaaaagcgccatgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcaccaagtgttcggggcgatttacggcgctgcctttagcggagtgtcctggacgatgaagatcctcattggcgttgtcatcacatggattgggatgaatagccggtctacctccctgagcgtgtctctggtgcttgtcggagtggttaccctctatctgggcgtgatggtccaggccgactccgggtgtgtggttagctggaaaaacaaggagctgaaatgcggatccggcatcttcatcacagataatgtgcacacctggacagaacagtacaagtttcagcctgagtctcccagcaagctcgcttccgccattcaaaaagctcatgaagaggggatctgtggcattagatctgtcacgcgcctggaaaaccttatgtggaagcagatcaccccggagctgaatcacattctcagcgagaacgaagtgaaactgacaatcatgaccggagacatcaagggcattatgcaggccgggaaacggtccctgagacctcagcccacagagcttaagtatagctggaaaacctggggaaaggcgaagatgctctctacggaactgcataatcacaccttcctgatcgatggccctgagacagccgaatgccccaacaccaatcgcgcttggaactccctcgaggttgaggactacgggtttggagtgttcacaaccaatatttggctgaaacttaaggaacggcaagatgtctattgtgacagcaaactgatgtctgccgctatcaaggacaacagagccgtgcacgcggatatgggctactggattgagtccgccctcaacgacacatggaaaatcgaaaaggctagctttatcgaggtgaagtcttgctattggcctaaaagccataccctgtggtccaatggcgtcctggagagcgaaatgattatccccaagaacttcgccgggccggtttctcagcacaattaccgccctggataccatacgcagacagctggcccctggcaccttgggcggctcgagatggatttcgacttttgtgaaggaaccaccgtggtggtcacagaggattgcggcaacagagggccctccctgcggaccacgacagccagcggaaaactgattaccgaatggtgctgtcgctcctgcacactccctccgctgagatatcggggcgaggacggctgttggtacgggatggagatcagaccccttaaggaaaaagaggaaaatctggtgaactctctcgttaccgccggacatggccagattgataatttcagcctgggggtgctgggaatggctctttttctcgaggaaatgctgcgcacacgggtcggcaccaagcacgcgatcctgctcgtggccgtttccttcgtgacgctgattaccgggaacatgtcttttagagaccttggacgcgtcatggtgatggttggcgctacaatgaccgatgacatcggcatgggggtgacatatctggccctcctggccgctttcaaggtcagacctacctttgccgcgggactgcttctgcggaaactcacgagcaaggagctgatgatgacaaccatcggcattgtgctcctgtcccaatctacaatccccgagaccattcttgaactgaccgatgctctcgccctggggatgatggccctgaaaatcgtgcgcaatatggagaagtaccagcttgctgtcacaattatggccatcctgtgcgttcctaacgcggtgatcctccagaatgcttggaaagtgagctgtacgaccctggccgtcgtgtccgttagccccctcctgcttacatcttcccaacagaaggccgactggattcctctggctctcaccatcaagggactgaaccccacagccattttcctgaccacgcttagcagaacatctaaaaagcggtcctggccgctgaatgaagctatcatggccgtgggcatggtcagcattctcgcgtcttccctgctcaaaaacgatatccctatgaccgggcccctggtggccggaggccttctgaccgtttgctatgtgctgacaggccgcagcgctgacctcgagctggaaagagccgctgacgtccggtgggaggagcaggccgaaatctccgggagctctcctattcttagcatcaccatttccgaggatggatctatgagcatcaagaatgaagaggaggaacagacactgacgattctcatccgcaccggcctgctcgtgatttccgggctgtttcccgtctctatcccgatcacagccgctgcgtggtacctttgggaggtgaaaaagcaaagagccggagttctgtgggacgtgccttctccccctcccgtcggcaaagctgaactggaggatggggcctatcggattaagcagaagggaatcctcggctactcccagattggcgccggggtgtacaaagaaggaaccttccacacaatgtggcatgttacccgcggcgctgtgctgatgcacaaggggaaaagaatcgagccctcctgggccgacgtcaagaaagatcttattagctatggaggcgggtggaagctggagggagaatggaaggagggcgaagaggtccaggtgctcgcgctggaacctggcaaaaacccgcgggctgttcaaacgaagcccgggctctttaaaaccaacacaggaaccatcggcgccgtctccctggacttcagccctgggacatctggatcccccatcgtggataagaaaggcaaggtggtcgggctttacggaaatggcgtggttaccagaagcggcacatatgtgtctgccattgctcagacggagaagtccatcgaggacaaccctgaaattgaggatgacatctttcgcaaaaagcggctgaccattatggatctgcatcccggggccggaaaaacaaagagatacctccctgcgatcgtccgcgaagctatcaaacggggcctgagaacccttattctggccccgacccgcgtggttgccgctgagatggaagaggccctccgggggctgcccatcagatatcagacccctgctattcgcgccgagcacacgggacgggaaatcgtggacctcatgtgtcatgcgaccttcacaatgagactgcttagccccattcgggtccctaattacaacctgatcattatggatgaggcccacttcaccgaccccgcttccatcgccgctcgcggctatatctctacaagagtggaaatgggggaggccgccggcatttttatgaccgctacgccgcctggaagccgggaccccttcccccagtccaatgcgcctatcatggatgaggaacgcgagattcccgaaagaagctggaactctggccacgagtgggttacagactttaaggggaagaccgtgtggttcgtcccttccatcaaagccggaaatgatattgctgcctgcctgcggaagaacggcaaaaaggtgatccaactcagcagaaaaacctttgacttcgaatacatcaagacacgcaccaatgattgggactttgtggtcacaaccgatatttctgagatgggggccaacttcaaggctgagcgggttatcgacccgagacgctgtatgaaacccgtgattctgacggatggagaagaacgggtgatccttgccggccctatgcccgtcacacatagctccgcggctcagagacgcgggcgggtgggcagaaatcctaagaacgaaaatgaccagtacatttatatgggagagcccctggaaaacgatgaggactgcgcccactggaaagaggccaagatgctcctggacaatatcaacaccccggaaggcatcattccttctatgtttgagcccgaacgcgagaaagttgatgctatcgacggggaatacagactgcggggagaggcccgcaagacattcgtggatctcatgagacggggcgaccttcctgtctggctggcgtatcgcgtggccgctgaggggattaactacgccgatagacggtggtgttttgacggagttaaaaataaccaaatcctggaagagaatgtggaagtcgagatttggaccaaggagggcgaaagaaagaaactcaagccccgctggctggatgctcggatctatagcgaccctcttgccctgaaagagttcaaggagttcgctgccgggagaaaatccctcacgctgaacctgattaccgagatgggccgcctccccacatttatgacccagaaggcgcggaatgcccttgataacctggctgtgctgcatacagccgaagctggaggcagagcctacaatcacgccctctctgagctgccggagacccttgaaacactgctcctgctgaccctccttgctacggtcacagggggaatcttcctgtttctgatgagcggcaaggggatcggaaaaatgaccctcggcatgtgctgcattatcaccgcgtccattctgctttggtatgcccagatccagcctcactggattgctgccagcatcatcctggagttctttctcattgtgctgctgatccccgaacccgagaagcaacggacacctcaggacaaccagctcacctacgttgtgattgccatccttacagtggtcgctgccacgatggcgaatgaaatgggcttcctggagaaaaccaagaaagattttgggctgggatctattacaacccagcaaccggagtccaacatcctcgacatcgatctgcgccccgccagcgcttggacactttacgccgttgctaccacgttcattacccctatgctgagacattccatcgaaaattctagcgtgaacgtgtccctcacagccattgcgaatcaggccaccgtcctgatgggcctggggaagggatggcccctctctaagatggacatcggcgtgcctcttctggctattgggtgttatagccaggttaaccccatcacactgaccgccgctctcctgcttctggtggcccactacgctattatcggacctggcctccaggccaaagcgacgcgggaggcccaaaagcgcgctgccgctggcatcatgaaaaatccgacagtcgacgggattaccgtgatcgatctggaccccattccttatgatcccaagtttgaaaaacagctgggacaggtcatgctccttgtgctgtgcgttacacaggtgctgatgatgagaaccacctgggccctctgtgaggccctgacacttgcgacgggccctatctccaccctgtgggaagggaaccccggacggttctggaatacaaccattgctgtcagcatggccaacatctttcgcggctcttacctcgctggggccggactgctgttctccatcatgaagaacacagccaataccagacggggcacgggcaacacaggggagaccctcggagagaagtggaaaaatcgccttaacgctctgggcaagagcgaatttcaaatttataaaaagtctgggatccaggaggtggacagaaccctggccaaagaaggaattaagcggggcgagacagatcatcacgcggtttccagagggagcgccaaactccgctggttcgtggagcggaatctggtcaccccggaaggaaaggtggtggaccttggctgcggcagagggggatggtcttactattgtggcgggctgaagaacgttaaagaggtcaagggactcacaaaaggcgggcctggacatgaggaacccatccccatgagcacgtacggctggaatctggtgcgcctgcagtccggcgtggatgtcttctttacccctcccgaaaagtgcgacacactcctttgtgatattggggagtctagccctaacccgaccgttgaggctggacggacactgagagtgctgaatctcgtggaaaactggctgaataacaatacccaattctgcatcaaagtccttaacccctacatgccttccgtgatcgagaagatggaagccctgcagcgcaagtatggcggggctctcgttcggaatcccctgagcagaaactccacgcacgagatgtactgggtgtctaacgccagcggaaatattgtctcctctgtgaacatgatcagccgcatgctgattaatcggtttaccatgagacacaaaaaggcgacatatgaacctgacgttgatctcggctccgggacccgcaacatcggaattgagtctgagatccccaatcttgacatcattggcaaacggatcgaaaagattaaacaggagcatgaaacaagctggcactacgatcaggaccatccgtataagacctgggcctaccacggctcctatgagacaaagcaaaccgggagcgcttcttccatggtgaacggagtcgtgagactgctgacgaaaccttgggacgtgatccccatggtcacacagatggccatgaccgataccacacctttcggccagcagcgcgtttttaaggaaaaagtggacacgagaacccaagagcccaaggaggggaccaaaaagctcatgaagattaccgctgaatggctgtggaaagagcttggaaagaaaaagacacctcggatgtgtacccgcgaagagttcacaagaaaagtgcggagcaatgccgctctgggcgccatctttaccgatgagaacaagtggaaatctgcgagagaagccgtcgaggactccgggttctgggaactcgtggataaggagcggaatctgcacctggaaggaaagtgcgagacgtgtgtttacaacatgatgggcaaacgcgagaagaaactcggcgaatttgggaaggctaaaggaagcagagccatttggtacatgtggctgggcgctcggttccttgagtttgaagccctggggttcctcaatgaggaccattggttttctcgcgaaaactccctgagcggagtggagggcgaggggcttcacaagctgggctatatcctcagagatgtctccaagaaagaaggaggcgccatgtacgcggacgataccgctgggtgggacacacggatcaccctggaggatctgaagaatgaagagatggtgacaaaccatatggaaggagagcacaaaaagctcgccgaggccattttcaaactgacctatcagaataaggttgtgcgcgtccagagacccacgccgcggggcacagtgatggacatcattagccgcagagaccagcgggggtctggacaagttgtgacctacggccttaacacattcaccaacatggaagctcagctgatccgccagatggagggggaaggcgtctttaagagcattcaacagctcacggtgaccgaggagatcgccgtcaaaaattggctggtgagagttggacgggaacgcctttccagaatggctatctctggcgatgactgcgtggtcaagcctctggatgaccggttcgccagcgcgctcacagccctgaacgatatggggaaagtgagaaaggacattcagcagtgggagccctcccgcggatggaatgattggacccaagtgcccttttgctctcatcacttccacgaactgatcatgaaagacggccgggttctcgtggtcccttgtagaaaccaggatgagctgattgggcgcgctcggatcagccagggagccggctggtcccttagagaaacagcttgcctggggaagtcttatgcccagatgtggagcctcatgtactttcatcgccgggacctgagacttgcggccaatgctatttgttccgccgtgccgagccactgggttcccacctctcgcacaacctggtccatccatgctacgcacgagtggatgacaaccgaggatatgctgaccgtgtggaaccgggtctggatccaagaaaatccttggatggaggacaagacacccgtggaaagctgggaggaaattccttatctcggcaaaagagaggatcagtggtgcggatctctgatcggcctgacctcccgcgccacatgggctaagaacattcagacggccatcaatcaggtccggagcctcattgggaacgaggaatacaccgactacatgccctccatgaaaagattccggagagaggaagaggaagcgggagtgctgtggtga

SEQ ID NO: 20221 - RNA, 9876 nt, synthetic construct
  misc_feature 1..9876: note = derived and/or modified CDS sequence (opt5) from DENV-2__KC762672__SS-prME
  source 1..9876: mol_type = other RNA
accgccggaatcattatcatgatgattcccaccgtgatggctttccacctgacgaccagaaatggggaacctcatatgatcgtgagccggcaggaaaagggaaaatccctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctgggagaacaaagaactgaagtgcggatccggcatcttcatcacagataatgtgcacacctggacagagcagtataaatttcagcctgaatctcccagcaagctcgcttccgccattcaaaaggctcacgaggaagggatctgtggcattagatctgtcacgcgcctggagaaccttatgtggaaacagatcaccccggagctgaatcatattctcagcgaaaacgaggtgaagctgacaatcatgaccggagacatcaaaggcattatgcaggccgggaagcggtccctgagacctcagcccacagaacttaaatacagctggaaggcgtggggaaaagccaagatgctctctaccgagctgcacaatcatacgttcctgatcgatggccctgaaaccgctgagtgccccaacacaaatcgcgcctggaactccctcgaggttgaagactatgggtttggagtgttcaccacaaatatttggctgaaacttaaagagcggcaagatgtcttttgtgacagcaagctgatgtctgctgccatcaaagactccagagcggtgcacgccgatatgggctactggattgaaagcgctctcaacgacacctggaagatcgagaaagcctctttcatcgaggtcaagagctgccactggcctaagtcccatacactgtggagcaacggcgtcctggaatctgagatgattatccccaaaaatttcgctgggccggtttcccagcacaactatcgccctggataccatacccagacggccggcccctggcaccttgggcggctcgaaatggattttgacttctgtgagggaacaaccgtggtggtcaccgaagattgcggcaatagagggcccagcctgcggacaaccacggcctccggaaagctgattacagagtggtgctgtcgctcttgcaccctccctccgctgagataccggggcgaggacggctgttggtatgggatggaaatcagaccccttaaagagaaggaagagaacctggtgaatagcctcgttacagctggacatggccagattgataacttttccctgggggtgctgggaatggcgcttttcctcgaagagatgctgcgcacccgggtcggcacaaaacacgccatcctgctcgtggctgtttcttttgtgaccctgattacggggaatatgagcttcagagaccttggacgcgtcatggtgatggttggcgccaccatgacagatgacatcggcatgggggtgacctacctggccctcctggctgcctttaaggtcagacctacattcgcggctggactgcttctgcggaagctcacctccaaagagctgatgatgacgacaatcggcattgtgctcctgtctcaagccaccatccccgaaacaattcttgagctgaccgatgccctcgctctggggatgatggtgctgaagatcgtccgcaacatggaaaaatatcagcttgccgttaccattatggcgatcctgtgcgtgcctaatgctgtgatcctccagaacgcctggaaggtcagctgtacaacgctggccgtggtttccgtgagccccctcctgcttacctcttcccaacagaaagctgactggattcctctggccctcacaatcaagggactgaatcccaccgctatttttctgacaacccttagcagaacgtctaagaaacggtcctggccgctgaacgaggccatcatggcggtcggcatggtgagcattctcgcctcttccctgctcaagaatgatatccctatgacagggcccctggttgctggaggccttctgaccgtgtgctacgtcctgaccggccgcagcgccgacctcgaactggagagagctgccgacgtgcggtgggaggaacaggccgagatctccgggagctctcctattcttagcatcacaatttccgaagatggatctatgagcatcaaaaacgaggaggaagaacagaccctgacaattctcatccgcacgggcctgctcgtcatttccgggctgttccccgtgtctatcccgatcaccgctgcggcctggtatctttgggaagttaagaaacaaagagctggagtgctgtgggacgtcccttctccccctcccgtgggcaaggccgagctggaagatggggcctaccggattaaacagaagggaatcctcggctattcccagattggcgctggggtttacaaggagggaacatttcacaccatgtggcatgtgacacgcggcgccgtcctgatgcacaaagggaagagaatcgagccctcctgggcggacgtgaaaaaggatcttattagctacggaggcgggtggaaactggaaggagagtggaaggaaggcgaggaagtgcaggttctcgctctggagcctggcaagaatccgcgggccgtccaaaccaaacccggactcttcaagacgaacaccggaacaatcggcgccgtgtccctggactttagccctgggacctctggatcccccatcgtggataaaaagggcaaagtcgtggggctttatggaaacggcgttgtgacaagaagcggcacctacgtctctgctattgcccagacagagaagtccatcgaagacaatcctgagattgaagatgacatcttccgcaagaaacggctgacgattatggatctgcatcccggggcgggaaagaccaaaagatatctccctgctatcgtgcgcgaggccatcaagcggggcctgagaacacttattctggccccgacccgcgttgtggctgccgaaatggaggaggctctccgggggctgcccatcagataccagacccctgccattcgcgcggaacacacaggacgggagatcgtcgacctcatgtgtcatgccacgttcaccatgagactgcttagccccattcgggtgcctaactataatctgatcattatggatgaagctcactttacagaccccgcctccatcgctgcccgcggctacatctctaccagagttgagatgggggaggccgctggcattttcatgacagcgaccccgcctggaagccgggacccctttccccagtccaacgcccctatcatggatgaagaacgcgaaattcccgagagaagctggaactctggccacgaatgggtgacggacttcaaagggaagacagtctggtttgtgccttccatcaaggctggaaacgatattgccgcctgcctgcggaaaaatggcaagaaagtgatccaactcagcagaaagaccttcgactttgagtatatcaaaacccgcacaaacgattgggacttcgtcgttaccacagatatttctgagatgggggctaattttaaggccgaacgggtgatcgacccgagacgctgtatgaagcccgtgattctgaccgatggagaggaacgggtcatccttgcgggccctatgcccgtgacgcatagctccgctgcccagagacgcgggcgggttggcagaaaccctaaaaatgagaacgaccagtacatttacatgggagaacccctggagaatgatgaggactgcgcccactggaaggaagctaaaatgctcctggacaacatcaatacaccggagggcatcattccttctatgttcgaacccgagcgcgaaaaggtggatgccatcgacggggagtatagactgcggggagaggcgcgcaaaacctttgtcgatctcatgagacggggcgaccttcctgtgtggctggcctaccgcgttgctgccgaagggattaactatgctgatagacggtggtgtttcgacggagtgaagaacaatcaaatcctggaggaaaacgtcgaggtggagatttggacaaaagaaggcgagagaaagaagctcaaaccccgctggctggatgcccggatctacagcgaccctcttgctctgaaggagttcaaagagtttgccgcggggagaaagtccctcaccctgaatctgattacggaaatgggccgcctccccaccttcatgacacagaaagcccggaacgctcttgataatctggccgtcctgcataccgctgaggccggaggcagagcctataaccacgctctctctgagctgccggaaacacttgagaccctgctcctgctgacactccttgcgaccgtgacaggcgggatctttctgttcctgatgagcgggaaggggatcggaaagatgacactcggcatgtgctgcattatcaccgcctccattctgctttggtacgctcagatccagcctcactggattgccgccagcatcatcctggaatttttcctcattgttctgctgatccccgagcccgaaaaacaacggacccctcaggacaatcagctcacatatgtggtgattgctatccttaccgtcgttgccgcgacaatggccaacgagatgggctttctggagaagacgaaaaaggatttcgggctgggatctattaccacacagcaaccggaatccaatatcctcgacatcgatctgcgccccgctagcgcctggaccctttacgctgtggccacaacctttattacgcctatgctgagacattccatcgagaactctagcgtgaatgtctccctcaccgcgattgccaaccaggctacagtgctgatgggcctggggaaaggatggcccctctctaagatggacatcggcgttcctcttctggccattgggtgttacagccaggtgaatcccatcaccctgacagctgccctcctgcttctggtcgctcactatgccattatcggacctggcctccaggcgaaggccacccgggaagctcaaaaacgcgccgctgccggcatcatgaagaacccgacggtggacgggattacagtcatcgatctggaccccattccttacgatcccaaattcgagaagcagctgggacaggtgatgctccttgttctgtgcgtgacccaggtcctgatgatgagaacaacctgggccctctgtgaagcgctgacccttgctacaggccctatctccacgctgtgggaggggaatcccggacggttttggaacaccacaattgccgtgagcatggctaatatcttccgcggctcttatctcgccggggccggactgctgttttccatcatgaaaaacaccgctaacacaagacggggcaccggcaatgccggggagacgctcggagaaaagtggaagaaccgccttaatgcgctgggcaaaagcgagttccaaatttacaagaaatctgggatccaggaagttgacagaacactggccaaggagggaattaaacggggcgagaccgatcatcacgctgtgtccagagggagcgccaagctccgctggttcgtcgaacggaacctggtgaccccggagggaaaagtggttgaccttggctgcggcagagggggatggtcttattactgtggcgggctgaagaatgtcaaggaagtgaaaggactcacaaagggcgggcctggacatgaggaacccatccccatgagcacctatggctggaacctggtgcgcctgcagtccggcgtcgatgtctttttcacacctcccgagaaatgcgacacgctcctttgtgatattggggagtctagccctaatccgaccgtggaagctggacggacactgagagtgctgaacctcgtcgagaattggctgaacaataacacccaattttgcatcaaggtgcttaatccctacatgccttccgttatcgagaagatggaggccctgcagcgcaagtacggcggggcgctcgtgcggaaccccctgagcagaaattccacacacgaaatgtattgggtctctaacgccagcggaaacattgtgtcctctgttaatatgatcagccgcatgctgattaaccggttcaccatgagacacaagaaagctacgtacgagcctgacgtggatctcggctccgggacccgcaatatcggaattgagtctgaaacacccaaccttgacatcatcggcaagcggattgagaaaatcaagcaggaacatgagaccagctggcactatgatcaggaccatccgtacaaaacatgggcctatcacggctcctacgaaaccaagcaaacagggagcgcttcttccatggtcaatggagtggtgagactgctgaccaagccttgggacgtcattcccatggttacgcagatggccatgacagataccaccccttttggccagcagcgcgtgttcaaagagaaggtggacacaagaacgcaagagcccaaagaagggaccaagaaactcatgaagatcacagctgagtggctgtggaaggaacttggcaaaaagaaaacccctcggatgtgtacacgcgaggagtttgccagaaaggtccggagcaacgcggccctgggcgctattttcaccgatgaaaataaatggaagtctgccagagaggctgtggaagactccgggttttgggagctcgttgataaagaacggaacctgcacctggagggaaagtgcgagacatgtgtgtataatatgatgggcaagcgcgagaaaaagctcggcgagttcgggaaagccaagggaagcagagccatctggtacatgtggctgggcgcgcggtttcttgagttcgaggctctggggtttctcaacgaagaccattggttctctcgcgaaaatagcctgagcggagtcgagggcgaagggcttcacaaactgggctacattctcagagatgtgtccatgaaggagggaggcgccatgtatgccgacgataccgctgggtgggacacgcggatcaccctggaagatctgaagaacgaggaaatggttacaaatcatatggagggagagcacaaaaagctcgccgaagctatcttcaaactgacctaccagaacaaggtggtccgcgtgcagagacccacaccgcggggcaccgttatggacattatcagccgcagagaccagcgggggtctggacaagtggtcacgtatggccttaatacatttaccaacatggaggcccagctgattcgccagatggaaggggagggcgtgttcaaaagcatccaacagctcacagtcaccgaggaaattgcggtgaagaactggctggttagagtgggacgggagcgcctttccagaatggccatctctggcgatgactgcgtcgtgaagcctctggatgaccggtttgctagcgccctcacggctctgaatgatatggggaaagtgagaaaggacatccagcagtgggaaccctcccgcggatggaacgattggacccaagttcccttctgctctcatcactttcacgagctgattatgaaagacggccgggtgctcgtcgtgccttgtagaaatcaggatgaactgatcgggcgcgcccggattagccagggagcgggctggtcccttagagagacagcctgcctggggaagtcttacgctcagatgtggagcctcatgtatttccatcgccgggacctgagacttgccgctaacgccatctgttccgctgttccgagccactgggtgcccacctctcgcacaacctggtccattcatgccacacacgagtggatgaccacggaagatatgctgacagtctggaatcgggtgtggatccaagagaacccttggatggaagacaaaacccccgtcgagagctgggaagagatcccttacctcggcaagagagaggatcagtggtgcggatctctgattggcctgacctcccgcgcgacatgggccaagaatatccagaccgctattaaccaggtgcggagcctcatcgggaatgaagagtatacagactacatgccctccatgaaaagatttcggagagaagaggaagaggccggagttctgtggtga

SEQ ID NO: 20222 - RNA, 9876 nt, synthetic construct
  misc_feature 1..9876: note = derived and/or modified CDS sequence (opt5) from DENV-2__KC762667__SS-prME
  source 1..9876: mol_type = other RNA
acagccggaatcattatcatgatgattcccacagtgatggctttccacctgacgaccagaaacggggagcctcatatgatcgtgagccggcaggaaaaggggaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcatggatctggaaaagcgccacgtgctcggacggctgattaccgtcaatcctatcgtgacagagaaagactctccggttaacattgaagccgagcccccttttggcgattcctacatcattatcggggtggaacccggccagctgaagctcagctggttcaaaaagggatctagcattggccagatgtttgagaccacaatgagaggggctaagcgcatggccatcctgggagacaccgcctgggatttcggctcccttgggggagtctttacgtctatcggcaaagctctgcatcaagtgttcggggccatttatggcgcggcttttagcggagtgtcctggacaatgaagatcctcattggcgttgtcatcacctggattgggatgaatagccggtctacctccctgagcgtgtctctggtgcttgtcggagtggttacactctacctgggcgtgatggtccaggccgactccgggtgtgtggttagctggaaaaacaaggagctgaaatgcggatccggcatcttcatcaccgataatgtgcacacatggacggaacagtataagtttcagcctgagtctcccagcaagctcgcctccgctattcaaaaagcccacgaagaggggatctgtggcattagatctgtcacccgcctggaaaaccttatgtggaagcagatcacaccggagctgaatcatattctcagcgagaacgaagtgaaactgaccatcatgacaggagacatcaagggcattatgcaggctgggaaacggtccctgagacctcagcccaccgagcttaagtacagctggaaaacgtggggaaaggccaagatgctctctaccgaactgcacaatcatacattcctgatcgatggccctgagaccgcggaatgccccaacgccaatcgcgcttggaactccctcgaggttgaggactatgggtttggagtgttcacaaccaatatttggctgaaacttaaggaacggcaagatgccttttgtgacagcaaactgatgtctgctgccatcaaggacaacagagcggtccacgccgatatgggctactggattgagtccgctctcaacgacacatggaaaatcgaaaaggccagcttcatcgaggtgaagtcttgccactggcctaaaagccataccctgtggtccaatggcgtgctggagagcgaaatgattatccccaagaacttcgctgggccggtctctcagcacaattatcgccctggataccatacgcagacagccggcccctggcaccttgggcggctcgagatggattttgacttctgtgaaggaaccaccgttgtggtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtcaactctctcgtgaccgctggacatggccagattgataattttagcctgggggttctgggaatggcgcttttcctcgaggaaatgctgcgcacacgggtgggcaccaagcacgccatcctgctcgtcgctgtgtcctttgttacgctgattaccgggaacatgtctttcagagaccttggacgcgtgatggtcatggtgggcgccacaatgaccgatgacatcggcatgggggttacatacctggccctcctggctgcctttaaggtgagacctaccttcgcggctggactgcttctgcggaaactcacgagcaaggagctgatgatgacaaccatcggcgtcacactcctgtcccaatctaccattcccgagaccatccttgaactgacagatgccctcgccctggggatgatggtgctgaaaattgtgcgcaatatggagaagtatcagcttgctgtcacgatcatggccattctgtgcgttcctaacgcggtgatcctccagaatgcttggaaagtgagctgtaccacactggccgtcgtgtccgttagccccctcctgcttacctcttcccaacagaaggccgactggatccctctggctctcacaattaagggactgaaccccaccgccatctttctgacgacacttagcagaacctctaaaaagcggtcctggccgctgaatgaagctattatggccgtgggcatggtcagcatcctcgcgtcttccctgctcaaaaacgatattcctatgaccgggcccctggtggccggaggccttctgacagtttgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagacgctgaccatcctcattcgcacaggcctgctcgtgatctccgggctgttccccgtctctattccgatcaccgccgctgcgtggtatctttgggaggtgaaaaagcaaagagccggagttctgtgggacgtgccttctccccctcccgtcggcaaagctgaactggaggatggggcctaccggatcaagcagaagggcattctcggctattcccagatcggcgccggggtgtacaaagaaggaacatttcacaccatgtggcatgttacgcgcggcgctgtgctgatgcacaaggggaaaagaattgagccctcctgggccgacgtcaagaaagatcttatcagctacggaggcgggtggaagctggagggagaatggaaggagggcgaagaggtccaggtgctcgcgctggaacctggcaaaaacccgcgggctgttcaaaccaagcccggactcttcaaaacatccaccggaacaattggcgccgtcagcctggacttttctcctgggacctccggaagccccatcgtggataagaaaggcaaggtggtcgggctttatggaaacggcgtggttacaagatctggcacgtacgtgtccgccatcgctcagaccgaaaagagcattgaggacaatcctgaaatcgaggatgacattttccgcaaaaagcggctgacaatcatggatctgcatcccggggccggaaaaaccaagagatatctccctgcgattgtccgcgaagctatcaaacggggcctgagaacccttatcctggccccgacacgcgtggttgccgctgagatggaagaggccctccgggggctgcccattagataccagacgcctgctatccgcgccgagcacaccggacgggaaattgtggacctcatgtgtcatgcgacattcaccatgagactgctttcccccatccgggtccctaactataatctgattatcatggatgaggcccactttacagaccccgcttctattgccgctcgcggctacatcagcaccagagtggaaatgggggaggccgccggcatcttcatgacggctacaccgcctggatcccgggacccctttccccagagcaacgcgcctattatggatgaggaacgcgagatccccgaaagatcttggaatagcggccacgagtgggttaccgacttcaaggggaagaccgtgtggtttgtccctagcattaaagccggaaacgatatcgctgcctgcctgcggaagaatggcaaaaaggtgattcaactctctagaaaaacattcgactttgaatatatcaagacccgcacaaacgattgggacttcgtggtcaccacggatatcagcgagatgggggccaattttaaggctgagcgggttattgacccgagacgctgtatgaaacccgtgatcctgacagatggagaagaacgggtgattcttgccggccctatgcccgtcacccattcctctgcggctcagagacgcgggcgggtgggcagaaaccctaagaatgaaaacgaccagtacatctacatgggagagcccctggaaaatgatgaggactgcgcccactggaaagaggccaagatgctcctggacaacattaatacaccggaaggcatcatccctagcatgttcgagcccgaacgcgagaaagttgatgctattgacggggaatatagactgcggggagaggcccgcaagacctttgtggatctcatgagacggggcgaccttcctgtctggctggcgtaccgcgtggccgctgaggggatcaactatgccgatagacggtggtgtttcgacggagttaaaaacaatcaaattctggaagagaacgtggaagtcgagatctggacgaaggagggcgaaagaaagaaactcaagccccgctggctggatgctcggatttactccgaccctcttgccctgaaagagttcaaggaatttgctgccgggagaaaatctctcaccctgaatctgatcacagagatgggccgcctccccaccttcatgacacagaaggcgcggaacgcccttgataatctggctgtgctgcataccgccgaagctggaggcagagcctataaccacgccctcagcgagctgccggagacacttgaaaccctgctcctgctgacgctccttgctacagtcaccgggggaatttttctgttcctgatgtccggcaaggggatcggaaaaatgaccctcggcatgtgctgcatcattacagcgagcatcctgctttggtacgcccagattcagcctcactggatcgctgcctctattatcctggagtttttcctcatcgtgctgctgattcccgaacccgagaagcaacggacccctcaggacaatcagctcacatatgttgtgatcgccattcttacggtggtcgctgccaccatggcgaacgaaatgggctttctggagaaaacaaagaaagatttcgggctgggatccatcaccacacagcaaccggagagcaatattctcgacatcgatctgcgccccgcctccgcttggaccctttacgccgttgctacgacctttatcacacctatgctgagacattctattgaaaacagctccgtgaatgtgtctctcaccgccatcgcgaaccaggccacagtcctgatgggcctggggaagggatggcccctcagcaagatggacattggcgtgcctcttctggctatcgggtgttactcccaggttaatcccattaccctgacggccgctctcctgcttctggtggcccactatgctatcattggacctggcctccaggccaaagcgacacgggaggcccaaaagcgcgctgccgctggcatcatgaaaaacccgaccgtcgacgggatcacagtgattgatctggaccccatcccttacgatcccaagttcgaaaaacagctgggacaggtcatgctccttgtgctgtgcgttacccaggtgctgatgatgagaaccacatgggccctctgtgaggccctgacgcttgcgaccggccctattagcacactgtgggaagggaatcccggacggttttggaacaccacaatcgctgtctctatggccaatattttccgcggctcctatctcgctggggccggactgctgtttagcatcatgaagaacaccgccaacacgagacggggcacaggcaataccggggagaccctcggagagaagtggaaaaaccgccttaatgctctgggcaagtctgagttccaaatctacaaaaagtccgggattcaggaggtggacagaacactggccaaagaaggaatcaagcggggcgagaccgatcatcacgcggttagcagagggtctgccaaactccgctggttcgtggagcggaacctggtcacaccggaaggaaaggtggtggaccttggctgcggcagagggggatggagctattactgtggcgggctgaagaatgttaaagaggtcaagggactcacgaaaggcgggcctggacatgaggaacccattcccatgtccacctatggctggaacctggtgcgcctgcagtctggcgtggatgtctttttcacacctcccgaaaagtgcgacaccctcctttgtgatatcggggagagctcccctaatccgacagttgaggctggacggaccctgagagtgctgaacctcgtggaaaattggctgaacaataacacgcaattttgcattaaagtccttaatccctacatgcctagcgtgatcgagaagatggaagccctgcagcgcaagtacggcggggctctcgttcggaaccccctgtccagaaattctacccacgagatgtattgggtgagcaacgcctccggaaacatcgtctctagcgtgaatatgatttcccgcatgctgatcaaccggttcacaatgagacacaaaaaggcgacctacgaacctgacgttgatctcggctctgggacacgcaatattggaatcgagagcgagacccccaaccttgacattatcggcaaacggatcgaaaagattaaaagagagcatgaaacatcctggcactatgatcaggaccatccgtacaagacctgggcctatcacggcagctacgagacgaagcagacagggtctgcttccagcatggtgaatggagtcgtgcgcctgctgaccaaaccttgggacgtgatccccatggtcacccaaatggccatgacagatacgaccccttttggccagcagagagttttcaaggaaaaagtggacacacggacccaggagcccaaggaggggaccaaaaagctcatgaagattaccgctgaatggctgtggaaagagcttggaaagaaaaagacacctcgcatgtgtaccagagaagagtttacgcggaaagtgagatctaacgccgctctgggcgccatcttcaccgatgagaataagtggaaatccgcgcgggaagccgtcgaggacagcgggttttgggaactcgtggataaggagcgcaacctgcacctggaaggaaagtgcgagacatgtgtttataatatgatgggcaaaagagagaagaaactcggcgagttcgggaaggctaaaggatctcgggccatttggtacatgtggctgggcgctcgctttcttgagttcgaagccctggggtttctcaacgaggaccattggttctccagagaaaatagcctgtccggagtggagggcgaggggcttcacaagctgggctacatcctccgggatgtcagcaagaaagaaggaggcgccatgtatgcggacgataccgctgggtgggacacacgcattaccctggaggatctgaagaacgaagagatggtgacgaatcatatggaaggagagcacaaaaagctcgccgaggccatcttcaaactgacataccaaaacaaggttgtgagagtccagcggcccaccccgcgcggcacagtgatggacatcatttctagacgggaccagcgcgggagcggacaggttgtgacctatggccttaatacgtttaccaacatggaagctcaactgatcagacagatggagggggaaggcgtcttcaagtccattcagcatctcacagtgaccgaggagatcgccgtcaaaaactggctggtgcgggttggacgcgaaagactttctcggatggctattagcggcgatgactgcgtggtcaagcctctggatgacagatttgcctccgcgctcacagccctgaatgatatggggaaagtgcgcaaggacatccaacagtgggagccctctcggggatggaacgattggacccaggtgcccttctgcagccaccactttcatgaactgatcatgaaagacggcagagttctcgtggtcccttgtcgcaatcaggatgagctgattgggcgggctagaatctcccaaggagccggctggtctcttcgcgaaacagcttgcctgggaaagagctacgcccagatgtggtccctcatgtatttccaccggagagacctgcgccttgcggccaacgctatttgtagcgccgtgccgtctcattgggttcccacctcccggacgacatggagcatccacgctacccacgagtggatgaccacagaggatatgctgaccgtgtggaatagagtctggattcaggaaaacccttggatggaggacaagacacccgtggaatcttgggaggaaatcccttacctcggcaaacgcgaggatcagtggtgcggatccctgatcggcctgacgagccgggccacctgggctaagaatattcaaacagccatcaaccaggtcagatccctcattgggaatgaggaatataccgactacatgccctctatgaaacggtttagacgcgaggaagaggaagcgggagtgctgtggtga

SEQ ID NO: 20223 - RNA, 9876 nt, synthetic construct
  misc_feature 1..9876: note = derived and/or modified CDS sequence (opt5) from DENV-2__KC762659__SS-prME
  source 1..9876: mol_type = other RNA
accgccggcatcattatcatgatgattcccacagtgatggctttccacctgacgaccagaaatggggaacctcatatgatcgtcagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaaggtggtgcagcctgaaaacctggagtataccattgtcatcacaccccactctggcgaagagaatgcggtggggaacgataccggaaaacatggcaaggagattaaagttacacctcagtccagcatcaccgaagccgagctcacgggctacgggaccgtgacaatggaatgttctccccggaccggactggacttcaatgagatggtccttctgcagatggaaaacaaggcttggctcgtgcaccgccaatggtttctggatcttccgctgccttggctccccggcgccgacacacaggggtccaactggatccagaaagagaccctggttacgttcaagaatcctcacgctaagaaacaggatgtggtcgtgctgggaagccaagagggcgccatgcatacagccctcaccggggctacagaaattcagatgtcctctggcaacctgctttttaccggacacctgaagtgcagactccggatggacaaactgcagcttaagggcatgagctattccatgtgtaccgggaaattcaaggtcgtgaaggagatcgcggaaacacaacatggaacgattgttatcagagtgcagtacgagggcgacgggagcccctgcaaaattcccttcgagatcatggatctggaaaagcgccacgtcctcggacggctgatcaccgtgaatcctattgttacagagaaagactctccggtgaacatcgaagccgagcccccttttggcgattcctacattatcattggggtcgaacccggccagctgaagctcagctggttcaaaaagggatctagcatcggccagatgtttgagaccacaatgagaggggctaagcgcatggccattctgggagacaccgcctgggatttcggctcccttgggggagtgtttacgtctatcggcaaagctctgcatcaagtgttcggggccatctatggcgcggcttttagcggagtttcctggacaatgaagattctcatcggcgtcgtgattacctggatcgggatgaatagccggtctacctccctgagcgtgtctctggtccttgtgggagttgtgacactctacctgggcgtcatggtgcaggccgactccgggtgtgttgtgagctggaaaaacaaggagctgaaatgcggatccggcattttcatcaccgataatgtccacacatggacggaacagtataagtttcagcctgagtctcccagcaagctcgcctccgctatccaaaaagcccacgaagaggggatttgtggcatcagatctgtgacccgcctggaaaaccttatgtggaagcagattacaccggagctgaatcatatcctcagcgagaacgaagttaaactgaccattatgacaggagacatcaagggcatcatgcaggctgggaaacggtccctgagacctcagcccaccgagcttaagtacagctggaaaacgtggggaaaggccaagatgctctctaccgaactgcacaatcatacattcctgattgatggccctgagaccgcggaatgccccaacacaaatcgcgcctggaactccctcgaggtggaggactatgggtttggagtcttcaccacaaatatctggctgaaacttaaggaacggcaagatgtgttttgtgacagcaaactgatgtctgctgccattaaggacaacagagctgtgcacgccgatatgggctactggatggagtccgcgctcaacgacacctggaaaatcgaaaaggccagcttcattgaggtcaagtcttgccactggcctaaaagccatacgctgtggtccaatggcgttctggagagcgaaatgatcatccccaagaacttcgctgggccggtgtctcagcacaattatcgccctggataccatacacagaccgccggcccctggcaccttgggcggctcgagatggattttgacttctgtgaaggaaccacagtggtcgtgaccgaggattgcggcaacagagggccctccctgcggacgacaaccgctagcggaaaactgattacagaatggtgctgtcgctcctgcaccctccctccgctgagataccggggcgaggacggctgttggtatgggatggagatcagaccccttaaggaaaaagaggaaaatctggttaactctctcgtgacagccggacatggccagattgataattttagcctgggggtcctgggaatggcccttttcctcgaggaaatgctgcgcacccgggtgggcacgaagcacgctatcctgctcgttgcggtgtcctttgtcaccctgattacagggaacatgtctttcagagaccttggacgcgtgatggttatggtgggcgccaccatgacagatgacatcggcatgggggtcacctacctggctctcctggccgcctttaaggtgagacctacgttcgctgccggactgcttctgcggcgcctcacaagcaaagagctgatgatgaccacaattggcatcgtgctcctgtcccaatctaccatccccgagaccattcttgaactgacagatgcgctcgctctggggatgatggtcctgaagatcgttagaaaaatggagaagtatcagcttgccgtgacgattatggccatcctgtgcgtgcctaatgctgtcattctccagaacgcctggaaagtgagctgtaccacactggcggttgtgtccgtcagccccctcctgcttacctcttcccaacagaaggctgactggatccctctggccctcacaatcaagggactgaatcccaccgccatttttctgacgacacttagccggacctctaaaaagcgctcctggccgctgaacgaagctatcatggccgtgggcatggttagcattctcgcttcttccctgctcaaaaatgatatccctatgaccgggcccctggtggccggaggccttctgacagtctgctacgtgctgaccggcagaagcgcggacctcgagctggaacgggccgctgacgtccgctgggaggagcaggccgaaatttccgggagctctcctatccttagcatcacaatttccgaggatggatctatgagcatcaagaacgaagaggaggaacagacgctgaccattctcatcagaacaggcctgctcgtgatttccgggctgttccccgtttctatcccgattaccgctgccgcctggtatctttgggaggtgaaaaagcaacgggctggagtcctgtgggacgtgccttctccccctcccgttggcaaagcggaactggaggatggggcctaccgcatcaagcagaagggaatcctcggctattcccagattggcgctggggtgtacaaagaaggaacatttcacaccatgtggcatgtcacgagaggcgccgtgctgatgcacaaggggaaacggatcgagccctcctgggccgacgtgaagaaagatcttattagctacggaggcgggtggaagctggagggagaatggaaggagggcgaagaggttcaggtcctcgctctggaacctggcaaaaatccgagagccgtgcaaaccaagcccggactcttcaaaacaaacaccggaacaatcggcgcggtgtccctggactttagccctgggacctctggatcccccattgtcgataagaaaggcaaggtggttgggctttatggaaacggcgtggtcacacgcagcggcacgtacgtgtctgctatcgcccagaccgagaagtccatcgaggacaatcctgaaattgaggatgacatcttccggaaaaagagactgacaattatggatctgcatcccggggccggaaaaaccaagcgctatctccctgctatcgttcgggaagccattaaaagaggcctgcgcacccttatcctggcgccgacacgggtggtcgctgccgagatggaagaggccctcagagggctgcccatccgctaccagacgcctgctattcgggccgagcacaccggaagagaaatcgtggacctcatgtgtcatgctacattcaccatgcggctgcttagccccattcgcgttcctaactataatctgatcattatggatgaggcccactttacagaccccgcgtccatcgccgctagaggctacatttctacccgggtggaaatgggggaggccgctggcatcttcatgacggccacaccgcctggaagccgcgacccctttccccagtccaacgcccctatcatggatgaggaaagagagattcccgaacggagctggaactctggccacgagtgggtcaccgacttcaaggggaagaccgtgtggtttgtgccttccatcaaagctggaaacgatattgcggcctgcctgagaaagaatggcaaaaaggtcatccaactcagccgcaaaacattcgactttgaatatattaagacccggacaaacgattgggacttcgttgtgaccacggatatctctgagatgggggctaattttaaggccgagagagtgatcgacccgcgccggtgtatgaaacccgtcattctgacagatggagaagagagagtgatccttgccggccctatgcccgttacccatagctccgctgcccagcgccgggggagagtgggccgcaaccctaagaatgaaaacgaccagtacatttacatgggagagcccctggaaaatgatgaggactgcgcgcactggaaagaggctaagatgctcctggacaacatcaatacaccggaaggcattatcccttctatgttcgagcccgaaagagagaaagtcgatgccatcgacggggaatatcggctgcgcggagaggccagaaagacctttgtggatctcatgcggcgcggcgaccttcctgtttggctggcttacagagtggccgcggaggggattaactatgccgatcggagatggtgtttcgacggagtcaaaaacaatcaaatcctggaagagaacgtggaagtcgagatttggacgaaggagggcgaacgcaagaaactcaagccccggtggctggatgctagaatctacagcgaccctcttgccctgaaagagttcaaggaatttgctgccgggcgcaaatccctcaccctgaatctgattacagagatgggccggctccccaccttcatgacacagaaggctagaaacgcccttgataatctggcggtgctgcataccgccgaagctggaggccgggcctataaccacgctctctctgagctgccggagacacttgaaaccctgctcctgctgacgctccttgccacagttaccgggggaatctttctgttcctgatgagcggcaaggggattggaaaaatgaccctcggcatgtgctgcatcatcacagcctccattctgctttggtacgctcagatccagcctcactggattgcggccagcatcattctggagtttttcctcatcgtgctgctgatccccgaacccgagaagcaacgcacccctcaggacaatcagctcacatatgtggtcattgctatccttacggttgtggccgccaccatggctaacgaaatgggctttctggagaaaacaaagaaagatttcgggctgggatctattaccacacagcaatccgagagcaatatcctcgacattgatctgagaccggcctccgcgtggaccctttacgccgtggctacgacctttatcacacccatgctgcggcattctatcgaaaacagctccgtcaatgtgtctctcaccgccattgctaaccaggccacagttctgatgggcctggggaagggatggcctctcagcaagatggacatcggcgtgccccttctggcgattgggtgttactcccaggtcaatcctatcaccctgacggccgctctcctgcttctggtggcccactatgctattatcggacccggcctccaggccaaagctacacgcgaggcccaaaagagagcggccgctggcattatgaaaaaccctaccgtcgacgggatcacagtgatcgatctggacccgattccctacgatcctaagttcgaaaaacagctgggacaggttatgctccttgtgctgtgcgtcacccaggtgctgatgatgcggaccacatgggccctctgtgaggctctgacgcttgccaccggccccatcagcacactgtgggaagggaatcctggacgcttttggaacaccacaattgccgtttctatggcgaatatcttcagaggctcctatctcgctggggccggactgctgtttagcattatgaagaacaccgctaacacgcggcgcggcacaggcaataccggggagaccctcggagagaagtggaaaaacagacttaatgccctgggcaagtctgagttccaaatctacaaaaagtccgggatccaggaggtggaccggacactggccaaagaaggaattaagagaggcgagaccgatcatcacgctgtcagccgcgggtctgccaaactccggtggttcgtggagagaaacctggtgacacccgaaggaaaggttgtcgaccttggctgcggccgcgggggatggagctattactgtggcgggctgaagaatgtgaaagaggtgaagggactcacgaaaggcgggccgggacatgaagaacctatccccatgtccacctatggctggaacctggtccggctgcagtctggcgttgatgtgtttttcacaccccctgaaaagtgcgacaccctcctttgtgatattggggagagctcccccaatcctacagtggaggcgggaagaaccctgcgcgtcctgaacctcgtggaaaattggctgaacaataacacgcaattttgcatcaaagttcttaatccgtacatgcccagcgtgattgagaagatggaagccctgcagcggaagtacggcggggctctcgtcagaaaccctctgtcccgcaattctacccacgagatgtattgggtgagcaacgcctccggaaacatcgtttctagcgtgaatatgatctcccggatgctgattaacagattcacaatgcgccacaaaaaggctacctacgaacccgacgtcgatctcggctctgggacacggaatatcggaattgagagcgagacccctaaccttgacatcattggcaaaagaatcgaaaagatcaaacaggagcatgaaacatcctggcactatgatcaggaccatccctacaagacctgggcctatcacggcagctacgagacgaagcaaacagggtctgcgtccagcatggtgaatggagtggtccgcctgctgaccaaaccgtgggacgttattcctatggtgacccagatggccatgacagatacgaccccctttggccagcagagagtgttcaaggaaaaagtcgacacacggacccaagagcctaaggaggggaccaaaaagctcatgaagatcaccgctgaatggctgtggaaagagcttggaaagaaaaagacaccccgcatgtgtaccagagaagagtttacgcggaaagtgagatctaacgccgctctgggcgccattttcaccgatgagaataagtggaaatccgctcgggaagccgttgaggacagcgggttttgggaactcgtggataaggagcgcaacctgcacctggaaggaaagtgcgagacatgtgtctataatatgatgggcaaaagagagaagaaactcggcgagttcgggaaggcgaaaggatctcgggccatctggtacatgtggctgggcgctcgctttcttgagttcgaagccctggggtttctcaacgaggaccattggttctccagagaaaatagcctgtccggagtggagggcgaggggcttcacaagctgggctacattctccgggatgttagcaagaaagaaggaggcgctatgtatgccgacgataccgccgggtgggacacacgcatcaccctggaggatctgaagaacgaagagatggtgacgaatcatatggaaggagagcacaaaaagctcgcggaggctattttcaaactgacataccagaacaaggtcgtgagagttcagcggcctacaccccgcggcacagtgatggacatcatctctagacgggaccagcgcgggagcggacaagtcgtgacctatggccttaatacgtttaccaacatggaagcccagctgattagacagatggagggggaaggcgtcttcaagtccatccaacagctcacagccaccgaggagattgctgtgaaaaactggctggttcgggtgggacgcgaaagactttctcggatggccatcagcggcgatgactgcgtcgtgaagccgctggatgacagatttgcttccgccctcacagcgctgaatgatatggggaaagtgcgcaaggacattcagcagtgggagccttctcggggatggaacgattggacccaagttcccttctgcagccatcactttcacgaactgatcatgaaagacggcagagtgctcgtcgtgccctgtcgcaatcaggatgagctgatcgggcgggccagaatttcccagggagctggctggtctcttcgcgaaacagcctgcctgggaaagagctacgctcagatgtggtccctcatgtatttccatcggagagacctgcgccttgccgcgaacgccatctgtagcgctgttccttctcactgggtgccgacctcccggacgacatggagcattcatgccacccacgagtggatgaccacagaggatatgctgaccgtctggaatagagtgtggatccaagaaaacccctggattgaggacaagacacctgtcgaatcttgggaggaaatcccctacctcggcaaacgcgaggatcagtggtgcggatccctgatcggcctgacgagccgggctacctgggccaagaatattcagacagctatcaaccaggtgagatccctcattgggaatgaggaatataccgactacatgccttctatgaaacggtttagacgcgaggaagaggaagccggagttctgtggtga

SEQ ID NO: 20224 - RNA, 9876 nt, synthetic construct
  misc_feature 1..9876: note = derived and/or modified CDS sequence (opt5) from DENV-2__KC762657__SS-prME
  source 1..9876: mol_type = other RNA
accgccggcatcattatcatgatgattcccacagtgatggtcttccacctgacgaccagaaatggggaacctcatatgatcgttagccggcaggaaaaggggaaaagcctcctgtttaagacagagaatggcgtgaacatgtgcacccttatggctatggacctgggggaactctgtgaggatacaattacctacaattgcccgctgcttcgccaaaacgaacccgaggacatcgattgttggtgcaattctacaagcacctgggtgacgtatgggacctgtacagccaccggcgagcacagacgggaaaaacgctccgtcgcgctggtgcctcatgttgggatgggactcgagacaagaaccgaaacgtggatgtctagcgagggcgcttggaagcacgcccagcggatcgagacatgggtgctgcgccatcccggcttcaccattatggccgctatcctggcctacacaattgggaccacctattttcagagagtcctcatcttcattctgcttacagctgtgacgccttccatgaccatgcggtgcatcggaatttctaaccgcgactttgttgaaggcgtgagcgggggatcctgggtcgatatcgtgctggagcacggcagctgtgtgacaaccatggccaaaaataagcccacactcgacttcgaactgatcaagaccgaggcgaaacaccctgccacgcttagaaagtactgcattgaagctaaactgacaaacaccaccacagcctctcggtgtccgacccagggggagccctccctcaatgaggaacaagataagcgctttgtctgcaaacatagcatggttgacagaggatggggcaacggctgtgggctgttcggaaagggcgggatcgtgacatgcgctatgtttacgtgcaagaaaaatatggagggaaaggtggtccagcctgaaaacctggagtataccattgtgatcacaccccactctggcgaagagaatgccgttgggaacgataccggaaaacatggcaaggagattaaagtgacacctcagtccagcatcaccgaagcggagctcacgggctacgggaccgtcacaatggaatgttctccccggaccggactggacttcaatgagatggtgcttctgcagatggaaaacaaggcctggctcgttcaccgccaatggtttctggatcttccgctgccttggctccccggcgctgacacacaggggtccaactggatccagaaagagaccctggtgacgttcaagaatcctcacgccaagaaacaggatgtcgtggtcctgggaagccaagagggcgctatgcatacagccctcaccggggccacagaaattcagatgtcctctggcaacctgctttttaccggacacctgaagtgcagactccggatggacaaactgcagcttaagggcatgagctattccatgtgtaccgggaaattcaaggtggttaaggagatcgctgaaacacaacatggaacgattgtgatcagagtccagtacgagggcgacgggagcccctgcaaaattcccttcgagatcatggatctggaaaagcgccacgtgctcggacggctgatcaccgttaatcctattgtgacagagaaagactctccggtcaacatcgaagcggagcccccttttggcgattcctacattatcattggggtggaacccggccagctgaagctcagctggttcaaaaagggatctagcatcggccagatgtttgagaccacaatgagaggggccaagcgcatggctattctgggagacaccgcctgggatttcggctcccttgggggagtgtttacgtctatcggcaaagccctgcatcaagttttcggggctatctatggcgccgcgtttagcggagtctcctggacaatgaagattctcatcggcgtggtgattacctggatcgggatgaatagccggtctacctccctgagcgtctctctggtgcttgttggagtggtcacactctacctgggcgtgatggttcaggctgactccgggtgtgtggtcagctggaaaaacaaggagctgaaatgcggatccggcattttcatcaccgataatgtgcacacatggacggaacagtataagtttcagcctgagtctcccagcaagctcgcctccgccatccaaaaagctcacgaagaggggatttgtggcatcagatctgttacccgcctggaaaaccttatgtggaagcagattacaccggagctgaatcatatcctcagcgagaacgaagtgaaactgaccattatgacaggagacatcaagggcatcatgcaggccgggaaacggtccctgagacctcagcccaccgagcttaagtacagctggaaaacgtggggaaaggctaagatgctctctaccgaactgcacaatcatacattcctgattgatggccctgagaccgccgaatgccccaacacaaatcgcgcgtggaactccctcgaggtcgaggactatgggtttggagtgttcaccacaaatatctggctgaaacttaaggaacggcaagatgtgttttgtgacagcaaactgatgtctgccgctattaaggacaacagagccgtccacgctgatatgggctactggatggagtccgccctcaacgacacctggaaaatcgaaaaggcgagcttcattgaggttaagtcttgccactggcctaaaagccatacgctgtggtccaatggcgtgctggagagcgaaatgatcatccccaagaacttcgccgggccggtgtctcagcacaattatcgccctggataccatacacagaccgctggcccctggcaccttgggcggctcgagatggattttgacttctgtgaaggaaccacagtcgtggttaccgaggattgcggcaacagagggccctccctgcggacgacaaccgccagcggaaaactgattacagaatggtgctgtcgctcctgcaccctccctccgctgagataccggggcgaggacggctgttggtatgggatggagatcagaccccttaaggaaaaagaggaaaatctggtgaactctctcgtcacagctggacatggccagattgataattttagcctgggggtgctgggaatggcccttttcctcgaggaaatgctgcgcacccgggttggcacgaagcacgccatcctgctcgtggctgtctcctttgtgaccctgattacagggaacatgtctttcagagaccttggacgcgttatggtgatggtcggcgcgaccatgacagatgacatcggcatgggggtgacctacctggccctcctggctgcctttaaggtgagacctacgttcgccgctggactgcttctgcggcgcctcacaagcaaagagctgatgatgaccacaattggcatcgtcctcctgtcccaatctaccatccccgagaccattcttgaactgacagatgccctcgcgctggggatgatggttctgaagatcgtgagaaaaatggagaagtatcagcttgctgtgacgattatggccatcctgtgcgtccctaatgccgtgattctccagaacgcttggaaagttagctgtaccacactggccgtggtctccgtgagccccctcctgcttacctcttcccaacagaaggcggactggatccctctggctctcacaatcaagggactgaatcccaccgccatttttctgacgacacttagccggacctctaaaaagcgctcctggccgctgaacgaagccatcatggctgttggcatggtgagcattctcgcctcttccctgctcaaaaatgatatccctatgaccgggcccctggtcgctggaggccttctgacagtgtgctacgtcctgaccggcagaagcgccgacctcgagctggaacgggcggccgacgtgcgctgggaggagcaggctgaaatttccgggagctctcctatccttagcatcacaatttccgaggatggatctatgagcatcaagaacgaagaggaggaacagacgctgaccattctcatcagaacaggcctgctcgttatttccgggctgttccccgtgtctatcccgattaccgccgctgcctggtatctttgggaggtcaaaaagcaacgggccggagtgctgtgggacgttccttctccccctcccgtgggcaaagctgaactggaggatggggcgtaccgcatcaagcagaagggaatcctcggctattcccagattggcgccggggtctacaaagaaggaacatttcacaccatgtggcatgtgacgagaggcgctgtgctgatgcacaaggggaaacggatcgagccctcctgggccgacgttaagaaagatcttattagctacggaggcgggtggaagctggagggagaatggaaggagggcgaagaggtccaggtgctcgccctggaacctggcaaaaatccgagagctgtgcaaaccaagcccggactcttcaaaacaaacaccggaacaatcggcgccgtctccctggactttagccctgggacctctggatcccccattgtggataagaaaggcaaggttgtggggctttatggaaacggcgtcgtgacacgcagcggcacgtacgtttctgcgatcgctcagaccgagaagtccatcgaggacaatcctgaaattgaggatgacatcttccggaaaaagagactgacaattatggatctgcatcccggggccggaaaaaccaagcgctatctccctgccatcgtgcgggaagctattaaaagaggcctgcgcacccttatcctggccccgacacgggtcgtggcggctgagatggaagaggccctcagagggctgcccatccgctaccagacgcctgccattcgggctgagcacaccggaagagaaatcgttgacctcatgtgtcatgccacattcaccatgcggctgcttagccccattcgcgtgcctaactataatctgatcattatggatgaggctcactttacagaccccgcctccatcgcggccagaggctacatttctacccgggtcgaaatgggggaggctgccggcatcttcatgacggctacaccgcctggaagccgcgacccctttccccagtccaacgcccctatcatggatgaggaaagagagattcccgaacggagctggaactctggccacgagtgggtgaccgacttcaaggggaagaccgtgtggtttgtcccttccatcaaagccggaaacgatattgctgcgtgcctgagaaagaatggcaaaaaggttatccaactcagccgcaaaacattcgactttgaatatattaagacccggacaaacgattgggacttcgtggtgaccacggatatctctgagatgggggccaattttaaggctgagagagtcatcgacccgcgccggtgtatgaaacccgtgattctgacagatggagaagagagagttatccttgccggccctatgcccgtgacccatagctccgccgctcagcgccgggggagagtcggccgcaaccctaagaatgaaaacgaccagtacatttacatgggagagcccctggaaaatgatgaggactgcgcccactggaaagaggcgaagatgctcctggacaacatcaatacaccggaaggcattatcccttctatgttcgagcccgaaagagagaaagtggatgctatcgacggggaatatcggctgcgcggagaggccagaaagacctttgttgatctcatgcggcgcggcgaccttcctgtgtggctggcctacagagtcgctgccgaggggattaactatgcggatcggagatggtgtttcgacggagtgaaaaacaatcaaatcctggaagagaacgtcgaagtggagatttggacgaaggagggcgaacgcaagaaactcaagccccggtggctggatgccagaatctacagcgaccctcttgctctgaaagagttcaaggaatttgccgctgggcgcaaatccctcaccctgaatctgattacagagatgggccggctccccaccttcatgacacagaaggccagaaacgctcttgataatctggccgttctgcataccgcggaagccggaggccgggcttataaccacgccctctctgagctgccggagacacttgaaaccctgctcctgctgacgctccttgctacagtgaccgggggaatctttctgttcctgatgagcggcaaggggattggaaaaatgaccctcggcatgtgctgcatcatcacagcctccattctgctttggtacgcccagatccagcctcactggattgctgcgagcatcattctggagtttttcctcatcgtgctgctgatccccgaacccgagaagcaacgcacccctcaggacaatcagctcacatatgtcgttattgccatccttacggtggtggctgccaccatggccaacgaaatgggctttctggagaaaacaaagaaagatttcgggctgggatctattaccacacagcaatccgagagcaatatcctcgacattgatctgagaccggcttccgcctggaccctttacgcggtcgccacgacctttatcacacccatgctgcggcattctatcgaaaacagctccgtgaatgtttctctcaccgctattgccaaccaggctacagtgctgatgggcctggggaagggatggcctctcagcaagatggacatcggcgtcccccttctggccattgggtgttactcccaggtgaatcctatcaccctgacggcggccctcctgcttctggtcgctcactatgccattatcggacccggcctccaggctaaagccacacgcgaggctcaaaagagagccgcggccggcattatgaaaaaccctaccgtggacgggatcacagttatcgatctggacccgattccctacgatcctaagttcgaaaaacagctgggacaggtgatgctccttgtcctgtgcgtgacccaggttctgatgatgcggaccacatgggctctctgtgaggccctgacgcttgctaccggccccatcagcacactgtgggaagggaatcctggacgcttttggaacaccacaattgccgtgtctatggccaatatcttcagaggctcctatctcgcgggggctggactgctgtttagcattatgaagaacaccgccaacacgcggcgcggcacaggcaataccggggagaccctcggagagaagtggaaaaacagacttaatgctctgggcaagtctgagttccaaatctacaaaaagtccgggatccaggaggtcgaccggacactggccaaagaaggaattaagagaggcgagaccgatcatcacgccgtgagccgcgggtctgctaaactccggtggttcgtggagagaaacctggttacacccgaaggaaaggtcgtggaccttggctgcggccgcgggggatggagctattactgtggcgggctgaagaatgtgaaagaggtcaagggactcacgaaaggcgggccgggacatgaagaacctatccccatgtccacctatggctggaacctggttcggctgcagtctggcgtggatgtgtttttcacaccccctgaaaagtgcgacaccctcctttgtgatattggggagagctcccccaatcctacagtcgaggccggaagaaccctgcgcgtgctgaacctcgttgaaaattggctgaacaataacacgcaattttgcatcaaagtgcttaatccgtacatgcccagcgtcattgagaagatggaagcgctgcagcggaagtacggcggggccctcgtgagaaaccctctgtcccgcaattctacccacgagatgtattgggttagcaacgcttccggaaacatcgtgtctagcgtcaatatgatctcccggatgctgattaacagattcacaatgcgccacaaaaaggccacctacgaacccgacgtggatctcggctctgggacacggaatatcggaattgagagcgagacccctaaccttgacatcattggcaaaagaatcgaaaagatcaaacaggagcatgaaacatcctggcactatgatcaggaccatccctacaagacctgggcttatcacggcagctacgagacgaagcaaacagggtctgcctccagcatggtgaatggagtcgttcgcctgctgaccaaaccgtgggacgtgattcctatggtgacccagatggcgatgacagatacgaccccctttggccagcagagagtcttcaaggaaaaagtggacacacggacccaagagcctaaggaggggaccaaaaagctcatgaagatcaccgccgaatggctgtggaaagagcttggaaagaaaaagacaccccgcatgtgtaccagagaagagtttacgcggaaagttagatctaacgctgccctgggcgctattttcaccgatgagaataagtggaaatccgcccgggaagctgtggaggacagcgggttttgggaactcgtcgataaggagcgcaacctgcacctggaaggaaagtgcgagacatgtgtgtataatatgatgggcaaaagagagaagaaactcggcgagttcgggaaggccaaaggatctcgggcgatctggtacatgtggctgggcgcccgctttcttgagttcgaagctctggggtttctcaacgaggaccattggttctccagagaaaatagcctgtccggagttgagggcgaggggcttcacaagctgggctacattctccgggatgtgagcaagaaagaaggaggcgccatgtatgctgacgataccgccgggtgggacacacgcatcaccctggaggatctgaagaacgaagagatggtcacgaatcatatggaaggagagcacaaaaagctcgccgaggcgattttcaaactgacataccagaacaaggtggttagagtgcagcggcctacaccccgcggcacagtcatggacatcatctctagacgggaccagcgcgggagcggacaagtggtcacctatggccttaatacgtttaccaacatggaagctcagctgattagacagatggagggggaaggcgtgttcaagtccatccaacatctcacagccaccgaggagattgccgttaaaaactggctggtgcgggtcggacgcgaaagactttctcggatggctatcagcggcgatgactgcgtggtgaagccgctggatgacagatttgcctccgctctcacagccctgaatgatatggggaaagttcgcaaggacattcagcagtgggagccttctcggggatggaacgattggacccaggtgcccttctgcagccaccactttcatgaactgatcatgaaagacggcagagtcctcgtggttccctgtcgcaatcaagatgagctgatcgggcgggcgagaatttcccagggagccggctggtctcttcgcgaaacagcttgcctgggaaagagctacgcccagatgtggtccctcatgtatttccaccggagagacctgcgccttgctgccaacgcgatctgtagcgccgtgccttctcattgggtcccgacctcccggacgacatggagcattcacgctacccacgagtggatgaccacagaggatatgctgaccgtgtggaatagagtctggatccaggaaaacccctggattgaggacaagacacctgtggaatcttgggaggaaatcccctacctcggcaaacgcgaggatcaatggtgcggatccctgatcggcctgacgagccgggccacctgggctaagaatattcagacagccatcaaccaggttagatccctcattgggaatgaggaatataccgactacatgccttctatgaaacggtttagacgcgaggaagaggaagctggagtgctgtggtga

SEQ ID NO: 20225 - RNA, 9876 nt, synthetic construct
  misc_feature 1..9876: note = derived and/or modified CDS sequence (opt5) from DENV-2__KC762666__SS-prME
  source 1..9876: mol_type = other RNA
acagccggcatcattatcatgatgattcccacagtgatggctttccacctgacgaccagaaacggggagcctcatatgatcgtcagccggcaggaaaaggggaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcacgccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcatggatctggaaaagcgccacgtgctcggacggctgattaccgtcaatcctatcgtgacagagaaagactctccggttaacattgaagccgagcccccttttggcgattcctacatcattatcggggtggaacccggccagctgaagctcagctggttcaaaaagggatctagcattggccagatgtttgagaccacaatgagaggggctaagcgcatggccatcctgggagacaccgcctgggatttcggctcccttgggggagtctttacgtctatcggcaaagctctgcatcaagtgttcggggccatttatggcgcggcttttagcggagtgtcctggacaatgaagatcctcattggcgttgtcatcacctggattgggatgaatagccggtctacctccctgagcgtgtctctggtgcttgtcggagtggttacactctacctgggcgtgatggtccaggccgactccgggtgtgtggttagctggaaaaacaaggagctgaaatgcggatccggcatcttcatcaccgataatgtgcacacatggacggaacagtataagtttcagcctgagtctcccagcaagctcgcctccgctattcaaaaagcccacgaagaggggatctgtggcattagatctgtcacccgcctggaaaaccttatgtggaagcagatcacaccggagctgaatcatattctcagcgagaacgaagtgaaactgaccatcatgacaggagacatcaagggcattatgcaggctgggaaacggtccctgagacctcagcccaccgagcttaagtacagctggaaaacgtggggaaaggccaagatgctctctaccgaactgcacaatcatacattcctgatcgatggccctgagaccgcggaatgccccaacgccaatcgcgcttggaactccctcgaggttgaggactatgggtttggagtgttcacaaccaatatttggctgaaacttaaggaacggcaagatgccttttgtgacagcaaactgatgtctgctgccatcaaggacaacagagcggtccacgccgatatgggctactggattgagtccgctctcaacgacacatggaaaatcgaaaaggccagcttcatcgaggtgaagtcttgccactggcctaaaagccataccctgtggtccaatggcgtgctggagagcgaaatgattatccccaagaacttcgctgggccggtctctcagcacaattatcgccctggataccatacgcagacagccggcccctggcaccttgggcggctcgagatggattttgacttctgtgaaggaaccaccgttgtggtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtcaactctctcgtgaccgctggacatggccagattgataattttagcctgggggttctgggaatggcgcttttcctcgaggaaatgctgcgcacacgggtgggcaccaagcacgccatcctgctcgtcgctgtgtcctttgttacgctgattaccgggaacatgtctttcagagaccttggacgcgtgatggtcatggtgggcgccacaatgaccgatgacatcggcatgggggttacatacctggccctcctggctgcctttaaggtgagacctaccttcgcggctggactgcttctgcggaaactcacgagcaaggagctgatgatgacaaccatcggcattacactcctgtcccaatctaccatccccgagaccattcttgaactgacagatgccctcgccctggggatgatggtcctgaaaatcgtgcgcaatatggagaagtatcagcttgctgtgacgattatggccatcctgtgcgtccctaacgcggttatcctccagaatgcttggaaagtgagctgtaccacactggccgtggtctccgtgagccccctcctgcttacctcttcccaacagaaggccgactggattcctctggctctcacaatcaagggactgaaccccaccgccatttttctgacgacacttagcagaacctctaaaaagcggtcctggccgctgaatgaagctatcatggccgttggcatggtgagcattctcgcgtcttccctgctcaaaaacgatatccctatgaccgggcccctggtcgccggaggccttctgacagtgtgctacgttctgaccggccgcagcgctgacctcgagctggaaagagccgctgacgtgcggtgggaggagcaggccgaaatctccgggagctctcctattcttagcatcacaatttccgaggatggatctatgagcatcaagaatgaagaggaggaacagacgctgaccattctcatccgcacaggcctgctcgtcatttccgggctgttccccgtgtctatcccgatcaccgccgctgcgtggtatctttgggaggtcaaaaagcaaagagccggagtgctgtgggacgttccttctccccctcccgtgggcaaagctgaactggaggatggggcctaccggattaagcagaagggaatcctcggctattcccagattggcgccggggtctacaaagaaggaacatttcacaccatgtggcatgtgacgcgcggcgctgttctgatgcacaaggggaaaagaatcgagccctcctgggccgacgtgaagaaagatcttattagctacggaggcgggtggaagctggagggagaatggaaggagggcgaagaggtccaggtgctcgcgctggaacctggcaaaaacccgcgggctgtgcaaaccaagcccggactcttcaaaacatccaccggaacaatcggcgccgttagcctggacttttctcctgggacctccggaagccccatcgtcgataagaaaggcaaggtggtggggctttatggaaacggcgtcgtgacaagatctggcacgtacgtttccgccattgctcagaccgaaaagagcatcgaggacaatcctgaaattgaggatgacatcttccgcaaaaagcggctgacaattatggatctgcatcccggggccggaaaaaccaagagatatctccctgcgatcgtgcgcgaagctatcaaacggggcctgagaacccttattctggccccgacacgcgtcgtggccgctgagatggaagaggccctccgggggctgcccatcagataccagacgcctgctattcgcgccgagcacaccggacgggaaatcgttgacctcatgtgtcatgcgacattcaccatgagactgctttcccccattcgggtgcctaactataatctgatcattatggatgaggcccactttacagaccccgcttctatcgccgctcgcggctacatcagcaccagagtcgaaatgggggaggccgccggcattttcatgacggctacaccgcctggatcccgggacccctttccccagagcaacgcgcctatcatggatgaggaacgcgagattcccgaaagatcttggaatagcggccacgagtgggtgaccgacttcaaggggaagaccgtttggtttgtgcctagcatcaaagccggaaacgatattgctgcctgcctgcggaagaatggcaaaaaggtcatccaactctctagaaaaacattcgactttgaatatatcaagacccgcacaaacgattgggacttcgtggtgaccacggatattagcgagatgggggccaattttaaggctgagcgggtcatcgacccgagacgctgtatgaaacccgttattctgacagatggagaagaacgggtgatccttgccggccctatgcccgtgacccattcctctgcggctcagagacgcgggcgggtcggcagaaaccctaagaatgaaaacgaccagtacatttacatgggagagcccctggaaaatgatgaggactgcgcccactggaaagaggccaagatgctcctggacaacatcaatacaccggaaggcatcattcctagcatgttcgagcccgaacgcgagaaagtggatgctatcgacggggaatatagactgcggggagaggcccgcaagacctttgttgatctcatgagacggggcgaccttcctgtgtggctggcgtaccgcgtcgccgctgaggggattaactatgccgatagacggtggtgtttcgacggagtgaaaaacaatcaaatcctggaagagaacgttgaagtggagatttggacgaaggagggcgaaagaaagaaactcaagccccgctggctggatgctcggatctactccgaccctcttgccctgaaagagttcaaggaatttgctgccgggagaaaatctctcaccctgaatctgattacagagatgggccgcctccccaccttcatgacacagaaggcgcggaacgcccttgataatctggctgtcctgcataccgccgaagctggaggcagagcctataaccacgccctcagcgagctgccggagacacttgaaaccctgctcctgctgacgctccttgctacagtgaccgggggaatctttctgttcctgatgtccggcaaggggatcggaaaaatgaccctcggcatgtgctgcattatcacagcgagcattctgctttggtacgcccagatccagcctcactggattgctgcctctatcatcctggagtttttcctcattgtcctgctgatccccgaacccgagaagcaacggacccctcaggacaatcagctcacatatgtggttattgccatccttacggtggtggctgccaccatggcgaacgaaatgggctttctggagaaaacaaagaaagatttcgggctgggatccattaccacacagcaaccggagagcaatatcctcgacatcgatctgcgccccgcctccgcttggaccctttacgccgtcgctacgacctttattacacctatgctgagacattctatcgaaaacagctccgttaatgtgtctctcaccgccattgcgaaccaggccacagtgctgatgggcctggggaagggatggcccctcagcaagatggacatcggcgtccctcttctggctattgggtgttactcccaggtgaatcccatcaccctgacggccgctctcctgcttctggttgcccactatgctattatcggacctggcctccaggccaaagcgacacgggaggcccaaaagcgcgctgccgctggcatcatgaaaaacccgaccgtggacgggattacagtcatcgatctggaccccattccttacgatcccaagttcgaaaaacagctgggacaggtgatgctccttgtcctgtgcgtgacccaggttctgatgatgagaaccacatgggccctctgtgaggccctgacgcttgcgaccggccctatcagcacactgtgggaagggaatcccggacggttttggaacaccacaattgctgtgtctatggccaatatcttccgcggctcctatctcgctggggccggactgctgtttagcatcatgaagaacaccgccaacacgagacggggcacaggcaataccggggagaccctcggagagaagtggaaaaaccgccttaatgctctgggcaagtctgagttccaaatttacaaaaagtccgggatccaggaggtcgacagaacactggccaaagaaggaattaagcggggcgagaccgatcatcacgcggtgagcagagggtctgccaaactccgctggttcgttgagcggaacctggtgacaccggaaggaaaggtcgtggaccttggctgcggcagagggggatggagctattactgtggcgggctgaagaatgtgaaagaggttaagggactcacgaaaggcgggcctggacatgaggaacccatccccatgtccacctatggctggaacctggtccgcctgcagtctggcgtggatgtgtttttcacacctcccgaaaagtgcgacaccctcctttgtgatattggggagagctcccctaatccgacagtcgaggctggacggaccctgagagttctgaacctcgtggaaaattggctgaacaataacacgcaattttgcatcaaagtgcttaatccctacatgcctagcgtcatcgagaagatggaagccctgcagcgcaagtacggcggggctctcgtgcggaaccccctgtccagaaattctacccacgagatgtattgggttagcaacgcctccggaaacattgtgtctagcgtcaatatgatctcccgcatgctgattaaccggttcacaatgagacacaaaaaggcgacctacgaacctgacgtggatctcggctctgggacacgcaatatcggaattgagagcgagacccccaaccttgacatcatcggcaaacggattgaaaagatcaaaagagagcatgaaacatcctggcactatgatcaggaccatccgtacaagacctgggcctatcacggcagctacgagacgaagcagacagggtctgcttccagcatggttaatggagtggtccgcctgctgaccaaaccttgggacgtgattcccatggtgacccaaatggccatgacagatacgaccccttttggccagcagagagtcttcaaggaaaaagttgacacacggacccaggagcccaaggaggggaccaaaaagctcatgaagatcaccgctgaatggctgtggaaagagcttggaaagaaaaagacacctcgcatgtgtaccagagaagagtttacgcggaaagtgagatctaacgccgctctgggcgccattttcaccgatgagaataagtggaaatccgcgcgggaagccgtggaggacagcgggttttgggaactcgtcgataaggagcgcaacctgcacctggaaggaaagtgcgagacatgtgtgtataatatgatgggcaaaagagagaagaaactcggcgagttcgggaaggctaaaggatctcgggccatctggtacatgtggctgggcgctcgctttcttgagttcgaagccctggggtttctcaacgaggaccattggttctccagagaaaatagcctgtccggagttgagggcgaggggcttcacaagctgggctacattctccgggatgtgagcaagaaagaaggaggcgccatgtatgcggacgataccgctgggtgggacacacgcatcaccctggaggatctgaagaacgaagagatggtcacgaatcatatggaaggagagcacaaaaagctcgccgaggccatcttcaaactgacataccaaaacaaggtggttagagtgcagcggcccaccccgcgcggcacagtcatggacattatctctagacgggaccagcgcgggagcggacaggtggttacctatggccttaatacgtttaccaacatggaagctcaactgattagacagatggagggggaaggcgtgttcaagtccatccagcaactcacagtcaccgaggagattgccgtgaaaaactggctggtccgggtgggacgcgaaagactttctcggatggctatcagcggcgatgactgcgttgtgaagcctctggatgacagatttgcctccgcgctcacagccctgaatgatatggggaaagtccgcaaggacatccagcagtgggagccctctcggggatggaacgattggacccaggtgcccttctgcagccatcactttcacgaactgattatgaaagacggcagagtgctcgttgtgccttgtcgcaatcaagatgagctgatcgggcgggctagaatttcccagggagccggctggtctcttcgcgaaacagcttgcctgggaaagagctacgcccagatgtggtccctcatgtatttccatcggagagacctgcgccttgcggccaacgctatctgtagcgccgtcccgtctcactgggtgcccacctcccggacgacatggagcattcatgctacccacgagtggatgaccacagaggatatgctgaccgtttggaatagagtgtggatccaggaaaacccttggatggaggacaagacacccgtcgaatcttgggaggaaatcccttacctcggcaaacgcgaggatcaatggtgcggatccctgattggcctgacgagccgggccacctgggctaagaatatccagacagccattaaccaggtgagatccctcatcgggaatgaggaatataccgactacatgccctctatgaaacggtttagacgcgaggaagaggaagcgggagtcctgtggtga

SEQ ID NO: 20226 - RNA, 9876 nt, synthetic construct
  misc_feature 1..9876: note = derived and/or modified CDS sequence (opt5) from DENV-2__KC762677__SS-prME
  source 1..9876: mol_type = other RNA
accgccggaatcattatcatgatgattcccacagtgatggctttccacctgacgaccagaaacggggagcctcatatgatcgtgagccggcaggaaaagggaaagtccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacccactttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacatcctgccacccttagaaagtattgcattgaagctaaactgacgaacacaaccaccgcctctcggtgtccgacacagggggagccctccctcaatgaggaacaagataagcgctttgtgtgcaaacacagcatggtcgacagaggatggggcaacggctgtgggctgttcggaaagggcgggatcgttacctgcgcgatgtttacatgcaagaaaaatatggagggaaagattgtgcagcctgaaaacctggagtacacgatcgtgattacaccccattctggcgaagagaatgccgtcgggaacgatacaggaaaacacggcaaggagatcaaagtgacccctcagtccagcatcacagaagctgagctcaccggctatgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcatgccaagaaacaggatgttgtggtcctgggaagccaagagggcgccatgcacacggctctcacaggggcgaccgaaatccagatgtcctctggcaacctgctttttacaggacatctgaagtgcagactccggatggacaaactgcagcttaagggcatgagctactccatgtgtaccgggaaattcaaggtggtcaaggagattgccgaaacccaacacggaacaatcgtgattagagttcagtatgagggcgacgggagcccctgcaaaatccccttcgagatcatggatctggaaaagcgccatgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcaccaagtgttcggggcgatttacggcgctgcctttagcggagtgtcctggacgatgaagatcctcattggcgttgtcatcacatggattgggatgaatagccggtctacctccctgagcgtgtctctggtgcttgtcggagtggttaccctctatctgggcgtgatggtccaggccgactccgggtgtgtggttagctggaaaaacaaggagctgaaatgcggatccggcatcttcatcacagataatgtgcacacctggacagaacagtacaagtttcagcctgagtctcccagcaagctcgcttccgccattcaaaaagctcatgaagaggggatctgtggcattagatctgtcacgcgcctggaaaaccttatgtggaagcagatcaccccggagctgaatcacattctcagcgagaacgaagtgaaactgacaatcatgaccggagacatcaagggcattatgcaggccgggaaacggtccctgagacctcagcccacagagcttaagtatagctggaaaacctggggaaaggcgaagatgctctctacggaactgcataatcacaccttcctgatcgatggccctgagacagccgaatgccccaacaccaatcgcgcttggaactccctcgaggttgaggactacgggtttggagtgttcacaaccaatatttggctgaaacttaaggaacggcaagatgtctattgtgacagcaaactgatgtctgccgctatcaaggacaacagagccgtgcacgcggatatgggctactggattgagtccgccctcaacgacacatggaaaatcgaaaaggctagctttatcgaggtgaagtcttgctattggcctaaaagccataccctgtggtccaatggcgtcctggagagcgaaatgattatccccaagaacttcgccgggccggtttctcagcacaattaccgccctggataccatacgcagacagctggcccctggcaccttgggcggctcgagatggatttcgacttttgtgaaggaaccaccgtggtggtcacagaggattgcggcaacagagggccctccctgcggaccacgacagccagcggaaaactgattaccgaatggtgctgtcgctcctgcacactccctccgctgagatatcggggcgaggacggctgttggtacgggatggagatcagacccatgaaggaaaaagaggaaaatcttgtgaactctctggttaccgccggacatggccagattgataatttcagcctcggggtgctgggaatggctctgtttcttgaggaaatgctccgcacacgggtcggcaccaagcacgcgatcctgctggtggccgtttccttcgtgacgctcattaccgggaacatgtcttttagagacctgggacgcgtcatggtgatggttggcgctacaatgaccgatgacatcggcatgggggtgacatatcttgccctgctcgccgctttcaaggtcagacctacctttgccgcgggactgctgcttcggaaactgacgagcaaggagctcatgatgacaaccatcggcattgtgctgctctcccaatctacaatccccgagaccattctggaacttaccgatgctctggccctcgggatgatggccctgaaaatcgtgcgcaatatggagaagtaccagctggctgtcacaattatggccatcctttgcgttcctaacgcggtgatcctgcagaatgcttggaaagtgagctgtacgaccctcgccgtcgtgtccgttagccccctgctcctgacatcttcccaacagaaggccgactggattcctcttgctctgaccatcaagggactcaaccccacagccattttcctgaccacgctgagcagaacatctaaaaagcggtcctggccgcttaatgaagctatcatggccgtgggcatggtcagcattctggcgtcttccctcctgaaaaacgatatccctatgaccgggcccctcgtggccggaggcctgcttaccgtttgctatgtgctgacaggccgcagcgctgacctggagctcgaaagagccgctgacgtccggtgggaggagcaggccgaaatctccgggagctctcctattctgagcatcaccatttccgaggatggatctatgagcatcaagaatgaagaggaggaacagacacttacgattctgatccgcaccggcctcctggtgatttccgggctctttcccgtctctatcccgatcacagccgctgcgtggtacctgtgggaggtgaaaaagcaaagagccggagttctttgggacgtgccttctccccctcccgtcggcaaagctgaactggaggatggggcctatcggattaagcagaagggaatcctgggctactcccagattggcgccggggtgtacaaagaaggaaccttccacacaatgtggcatgttacccgcggcgctgtgctcatgcacaaggggaaaagaatcgagccctcctgggccgacgtcaagaaagatctgattagctatggaggcgggtggaaacttgagggagaatggaaggagggcgaagaggtccaggtgctggcgctcgaacctggcaaaaacccgcgggctgttcaaacgaagcccgggctgtttaaaaccaacacaggaaccatcggcgccgtctccctcgacttcagccctgggacatctggatcccccatcgtggataagaaaggcaaggtggtcgggctgtacggaaatggcgtggttaccagaagcggcacatatgtgtctgccattgctcagacggagaagtccatcgaggacaaccctgaaattgaggatgacatctttcgcaaaaagcggcttaccattatggatctgcatcccggggccggaaaaacaaagagatacctgcctgcgatcgtccgcgaagctatcaaacggggcctcagaaccctgattcttgccccgacccgcgtggttgccgctgagatggaagaggccctgcgggggctccccatcagatatcagacccctgctattcgcgccgagcacacgggacgggaaatcgtggacctgatgtgtcatgcgaccttcacaatgagactcctgagccccattcgggtccctaattacaaccttatcattatggatgaggcccacttcaccgaccccgcttccatcgccgctcgcggctatatctctacaagagtggaaatgggggaggccgccggcatttttatgaccgctacgccgcctggaagccgggaccccttcccccagtccaatgcgcctatcatggatgaggaacgcgagattcccgaaagaagctggaactctggccacgagtgggttacagactttaaggggaagaccgtgtggttcgtcccttccatcaaagccggaaatgatattgctgcctgcctgcggaagaacggcaaaaaggtgatccaactgagcagaaaaacctttgacttcgaatacatcaagacacgcaccaatgattgggactttgtggtcacaaccgatatttctgagatgggggccaacttcaaggctgagcgggttatcgacccgagacgctgtatgaaacccgtgattctcacggatggagaagaacgggtgatcctggccggccctatgcccgtcacacatagctccgcggctcagagacgcgggcgggtgggcagaaatcctaagaacgaaaatgaccagtacatttatatgggagagccccttgaaaacgatgaggactgcgcccactggaaagaggccaagatgctgctcgacaatatcaacaccccggaaggcatcattccttctatgtttgagcccgaacgcgagaaagttgatgctatcgacggggaatacagactgcggggagaggcccgcaagacattcgtggatctgatgagacggggcgacctccctgtctggcttgcgtatcgcgtggccgctgaggggattaactacgccgatagacggtggtgttttgacggagttaaaaataaccaaatcctggaagagaatgtggaagtcgagatttggaccaaggagggcgaaagaaagaaactgaagccccgctggctcgatgctcggatctatagcgaccctctggcccttaaagagttcaaggagttcgctgccgggagaaaatccctgacgctcaacctgattaccgagatgggccgcctgcccacatttatgacccagaaggcgcggaatgccctcgataaccttgctgtgctgcatacagccgaagctggaggcagagcctacaatcacgccctgtctgagctcccggagaccctggaaacacttctgctcctgaccctgctcgctacggtcacagggggaatcttcctttttctgatgagcggcaaggggatcggaaaaatgaccctgggcatgtgctgcattatcaccgcgtccattctcctgtggtatgcccagatccagcctcactggattgctgccagcatcatccttgagttctttctgattgtgctcctgatccccgaacccgagaagcaacggacacctcaggacaaccagctgacctacgttgtgattgccatcctcacagtggtcgctgccacgatggcgaatgaaatgggcttccttgagaaaaccaagaaagattttgggctgggatctattacaacccagcaaccggagtccaacatcctggacatcgatctccgccccgccagcgcttggacactgtacgccgttgctaccacgttcattacccctatgcttagacattccatcgaaaattctagcgtgaacgtgtccctgacagccattgcgaatcaggccaccgtcctcatgggcctggggaagggatggcccctgtctaagatggacatcggcgtgcctctccttgctattgggtgttatagccaggttaaccccatcacactgaccgccgctctgctcctgcttgtggcccactacgctattatcggacctggcctgcaggccaaagcgacgcgggaggcccaaaagcgcgctgccgctggcatcatgaaaaatccgacagtcgacgggattaccgtgatcgatctcgaccccattccttatgatcccaagtttgaaaaacagctgggacaggtcatgctgctcgtgctttgcgttacacaggtgctgatgatgagaaccacctgggccctgtgtgaggccctcacactggcgacgggccctatctccaccctttgggaagggaaccccggacggttctggaatacaaccattgctgtcagcatggccaacatctttcgcggctcttacctggctggggccggactcctgttctccatcatgaagaacacagccaataccagacggggcacgggcaacacaggggagaccctgggagagaagtggaaaaatcgcctcaacgctcttggcaagagcgaatttcaaatttataaaaagtctgggatccaggaggtggacagaaccctggccaaagaaggaattaagcggggcgagacagatcatcacgcggtttccagagggagcgccaaactgcgctggttcgtggagcggaatctcgtcaccccggaaggaaaggtggtggacctgggctgcggcagagggggatggtcttactattgtggcgggcttaagaacgttaaagaggtcaagggactgacaaaaggcgggcctggacatgaagaacccatccccatgagcacgtacggctggaatctcgtgcgcctgcagtccggcgtggatgtcttctttacccctcccgaaaagtgcgacacactgctctgtgatattggggagtctagccctaacccgaccgttgaggctggacggacacttagagtgctgaatctggtggaaaactggctcaataacaatacccaattctgcatcaaagtcctgaacccctacatgccttccgtgatcgagaagatggaagcccttcagcgcaagtatggcggggctctggttcggaatcccctcagcagaaactccacgcacgagatgtactgggtgtctaacgccagcggaaatattgtctcctctgtgaacatgatcagccgcatgctgattaatcggtttaccatgagacacaaaaaggcgacatatgaacctgacgttgatctgggctccgggacccgcaacatcggaattgagtctgagatccccaatctcgacatcattggcaaacggatcgaaaagattaaacaggagcatgaaacaagctggcactacgatcaggaccatccgtatagaacctgggcctaccacggctcctatgagaacaagcaaacagggagcgcttcttccatggtgaatggagtcgtgcgccttctgaccaagccttgggacgtgatccccatggtcacgcagatggccatgacagataccacccctttcggccagcagagagtttttaaagaaaaggtggacacacggacgcaagagcccaaagaggggaccaagaaactgatgaagattacagctgaatggctctggaaggagctgggcaagaagaaaacccctcgcatgtgtacaagaaaggagttcacccggaaagtgagaagcaacgccgctcttggcgccatctttacagatgagaataagtggaaatctgcgcgggaggccgtcgaagactccgggttctgggagctggtggataaggaacgcaacctccacctggagggaaagtgcgaaacctgtgtttacaatatgatgggcaaaagagagaagaaactgggcgagtttgggaaggctaaaggaagccgggccatttggtacatgtggctcggcgctcgcttcctggaatttgaggcccttgggttcctgaacgaagaccattggttttctagagagaatagcctcagcggagtggaaggcgaggggctgcacaaacttggctatatcctgcgggatgtctccaagaaagagggaggcgccatgtacgcggacgatacggctgggtgggacacccgcatcacactcgaagatctgaagaacgaggaaatggtgaccaatcatatggagggagaacacaaaaagctggccgaggccattttcaaactcacatatcagaacaaggttgtgagagtccagcggcccaccccgcgcggcacggtgatggacatcattagcagacgggaccagcgcgggtctggacaagttgtgacatacggcctgaacaccttcacaaatatggaggctcagcttatcagacagatggaaggggagggcgtctttaagagcattcaacagctgaccgtgacggaagagatcgccgtcaaaaactggctcgtgcgggttggacgcgagagactgtcccggatggctatctctggcgatgactgcgtggtcaagcctcttgatgacagattcgccagcgcgctgaccgccctcaatgatatggggaaagtgcgcaaggacattcagcagtgggaaccctcccggggatggaacgattggacacaagtgcccttttgctctcatcacttccacgagctgatcatgaaagacggcagagttctggtggtcccttgtcgcaatcaggatgaactcattgggcgggctagaatcagccagggagccggctggtccctgcgcgagaccgcttgccttgggaagtcttatgcccagatgtggagcctgatgtactttcatcggagagacctccgcctggcggccaacgctatttgttccgccgtgccgagccactgggttcccacatctcggaccacatggtccatccatgctacccacgaatggatgacgacagaggatatgcttaccgtgtggaatagagtctggatccaagagaacccttggatggaagacaagacccccgtggagagctgggaagagattccttatctgggcaaacgcgaagatcagtggtgcggatctctcatcggcctgacatcccgggccacctgggctaagaatattcagacagccatcaaccaggtcagaagcctgattgggaatgaggagtacacggactacatgccctccatgaaacggttcagacgcgaagaggaagaggcgggagtgctctggtga

SEQ ID NO: 20227 - RNA, 9876 nt, synthetic construct
  misc_feature 1..9876: note = derived and/or modified CDS sequence (opt5) from DENV-2__KC762668__SS-prME
  source 1..9876: mol_type = other RNA
accgccggaatcattatcatggtgattcccaccgtcatggctttccacctgacgaccagaaacggggagcctcatatgatcgttagccggcaggaaaaggggaaaagcctcctgtttaagaccgagaatggcgtgaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgttgctctggtgcctcatgttgggatgggactcgagacaagaaccgaaacgtggatgtctagcgagggcgcctggaagcacgcccagcggatcgagacatgggtgctgcgccatcccggcttcaccattatggctgccatcctggcttacacaattgggaccacctattttcagagagtcctcatcttcattctgcttacagccgtggcgccttccatgacgatgcggtgcatcggaatttctaaccgcgactttgttgaaggcgtgagcgggggatcctgggtcgatatcgtgctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggatcgtgacctgcgcgatgtttacatgcaagaaaaatatggagggaaagattgtgcagcctgaaaacctggagtatacgatcgtcattacaccccactctggcgaagagaatgccgtggggaacgatacaggaaaacatggcaaggagatcaaaatcacccctcagtccagcattacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggatccagaaagagacactggtgaccttcaagaatcctcacgccaagaaacaggatgttgtggtcctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtggtcaaggagatcgccgaaacccaacatggaacaattgtgatcagagttcagtacgagggcgacgggagcccctgcaaaatccccttcgagattatggatctggaaaagcgccacgtgctcggacggctgatcacggtcaatcctattgtgaccgagaaagactctccggttaacatcgaagctgagcccccttttggcgattcctacattatcattggggtggaacccggccagctgaagctcagctggttcaaaaagggatctagcatcggccagatgtttgagacaaccatgagaggggccaagcgcatggccatcctgggagacacagcttgggatttcggctcccttgggggagtctttacctctattggcaaagccctgcatcaagtgttcggggcgatctatggcgctgcctttagcggagtgtcctggacgatgaagattctcatcggcgttgtcattacatggatcgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcattacagataatgtgcacacctggacagaacagtataagtttcagcctgagtctcccagcaagctcgcttccgccatccaaaaagctcacgaagaggggatttgtggcatcagatctgtcacgcgcctggaaaaccttatgtggaagcagattaccccggagctgaatcatatcctcagcgagaacgaagtgaaactgacaatcatgaccggagacattaagggcatcatgcaggccgggaaacggtccctgagacctcagcccacagagcttaagtacagctggaaagcgtggggaaaggccaagatgctctctaccgaactgcacaatcatacgttcctgattgatggccctgagaccgctgaatgccccaacacaaatcgcgcctggaactccctcgaggttgaggactatgggtttggagtgttcaccacaaatatctggctgaaacttaaggaacggcaagatgtcttttgtgacagcaaactgatgtctgctgccattaaggacaacagagcggtgcacgccgatatgggctactggatcgagtccgctctcaacgacacctggaaaatcgaaaaggccagcttcattgaggtgaagtcttgccactggcctaaaagccatacactgtggtccaatggcgtcctggagagcgaaatgatcattcccaagaacttcgctgggccggtttctcagcacaattatcgccctggataccatacccagacggccggcccctggcaccttgggcggctcgagatggattttgacttctgtgaaggaacaaccgtggtggtcaccgaggattgcggcaacagagggccctccctgcggacaaccacggccagcggaaaactgatcacagaatggtgctgtcgctcctgcaccctccctccgctgagataccggggcgaggacggctgttggtatgggatggagattagaccccttaaggaaaaagaggaaaatctggtgaactctctcgttacagctggacatggccagatcgataattttagcctgggggtgctgggaatggcgcttttcctcgaggaaatgctgcgcacccgggtcggcacaaagcacgccattctgctcgtggctgtttcctttgtgaccctgatcacggggaacatgtctttcagagaccttggacgcgtcatggtgatggttggcgccaccatgacagatgacatcggcatgggggtgacctacctggccctcctggctgcctttaaggtcagacctacattcgcggctggactgcttctgcggaaactcaccagcaaggagctgatgatgacgacaattggcatcgtgctcctgtcccaatctaccattcccgagacaatccttgaactgaccgatgccctcgccctggggatgatggtgctgaaaattgtccgcaatatggagaagtatcagcttgctgttaccatcatggccatcctgtgcgtgcctaacgcggtgattctccagaatgcttggaaagtcagctgtacaacgctggccgtggtttccgtgagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtcggcatggtgagcatcctcgcgtcttccctgctcaaaaacgatatccctatgacagggcccctggttgccggaggccttctgaccgtgtgctacgtcctgaccggccgcagcgctgacctcgagctggaaagagccgctgacgtgcggtgggaggagcaggccgaaatttccgggagctctcctatccttagcattacaatctccgaggatggatctatgagcattaagaatgaagaggaggaacagaccctgacaatcctcattcgcacgggcctgctcgtcatctccgggctgttccccgtgtctatcccgattaccgccgctgcgtggtatctttgggaggttaaaaagcaaagagccggagtgctgtgggacgtcccttctccccctcccgtgggcaaagctgaactggaggatggggcctaccggatcaagcagaagggcattctcggctattcccagatcggcgccggggtttacaaagaaggaacatttcacaccatgtggcatgtgacacgcggcgctgtcctgatgcacaaggggaaaagaattgagccctcctgggccgacgtgaagaaagatcttatcagctacggaggcgggtggaagctggagggagaatggaaggagggcgaagaggtgcaggttctcgcgctggaacctggcaaaaacccgcgggctgtccaaaccaagcccggactcttcaaaacgaacaccggaatcattggcgccgtgtccctggactttagccctgggacatctggatcccccatcgtggataagaaaggcaaggtcgtggggctttatggaaatggcgttgtgaccagaagcggcacatacgtctctgccattgctcagaccgagaagtccatcgaggacaaccctgaaattgaggatgacatcttccgcaaaaagcggctgacaatcatggatctgcatcccggggccggaaaaacgaagagatatctccctgcgattgtgcgcgaagctatcaaacggggcctgagaacccttattctggccccgacacgcgttgtggccgctgagatggaagaggccctccgggggctgcccatcagataccagacccctgctattcgcgccgagcacaccggacgggaaatcgtcgacctcatgtgtcatgcgacattcacgatgagactgcttagccccattcgggtgcctaattataacctgatcatcatggatgaggcccactttaccgaccccgcttccattgccgctcgcggctacatctctacaagagttgaaatgggggaggccgccggcattttcatgaccgctacaccgcctggaagccgggacccctttccccagtccaatgcgcctatcatggatgaggaacgcgagattcccgaaagaagctggaactctggccacgagtgggtgaccgacttcaaggggaagacggtctggtttgtgccttccatcaaagccggaaatgatatcgctgcctgcctgcggaagaacggcaaaaaggtgattcaactcagcagaaaaacattcgactttgaatatatcaagacccgcaccaatgattgggacttcgtcgttacaaccgatatttctgagatgggggccaactttaaggctgagcgggtgatcgacccgagacgctgtatgaaacccgtgattctgacagatggagaagaacgggtcatccttgccggccctatgcccgtgacccatagctccgcggctcagagacgcgggcgggttggcagaaatcctaagaacgaaaatgaccagtacatctacatgggagagcccctggaaaacgatgaggactgcgcccactggaaagaggccaagatgctcctggacaatattaacacgccggaaggcatcattccttctatgttcgagcccgaacgcgagaaagtggatgctatcgacggggaatatagactgcggggagaggcccgcaagacatttgtcgatctcatgagacggggcgaccttcctgtgtggctggcgtaccgcgttgccgctgaggggattaactatgccgatagacggtggtgtttcgacggagtgaaaaataaccaaatcctggaagagaatgtcgaagtggagatttggaccaaggagggcgaaagaaagaaactcaagccccgctggctggatgctcggatctacagcgaccctcttgccctgaaagagttcaaggaatttgctgccgggagaaaatccctcacactgaacctgatcaccgagatgggccgcctccccacgttcatgacccagaaggcgcggaatgcccttgataacctggctgtcctgcatacagccgaagctggaggcagagcctataatcacgccctctctgagctgccggagacccttgaaacactgctcctgctgaccctccttgctacagtgaccgggggaatttttctgttcctgatgagcggcaaggggatcggaaaaatgacgctcggcatgtgctgcattatcacagcgtccattctgctttggtacgcccagatccagcctcactggatcgctgccagcattatcctggagtttttcctcattgttctgctgatccccgaacccgagaagcaacggacccctcaggacaaccagctcacctatgtggtgattgccatccttacagtcgttgctgccaccatggcgaatgaaatgggctttctggagaaaacaaagaaagatttcgggctgggatctatcacgacccagcaactcgagtccaacattctggacatcgatcttcgcccggccagcgcttggacactgtacgccgtggctaccacatttattacccccatgctcagacattccatcgaaaattctagcgtgaacgtctccctgacggccattgcgaatcaggccaccgtgctgatgggcctcgggaagggatggcctctttctaagatggacatcggcgttcccctgctggctattgggtgttacagccaggtgaaccctatcacactcaccgccgctctgcttctgctcgtcgcccactatgctatcattggacccggcctgcaggccaaagcgacacgggaggcccaaaagcgcgctgccgctggcatcatgaaaaatcctaccgtggacgggattacggtcatcgatctggacccgattccctacgatcctaagttcgaaaaacagctcggacaggtgatgcttctggttctgtgcgtgacacaggtcctcatgatgagaaccacatgggccctgtgtgaggcccttaccctggcgaccggccccatctccacactctgggaagggaaccctggacggttttggaatacgaccatcgctgtgagcatggccaacattttccgcggctcttatctggctggggccggactgctcttttccatcatgaagaacacagccaataccagacggggcacaggcaacaccggggagacgcttggagagaagtggaaaaatcgcctgaacgctctgggcaagagcgagttccaaatttacaaaaagtctgggatccaggaggttgacagaacactcgccaaagaaggaattaagcggggcgagaccgatcatcacgcggtgtccagagggagcgccaaactgcgctggttcgtcgagcggaatcttgtgacccccgaaggaaaggtggttgacctgggctgcggcagagggggatggtcttattactgtggcgggctcaagaacgtcaaagaggtgaagggactgacaaaaggcgggccgggacatgaagaacctatccccatgagcacctatggctggaatctggtgcgcctccagtccggcgtcgatgtctttttcacaccccctgaaaagtgcgacacgcttctgtgtgatatcggggagtctagccccaaccctaccgtggaggctggacggacactgagagtgctcaatctggtcgaaaactggcttaataacaatacccaattttgcattaaagtgctgaacccgtacatgccctccgttatcgagaagatggaagccctccagcgcaagtacggcggggctctggtgcggaatcctctgagcagaaactccacacacgagatgtattgggtctctaacgccagcggaaatattgtgtcctctgttaacatgatcagccgcatgctcattaatcggttcaccatgagacacaaaaaggcgacgtacgaacccgacgtggatcttggctccgggacccgcaacatcggaatcgagtctgagacacctaatctggacattatcggcaaacggattgaaaagatcaaacaggagcatgaaaccagctggcactatgatcaggaccatccctacaagacatgggcctatcacggctcctacgagaccaagcaaacagggagcgcttcttccatggtcaacggagtggtgagactgctcaccaaaccgtgggacgtcattcctatggttacgcagatggccatgacagataccaccccctttggccagcagcgcgtgttcaaggaaaaagtggacacaagaacgcaagagcctaaggaggggaccaaaaagctgatgaagatcacagctgaatggctttggaaagagctgggaaagaaaaagacaccccggatgtgtacacgcgaagagtttaccagaaaagtccggagcaatgccgctctcggcgccattttcacagatgagaacaagtggaaatctgcgagagaagccgtggaggactccgggttttgggaactggttgataaggagcggaatctgcacctcgaaggaaagtgcgagacctgtgtgtataacatgatgggcaaacgcgagaagaaactgggcgagttcgggaaggctaaaggaagcagagccatctggtacatgtggcttggcgctcggtttctggagttcgaagccctcgggtttctgaatgaggaccattggttctctcgcgaaaactcccttagcggagtcgagggcgaggggctgcacaagctcggctacatcctgagagatgtgtccaagaaagaaggaggcgccatgtatgcggacgatacggctgggtgggacacccggattacactggaggatctcaagaatgaagagatggttaccaaccatatggaaggagagcacaaacgcctggccgaggccatcttcagacttacataccagaataaggtggtccgggtgcagcgccctacccccagaggcacggttatggacattatcagccggcgcgaccagagagggtctggacaagtggtcacatatggcctgaacacctttacaaacatggaagctcagctcattcggcagatggagggggaaggcgtgttcaaaagcatccaacatctgaccgtcacggaggagatcgccgtgaagaattggcttgctcgcgttggaagagaacggctgtccagaatggccatttctggcgatgactgcgtggtcaagccgctcgatgaccgctttgcgagcgccctgaccgctctgaacgatatggggaaagtgcggaaggacatccagcagtgggagccttccagaggatggaatgattggacacaggtgcccttctgctctcaccactttcatgaactcattatgaaagacggccgcgttctggtggtcccctgtcggaaccaagatgagcttatcgggagagcccgcattagccagggagctggctggtccctgcgggaaaccgcctgcctcgggaagtcttacgcgcagatgtggagcctgatgtatttccacagacgcgaccttcggctggccgctaatgccatctgttccgctgtgcctagccattgggttccgacatctagaaccacatggtccatccacgccacccacgagtggatgacgacagaggatatgctcaccgtgtggaaccgcgtctggattcaggaaaatccctggatggaggacaaaacccctgtggaaagctgggaggaaatcccctacctgggcaagcgggaggatcaatggtgcggatctctgattggcctcacatccagagctacctgggccaagaacatccagacagcgattaatcaggtccggagcctgatcgggaacgaggaatatacggactacatgccttccatgaaaagatttcgccgggaggaagaggaagccggagtgctttggtga

SEQ ID NO: 20228 - RNA, 9876 nt, synthetic construct
  misc_feature 1..9876: note = derived and/or modified CDS sequence (opt5) from DENV-2__KC762678__SS-prME
  source 1..9876: mol_type = other RNA
accgccggcatcattatcatgatgattcccacagtgatggctttccacctgacgaccagaaacggggagcctcatatgatcgtcagccggcaggaaaaggggaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagaatcctcattttcatcctgcttacagccgtgacgccttccatgaccatgcggtgcattggaatctctaaccgcgactttgtcgaaggcgtgagcgggggatcctgggttgatatcgtgctggagcacggcagctgtgtcacaaccatggcgaaaaataagcccacactcgacttcgaactgattaagaccgaggccaaacaccctgctacgcttagaaagtactgcatcgaagccaaactgacaaacaccaccacagcttctcggtgtccgacccagggggagccctccctcaatgaggaacaagataagcgctttgtgtgcaaacatagcatggtggacagaggatggggcaacggctgtgggctgttcggaaagggcgggattgtcacatgcgccatgtttacgtgcaagaaaaatatggagggaaagatcgttcagcctgaaaacctggagtataccattgtgatcacaccccactctggcgaagagaatgcggtggggaacgataccggaaaacatggcaaggagatcaaagtcacacctcagtccagcattaccgaagccgagctcacgggctacgggaccgtgacaatggaatgttctccccggaccggactggacttcaatgagatggttcttctgcagatggaaaacaaggcttggctcgtgcaccgccaatggtttctggatcttccgctgccttggctccccggcgccgacacacaggggtccaactggatccagaaagagaccctggtcacgttcaagaatcctcacgctaagaaacaggatgtggttgtgctgggaagccaagagggcgccatgcatacagccctcaccggggctacagaaattcagatgtcctctggcaacctgctttttaccggacacctgaagtgcagactccggatggacaaactgcagcttaagggcatgagctattccatgtgtaccgggaaattcaaggtcgtgaaggagatcgcggaaacacaacatggaacgattgtcatcagagtgcagtacgagggcgacgggagcccctgcaaaatccccttcgagattatggatctggaaaagcgccacgttctcggacggctgatcaccgtgaatcctattgtcacagagaaagactctccggtgaacatcgaagccgagcccccttttggcgattcctacattatcattggggttgaacccggccagctgaagctcagctggttcaaaaagggatctagcatcggccagatgtttgagaccacaatgagaggggctaagcgcatggccatcctgggagacaccgcctgggatttcggctcccttgggggagtgtttacgtctattggcaaagctctgcatcaagtcttcggggccatctatggcgcggcttttagcggagtgtcctggacaatgaagattctcatcggcgtggttattacctggatcgggatgaatagccggtctacctccctgagcgtctctctggtgcttgtgggagtcgtgacactctacctgggcgttatggtgcaggccgactccgggtgtgtcgtgagctggaaaaacaaggagctgaaatgcggatccggcatcttcattaccgataatgttcacacatggacggaacagtataagtttcagcctgagtctcccagcaagctcgcctccgctatccaaaaagcccacgaagaggggatttgtggcatcagatctgtgacccgcctggaaaaccttatgtggaagcagattacaccggagctgaatcatatcctcagcgagaacgaagtcaaactgaccatcatgacaggagacattaagggcatcatgcaggctgggaaacggtccctgagacctcagcccaccgagcttaagtacagctggaaaacgtggggaaaggccaagatgctctctaccgaactgcacaatcatacattcctgattgatggccctgagaccgcggaatgccccaacgccaatcgcgcttggaactccctcgaggtggaggactatgggtttggagttttcacaaccaatatctggctgaaacttaaggaacggcaagatgccttttgtgacagcaaactgatgtctgctgccattaaggacaacagagcggtgcacgccgatatgggctactggatcgagtccgctctcaacgacacatggaaaatcgaaaaggccagcttcattgaggtcaagtcttgccactggcctaaaagccataccctgtggtccaatggcgtgctggagagcgaaatgatcattcccaagaacttcgctgggccggtgtctcagcacaattatcgccctggataccatacgcagacagccggcccctggcaccttgggcggctcgagatggattttgacttctgtgaaggaaccaccgtcgttgtgacagaggattgcggcaacagagggccctccctgcggaccacgacagccagcggaaaactgatcaccgaatggtgctgtcgctcctgcacactccctccgctgagataccggggcgaggacggctgttggtatgggatggagattagaccccttaaggaaaaagaggaaaatctggtgaactctctcgtcaccgctggacatggccagatcgataattttagcctgggggtgctgggaatggcgcttttcctcgaggaaatgctgcgcacacgggttggcaccaagcacgccattctgctcgtggctgtctcctttgtgacgctgatcaccgggaacatgtctttcagagaccttggacgcgttatggtgatggtcggcgccacaatgaccgatgacatcggcattggggtgacatacctggccctcctggctgcctttaaggttagacctaccttcgcggctggactgcttctgcggaaactcacgagcaaggagctgatgatgacaaccatcggcattacactcctgtcccaatctaccatccccgagaccattcttgaactgacagatgccctcgccctggggatgatggtgctgaaaatcgtccgcaatatggagaagtatcagcttgctgtgacgatcatggccattctgtgcgtgcctaacgcggtcatcctccagaatgcttggaaagttagctgtaccacactggccgtggtgtccgtcagccccctcctgcttacctcttcccaacagaaggccgactggattcctctggctctcacaatcaagggactgaaccccaccgccatttttctgacgacacttagcagaacctctaaaaagcggtcctggccgctgaatgaagctatcatggccgtgggcatggttagcatcctcgcgtcttccctgctcaaaaacgatattcctatgaccgggcccctggtggccggaggccttctgacagtctgctacgtgctgaccggccgcagcgctgacctcgagctggaaagagccgctgacgttcggtgggaggagcaggccgaaatctccgggagctctcctattcttagcatcacaatttccgaggatggatctatgagcatcaagaatgaagaggaggaacagacgctgaccattctcatccgcacaggcctgctcgtgatctccgggctgttccccgtctctattccgatcaccgccgctgcgtggtatctttgggaggtgaaaaagcaaagagccggagtcctgtgggacgtgccttctccccctcccgttggcaaagctgaactggaggatggggcctaccggattaagcagaagggaatcctcggctattcccagattggcgccggggtgtacaaagaaggaacatttcacaccatgtggcatgtcacgcgcggcgctgtgctgatgcacaaggggaaaagaatcgagccctcctgggccgacgttaagaaagatcttatcagctacggaggcgggtggaagctggagggagaatggaaggagggcgaagaggtgcaggtcctcgcgctggaacctggcaaaaacccgcgggctgtgcaaaccaagcccggactcttcaaaacatccaccggaacaattggcgccgtgagcctggacttttctcctgggacctccggaagccccatcgttgataagaaaggcaaggtcgtggggctttatggaaacggcgtggtcacaagatctggcacgtacgtgtccgccattgctcagaccgaaaagagcatcgaggacaatcctgaaattgaggatgacatcttccgcaaaaagcggctgacaatcatggatctgcatcccggggccggaaaaaccaagagatatctccctgcgattgttcgcgaagctatcaaacggggcctgagaacccttattctggccccgacacgcgtggtcgccgctgagatggaagaggccctccgggggctgcccatcagataccagacgcctgctattcgcgccgagcacaccggacgggaaatcgtggacctcatgtgtcatgcgacattcaccatgagactgctttcccccattcgggttcctaactataatctgatcatcatggatgaggcccactttacagaccccgcttctattgccgctcgcggctacatcagcaccagagtggaaatgggggaggccgccggcattttcatgacggctacaccgcctggatcccgggacccctttccccagagcaacgcgcctatcatggatgaggaacgcgagattcccgaaagatcttggaatagcggccacgagtgggtcaccgacttcaaggggaagaccgtgtggtttgttcctagcatcaaagccggaaacgatatcgctgcctgcctgcggaagaatggcaaaaaggtgattcaactctctagaaaaacattcgacagcgaatatatcaagacccgcacaaacgattgggactttgtcgtgaccacggatatttccgagatgggggccaatttcaaggctgagcgggtgatcgacccgagacgctgtatgaaacccgtcattctgacagatggagaggaacgggttatccttgccggccctatgcccgtgacccattctagcgcggctcagagacgcgggcgggtgggcagaaaccctaagaatgaaaacgaccagtacatctacatgggagagcccctggaaaatgatgaggactgcgcccactggaaagaggccaagatgctcctggacaacattaatacaccggaaggcatcattccttccatgtttgagcccgaacgcgagaaagtcgatgctatcgacggggaatatagactgcggggagaggcccgcaagaccttcgtggatctcatgagacggggcgaccttcctgtttggctggcgtaccgcgtggccgctgaggggattaactatgccgatagacggtggtgttttgacggagtcaaaaacaatcaaatcctggaagagaacgtggaagttgagatttggacgaaggagggcgaaagaaagaaactcaagccccgctggctggatgctcggatctactctgaccctcttgccctgaaagagttcaaggagttcgctgccgggagaaaaagcctcaccctgaatctgatcacagagatgggccgcctccccacctttatgacacagaaggtgcggaacgcgcttgataatctggccgtcctgcataccgctgaagccggaggcagagcttataaccacgccctctccgagctgccggagacacttgaaaccctgctcctgctgacgctccttgccacagtgaccgggggaattttcctgtttctgatgagcggcaagggggtcggaaaaatgaccctcggcatgtgctgcatcattacagcttctatcctgctttggtacgcgcagattcagcctcactggatcgccgcttccatcattctggagttctttctcatcgtgctgctgattcccgaacccgagaagcaacggacccctcaggacaatcagctcacatatgttgtgatcgccattcttacggtggtcgccgctaccatggccaacgaaatgggcttcctggagaaaacaaagaaagattttgggctgggaagcatcaccacacagcaaccggagtccaatatcctcgacattgatctgcgccccgcgtctgcctggaccctttacgctgttgccacgaccttcatcacacctatgctgagacatagcattgaaaactcctctgtgaatgtgagcctcaccgctatcgccaaccaggcgacagtcctgatgggcctggggaagggatggcccctctccaagatggacattggcgtgcctcttctggccatcgggtgttacagccaggttaatcccattaccctgacggctgccctcctgcttctggtggctcactatgccatcatcggacctggcctccaggctaaagccacacgggaggcgcaaaagcgcaccgccgctggcattatgaaaaacccgacagtcgacgggatcaccgtgattgatctggaccccatcccttacgatcccaagtttgaaaaacagctgggacaggtcatgctccttgtgctgtgcgttacccaggtgctgatgatgagaacaacgtgggccctctgtgaggctctgacccttgccacaggccctatttctaccctgtgggaagggaatcccggacggttctggaacacaaccatcgccgtctccatggcgaatatctttcgcggcagctatctcgctggggccggactgctgttctctattatgaagaacacggctaacacaagacggggcaccggcaataccggggagacactcggagagaagtggaaaaaccgccttaatgccctgggcaagtccgaatttcaaatctacaaaaagagcgggattcaggaggtggacagaaccctggccaaagaaggaatcaagcggggcgagacagatcatcacgctgtttctagagggagcgccaaactccgctggttcgtggagcggaacctggtcacgccggaaggaaaggtggtggaccttggctgcggcagagggggatggtcctattactgtggcgggctgaagaatgttaaagaggtcaagggactcaccaaaggcgggcctggacatgaggaacccattcccatgtctacatatggctggaacctggtgcgcctgcagagcggcgtggatgtcttctttacccctcccgaaaagtgcgacacactcctttgtgatatcggggagtccagccctaatccgaccgttgaggcgggacggacgctgagagtgctgaacctcgtggaaaattggctgaacaataacacccaattctgcatcaaagtcctttccccctacatgccttctgtgattgagaagatggaagccctgcagcgcaagtacggcggggctctcgttcggaatcccctgagcagaaactccacacacgagatgtattgggtgtctaatgccagcggaaacatcgtctcctctgtgaacatgattagccgcatgctgatcaatcggtttaccatgagacacaaaaaggctacatacgaacctgacgttgatctcggctccgggacccgcaacattggaatcgagagcgagacacccaatcttgacatcattggcaaacggatcgaaaagattaaacaggagcatgaaacctcttggcactatgatcaggaccatccgtacaagacgtgggcctatcacggctcctacgagacaaagcaaaccgggagcgcgtcttccatggtgaacggagtcgtgagactgctgaccaaaccttgggacgtgatccccatggtcacacagatggccatgacggataccacacctttcggccagcagcgcgtttttaaggaaaaagtggacaccagaacacaagagcccaaggaggggaccaaaaagctcatgaagattacagctgaatggctgtggaaagagcttggaaagaaaaagacccctcggatgtgtacgcgcgaagagttcaccagaaaagtgcggagcaatgccgctctgggcgccatctttacagatgagaacaagtggaaatctgctagagaagccgtcgaggactccgggttctgggaactcgtggataaggagcggaatctgcacctggaaggaaagtgcgagacctgtgtttataacatgatgggcaaacgcgagaagaaactcggcgaatttgggaaggcgaaaggaagcagagccatttggtacatgtggctgggcgctcggttccttgagtttgaagccctggggttcctcaatgaggaccattggttttcccgcgaaaacagcctgtctggagtggagggcgaggggcttcacaagctgggctacatcctcagagatgtcagcaagaaagaaggaggcgctatgtatgccgacgatacagccgggtgggacacccggatcacgctggaggatctgaagaatgaagagatggtgacaaaccatatggaaggagagcacaaaaagctcgcggaggctattttcaaactgacctaccagaataaggttgtgcgcgtccagagacccacaccgcggggcaccgtgatggacatcatttcccgcagagaccagcgggggtctggacaagttgtgacgtatggccttaacaccttcacaaatatggaagcccagctgatccgccagatggagggggaaggcgtctttaagagcattcaacagctcaccgtgacagaggagatcgccgtcaaaaactggctggtgaccgttggaagagaacggctttcccgcatggctatctctggcgatgactgcgtggtcaagcctctggatgacagattcgccagcgctctcacagccctgaacgatatggggaaagtgcggaaggacattcagcagtgggagccctccagaggatggaatgattggacccaagtgcccttttgctctcatcacttccacgaactgatcatgaaagacggccgcgttctcgtggtcccttgtcggaaccaggatgagctgattgggagagcgcgcatcagccagggagccggctggtcccttcgggaaacggcttgcctgggaaagagctacgcccagatgtggtctctcatgtattttcatagacgcgacctgcggcttgctgccaatgcgatttgttccgccgtgccgagccactgggttcccacatctagaaccacctggtccatccatgctacacacgagtggatgaccacagaggatatgctgacggtgtggaaccgcgtctggatccaagaaaatccttggatggaggacaagacccccgtggaaagctgggaggaaattccttacctcggcaaacgggaggatcagtggtgcggatccctgatcggcctgacatctagagccacctgggctaagaacattcagacagccatcaatcaggtccgcagcctcattgggaacgaggaatataccgactacatgccctccatgaaacggttcagacgggaggaagaggaagctggagtgctgtggtga

SEQ ID NO: 20229 - RNA, 9876 nt, synthetic construct
  misc_feature 1..9876: note = derived and/or modified CDS sequence (opt5) from DENV-2__KC762679__SS-prME
  source 1..9876: mol_type = other RNA
accgccggcatcattatcatgatgattcccacggtgatggctttccacctgacgaccagaaatggggagcctcatatgatcgtctcccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgctacgtgctcggacggctgattacggtcaatcctatcgtgaccgagaaagactctccggttaacattgaagctgagcccccttttggcgattcctatatcattatcggggtggaacccggccagctgaagctcaattggttcaaaaagggaagctctattggccagatgtttgagacaaccatgagaggggccaagcgcatggccatcctgggagacacagcttgggatttcggcagccttgggggagtctttacctccatcggcaaagccctgcaccaagtgttcggggcgatttacggcgctgccttttctggagtgagctggacgatgaagatcctcattggcgttgtcatcacatggattgggatgaactcccggagcacctctctgtccgtgagcctggtgcttgtcggagtggttaccctctatctgggcgtgatggtccaggccgactctgggtgtgtggtttcctggaaaaataaggagctgaaatgcggaagcggcatcttcatcacagataacgtgcatacctggacagaacagtacaagtttcagcctgagtccccctctaagctcgctagcgccattcaaaaagctcacgaagaggggatctgtggcattagatccgtcacgcgcctggaaaatcttatgtggaagcagatcaccccggagctgaaccacattctctctgagaatgaagtgaaactgacaatcatgaccggagacatcaagggcattatgcaggccgggaaacggagcctgagacctcagcccacagagcttaagtattcctggaaagcgtggggaaaggccaagatgctcagcaccgaactgcataaccacacgttcctgatcgatggccctgagaccgctgaatgccccaatacaaaccgcgcctggaactctctcgaggttgaggactacgggtttggagtgttcaccacaaacatttggctgaaacttaaggaacggcaagatgtcttttgtgactccaaactgatgagcgctgccatcaaggactctagagcggtgcatgccgatatgggctattggattgagtccgctctcaacgacacctggaaaatcgaaaaggccagcttcatcgaggtgaagtcttgccactggcctaaaagccacacactgtggtccaatggcgtcctggagagcgaaatgattatccccaagaacttcgctgggccggtttctcagcataattaccgccctggataccacacccagacggccggcccctggcatcttgggcggctcgagatggattttgacttctgtgaaggaacaaccgtggtggtcaccgaggattgcggcaacagagggccctccctgcggacaaccacggccagcggaaaactgattacagaatggtgctgtcgctcctgcaccctccctccgctgagatatcggggcgaggacggctgttggtacgggatggagatcagaccccttaaggaaaaagaggaaaatctggtgaactctctcgttacagctggacacggccagattgataattttagcctgggggtgctgggaatggcgcttttcctcgaggaaatgctgcgcacccgggtcggcacaaagcatgccatcctgctcgtggctgtttcctttgtgaccctgattacggggaacatgtctttcagagaccttggacgcgtcatggtgatggttggcgccaccatgacagatgacatcggcatgggggtgacctatctggccctcctggctgcctttaaggtcagacctacattcgcggctggactgcttctgcggaaactcaccagcaaggagctgatgatgacgacaatcggcattgtgctcctgtcccaagccaccatccccgagacaattcttgaactgaccgatgccctcgctctggggatgatggtgctgaaaatcgtccgcaatatggagaagtaccagcttgccgttaccattatggcgatcctgtgcgtgcctaacgctgtgatcctccagaatgcctggaaagtctcttgtacaacgctggccgtggttagcgtgagccccctcctgcttaccagctctcaacagaaggctgactggattcctctggccctcacaatcaagggactgaaccccaccgctatttttctgacaaccctttccagaacgagcaaaaagcggtcttggccgctgaatgaagccatcatggcggtcggcatggtgtccattctcgccagctctctgctcaaaaacgatatccctatgacagggcccctggttgctggaggccttctgaccgtgtgctatgtcctgaccggccgctccgccgacctcgagctggaaagagctgccgacgtgcggtgggaggagcaggccgaaatcagcgggtccagccctattctttctatcacaattagcgaggatggatccatgtctatcaagaatgaagaggaggaacagaccctgacaattctcatccgcacgggcctgctcgtcattagcgggctgttccccgtgtccatcccgatcaccgctgcggcctggtacctttgggaggttaaaaagcaaagagctggagtgctgtgggacgtcccttctccccctcccgtgggcaaagccgaactggaggatggggcctatcggattaagcagaagggaatcctcggctacagccagattggcgctggggtttacaaagaaggaacatttcacaccatgtggcacgtgacacgcggcgccgtcctgatgcataaggggaaaagaatcgagccctcctgggcggacgtgaagaaagatcttatttcttatggaggcgggtggaagctggagggagaatggaaggagggcgaagaggtgcaggttctcgctctggaacctggcaaaaacccgcgggccgtccaaaccaagcccggactcttcaaaacgaacaccggaacaatcggcgccgtgagcctggacttttcccctgggaccagcggatctcccatcgtggataagaaaggcaaggtcgtggggctttacggaaatggcgttgtgacaagatccggcacctatgtcagcgctattgcccagacagagaagtctatcgaggacaaccctgaaattgaggatgacatcttccgcaaaaagcggctgacgattatggatctgcaccccggggcgggaaaaaccaagagatacctccctgctatcgtgcgcgaagccatcaaacggggcctgagaacacttattctggccccgacccgcgttgtggctgccgagatggaagaggctctccgggggctgcccatcagatatcagacccctgccattcgcgcggagcatacaggacgggaaatcgtcgacctcatgtgtcacgccacgttcaccatgagactgctttcccccattcgggtgcctaattacaacctgatcattatggatgaggctcattttacagaccccgccagcatcgctgcccgcggctatatctccaccagagttgaaatgggggaggccgctggcattttcatgacagcgaccccgcctggatctcgggacccctttccccagagcaatgcccctatcatggatgaggaacgcgagattcccgaaagatcctggaacagcggccacgagtgggtgacggacttcaaggggaagacagtctggtttgtgccttctatcaaagctggaaatgatattgccgcctgcctgcggaagaacggcaaaaaggtgatccaactctccagaaaaaccttcgacagcgaatacatcaagacccgcacaaatgattgggactttgtcgttaccacagatatttctgagatgggggctaacttcaaggccgagcgggtgatcgacccgagacgctgtatgaaacccgtgattctgaccgatggagaagaacgggtcatccttgcgggccctatgcccgtgacgcacagctccgctgcccagagacgcgggcgggttggcagaaatcctaagaacgaaaatgaccagtacatttatatgggagagcccctggaaaacgatgaggactgcgcccattggaaagaggctaagatgctcctggacaatatcaacacaccggaaggcatcattccttctatgtttgagcccgaacgcgagaaagtggatgccatcgacggggaatacagactgcggggagaggcgcgcaagaccttcgtcgatctcatgagacggggcgaccttcctgtgtggctggcctatcgcgttgctgccgaggggattaactacgctgatagacggtggtgttttgacggagtgaaaaataaccaaatcctggaagagaatgtcgaagtggagatttggacaaaggagggcgaaagaaagaaactcaagccccgctggctggatgcccggatctatagcgaccctcttgctctgaaagagttcaaggagttcgccgcggggagaaaatccctcaccctgaacctgattacggagatgggccgcctccccacctttatgacacagaaggcccggaatgctcttgataacctggccgtcctgcacaccgctgaagccggaggcagagcctacaatcatgctctctctgagctgccggagacacttgaaaccctgctcctgctgacactccttgcgaccgtgacaggcgggatcttcctgtttctgatgagcgggaaggggatcggaaaaatgacactcggcatgtgctgcattatcaccgcctccattctgctttggtatgctcagatccagcctcactggattgccgccagcatcatcctggagttctttctcattgttctgctgatccccgaacccgagaagcaacggacccctcaggacaaccagctcacatacgtggtgattgctatccttaccgtcgttgccgcgacaatggccaatgaaatgggcttcctggagaaaacgaagaaagattttgggctgggatctattaccacacagcaaccggagtccaacatcctcgacatcgatctgcgccccgctagcgcctggaccctttacgctgtggccacaaccttcattacgcctatgctgagacactccatcgaaaattctagcgtgaacgtctccctcaccgcgattgccaatcaggctacagtgctgatgggcctggggaagggatggcccctctctaagatggacatcggcgttcctcttctggccattgggtgttatagccaggtgaaccccatcaccctgacagctgccctcctgcttctggtcgctcattacgccattatcggacctggcctccaggcgaaagccacccgggaggctcaaaagcgcgccgctgccggcatcatgaaaaatccgacggtggacgggattacagtcatcgatctggaccccattccttatgatcccaagtttgaaaaacagctgggacaggtgatgctccttgttctgtgcgtgacccaggtcctgatgatgagaacaacctgggccctctgtgaggcgctgacccttgctacaggccctatctccacgctgtgggaagggaaccccggacggttctggaataccacaattgccgtgagcatggctaacatctttcgcggctcttacctcgccggggccggactgctgttctccatcatgaagaacaccgctaatacaagacggggcaccggcaacacgggggagacactcggagagaagtggaaaaatcgccttaacgccctgggcaagagcgaatttcaaatttataaaaagtctgggatccaggaggttgacagaaccctggcgaaagaaggaattaagcggggcgagaccgatcaccatgccgtgtccagagggagcgctaaactccgctggttcgtcgagcggaatctggtgacaccggaaggaaaggtggttgaccttggctgcggcagagggggatggtcttactattgtggcgggctgaagaacgtcaaagaggtgaagggactcaccaaaggcgggcctggacacgaggaacccatccccatgagcacatacggctggaatctggtgcgcctgcagtccggcgtcgatgttttctttacgcctcccgaaaagtgcgacaccctcctttgtgatattggggagtctagccctaacccgacagtggaggccggacggaccctgagagtgctgaatctcgtcgaaaactggctgaataacaatacacaattctgcatcaaagtgcttaacccctacatgccttccgttatcgagaagatggaagctctgcagcgcaagtatggcggggccctcgtgcggaatcccctgagcagaaactccacccatgagatgtactgggtctctaacgcgagcggaaatattgtgtcctctgttaacatgatcagccgcatgctgattaatcggtttacgatgagacacaaaaaggccacctatgaacctgacgtggatctcggctccgggacacgcaacatcggaattgagtctgagacccccaatcttgacatcatcggcaaacggattgaaaagatcaaacaggagcacgaaacaagctggcattacgatcaggaccacccgtataagacctgggcttaccatggctcctatgagacaaagcaaaccgggagcgcctcttccatggtcaacggagtggtgagactgctgacgaaaccttgggacgtcattcccatggttacacagatggctatgaccgataccacacctttcggccagcagcgcgtgtttaaggaaaaagtggacacgagaacccaagagcccaaggaggggaccaaaaagctcatgaagatcaccgccgaatggctgtggaaagagcttggaaagaaaaagacacctcggatgtgtacccgcgaagagttcacaagaaaagtccggagcaatgctgccctgggcgcgatttttaccgatgagaacaagtggaaatctgccagagaagctgtggaggactccgggttctgggaactcgttgataaggagcggaatctgcacctggaaggaaagtgcgagacgtgtgtgtacaacatgatgggcaaacgcgagaagaaactcggcgaatttgggaaggccaaaggaagcagagctatctggtacatgtggctgggcgcccggttccttgagtttgaagccctggggttcctcaatgaggaccactggttttctcgcgaaaactccctgagcggagtcgagggcgaggggcttcataagctgggctatattctcagagatgtgtccatgaaggaaggaggcgcgatgtacgctgacgataccgccgggtgggacacacggatcaccctggaggatctgaaaaatgaagagatggttacaaaccacatggaaggagagcataagaaactcgccgaggctatcttcaagctgacctatcagaataaagtggtccgcgtgcagagacccacgccgcggggcacagttatggacattatcagccgcagagaccagcgggggtctggacaagtggtcacctacggccttaacacattcaccaacatggaagcccagctgattcgccagatggagggggaaggcgtgtttaagagcatccaacagctcacggtcaccgaggagattgctgtgaagaattggctggttagagtgggacgggaacgcctttccagaatggccatctctggcgatgactgcgtcgtgaaacctctggatgaccggttcgcgagcgccctcacagctctgaacgatatggggaaggtgagaaaagacatccagcagtgggagccctcccgcggatggaatgattggacccaagttcccttttgctctcaccatttccacgaactgattatgaaggacggccgggtgctcgtcgtgccttgtagaaaccaggatgagctgatcgggcgcgcccggattagccagggagctggctggtcccttagagaaacagcctgcctggggaaatcttatgcgcagatgtggagcctcatgtactttcaccgccgggacctgagacttgccgctaatgccatctgttccgctgttccgagccattgggtgcccacctctcgcacaacctggtccattcacgccacgcatgagtggatgacaaccgaggatatgctgaccgtctggaaccgggtgtggatccaagaaaatccttggatggaggacaagacacccgtcgaaagctgggaggaaatcccttatctcggcaagagagaggatcagtggtgcggatctctgattggcctgacctcccgcgctacatgggccaaaaacatccagacggcgattaatcaggtgcggagcctcatcgggaacgaggaatacaccgactacatgccctccatgaagagattccggagagaggaagaggaagccggagttctgtggtga

SEQ ID NO: 20230 - RNA, 9876 nt, synthetic construct
  misc_feature 1..9876: note = derived and/or modified CDS sequence (opt5) from DENV-2__KC762680__SS-prME
  source 1..9876: mol_type = other RNA
accgccggcatcattatcatgatgattcccacggtgatggctttccacctgacgaccagaaatggggagcctcatatgatcgtctcccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgctacgtgctcggacggctgattacggtcaatcctatcgtgaccgagaaagactctccggttaacattgaagctgagcccccttttggcgattcctatatcattatcggggtggaacccggccagctgaagctcaattggttcaaaaagggaagctctattggccagatgtttgagacaaccatgagaggggccaagcgcatggccatcctgggagacacagcttgggatttcggcagccttgggggagtctttacctccatcggcaaagccctgcaccaagtgttcggggcgatttacggcgctgccttttctggagtgagctggacgatgaagatcctcattggcgttgtcatcacatggattgggatgaactcccggagcacctctctgtccgtgagcctggtgcttgtcggagtggttaccctctatctgggcgtgatggtccaggccgactctgggtgtgtggtttcctggaaaaataaggagctgaaatgcggaagcggcatcttcatcacagataacgtgcatacctggacagaacagtacaagtttcagcctgagtccccctctaagctcgctagcgccattcaaaaagctcacgaagaggggatctgtggcattagatccgtcacgcgcctggaaaatcttatgtggaagcagatcaccccggagctgaaccacattctctctgagaatgaagtgaaactgacaatcatgaccggagacatcaagggcattatgcaggccgggaaacggagcctgagacctcagcccacagagcttaagtattcctggaaagcgtggggaaaggccaagatgctcagcaccgaactgcataaccacacgttcctgatcgatggccctgagaccgctgaatgccccaatacaaaccgcgcctggaactctctcgaggttgaggactacgggtttggagtgttcaccacaaacatttggctgaaacttaaggaacggcaagatgtcttttgtgactccaaactgatgagcgctgccatcaaggactctagagcggtgcatgccgatatgggctattggattgagtccgctctcaacgacacctggaaaatcgaaaaggccagcttcatcgaggtgaagtcttgccactggcctaaaagccacacactgtggtccaatggcgtcctggagagcgaaatgattatccccaagaacttcgctgggccggtttctcagcataattaccgccctggataccacacccagacggccggcccctggcatcttgggcggctcgagatggattttgacttctgtgaaggaacaaccgtggtggtcaccgaggattgcggcaacagagggccctccctgcggacaaccacggccagcggaaaactgattacagaatggtgctgtcgctcctgcaccctccctccgctgagatatcggggcgaggacggctgttggtacgggatggagatcagaccccttaaggaaaaagaggaaaatctggtgaactctctcgttacagctggacacggccagattgataattttagcctgggggtgctgggaatggcgcttttcctcgaggaaatgctgcgcacccgggtcggcacaaagcatgccatcctgctcgtggctgtttcctttgtgaccctgattacggggaacatgtctttcagagaccttggacgcgtcatggtgatggttggcgccaccatgacagatgacatcggcatgggggtgacctatctggccctcctggctgcctttaaggtcagacctacattcgcggctggactgcttctgcggaaactcaccagcaaggagctgatgatgacgacaatcggcattgtgctcctgtcccaagccaccatccccgagacaattcttgaactgaccgatgccctcgctctggggatgatggtgctgaaaatcgtccgcaatatggagaagtaccagcttgccgttaccattatggcgatcctgtgcgtgcctaacgctgtgatcctccagaatgcctggaaagtctcttgtacaacgctggccgtggttagcgtgagccccctcctgcttaccagctctcaacagaaggctgactggattcctctggccctcacaatcaagggactgaaccccaccgctatttttctgacaaccctttccagaacgagcaaaaagcggtcttggccgctgaatgaagccatcatggcggtcggcatggtgtccattctcgccagctctctgctcaaaaacgatatccctatgacagggcccctggttgctggaggccttctgaccgtgtgctatgtcctgaccggccgctccgccgacctcgagctggaaagagctgccgacgtgcggtgggaggagcaggccgaaatcagcgggtccagccctattctttctatcacaattagcgaggatggatccatgtctatcaagaatgaagaggaggaacagaccctgacaattctcatccgcacgggcctgctcgtcattagcgggctgttccccgtgtccatcccgatcaccgctgcggcctggtacctttgggaggttaaaaagcaaagagctggagtgctgtgggacgtcccttctccccctcccgtgggcaaagccgaactggaggatggggcctatcggattaagcagaagggaatcctcggctacagccagattggcgctggggtttacaaagaaggaacatttcacaccatgtggcacgtgacacgcggcgccgtcctgatgcataaggggaaaagaatcgagccctcctgggcggacgtgaagaaagatcttatttcttatggaggcgggtggaagctggagggagaatggaaggagggcgaagaggtgcaggttctcgctctggaacctggcaaaaacccgcgggccgtccaaaccaagcccggactcttcaaaacgaacaccggaacaatcggcgccgtgagcctggacttttcccctgggaccagcggatctcccatcgtggataagaaaggcaaggtcgtggggctttacggaaatggcgttgtgacaagatccggcacctatgtcagcgctattgcccagacagagaagtctatcgaggacaaccctgaaattgaggatgacatcttccgcaaaaagcggctgacgattatggatctgcaccccggggcgggaaaaaccaagagatacctccctgctatcgtgcgcgaagccatcaaacggggcctgagaacacttattctggccccgacccgcgttgtggctgccgagatggaagaggctctccgggggctgcccatcagatatcagacccctgccattcgcgcggagcatacaggacgggaaatcgtcgacctcatgtgtcacgccacgttcaccatgagactgctttcccccattcgggtgcctaattacaacctgatcattatggatgaggctcattttacagaccccgccagcatcgctgcccgcggctatatctccaccagagttgaaatgggggaggccgctggcattttcatgacagcgaccccgcctggatctcgggacccctttccccagagcaatgcccctatcatggatgaggaacgcgagattcccgaaagatcctggaacagcggccacgagtgggtgacggacttcaaggggaagacagtctggtttgtgccttctatcaaagctggaaatgatattgccgcctgcctgcggaagaacggcaaaaaggtgatccaactctccagaaaaaccttcgactttgaatacatcaagacccgcacaaatgattgggacttcgtcgttaccacagatattagcgagatgggggctaactttaaggccgagcgggtgatcgacccgagacgctgtatgaaacccgtgattctgaccgatggagaagaacgggtcatccttgcgggccctatgcccgtgacgcactctagcgctgcccagagacgcgggcgggttggcagaaatcctaagaacgaaaatgaccagtacatttatatgggagagcccctggaaaacgatgaggactgcgcccattggaaagaggctaagatgctcctggacaatatcaacacaccggaaggcatcattccttccatgttcgagcccgaacgcgagaaagtggatgccatcgacggggaatacagactgcggggagaggcgcgcaagacctttgtcgatctcatgagacggggcgaccttcctgtgtggctggcctatcgcgttgctgccgaggggattaactacgctgatagacggtggtgtttcgacggagtgaaaaataaccaaatcctggaagagaatgtcgaagtggagatttggacaaaggagggcgaaagaaagaaactcaagccccgctggctggatgcccggatctattctgaccctcttgctctgaaagagttcaaggaatttgccgcggggagaaaaagcctcaccctgaacctgattacggagatgggccgcctccccaccttcatgacacagaaggcccggaatgctcttgataacctggccgtcctgcacaccgctgaagccggaggcagagcctacaatcatgctctctccgagctgccggagacacttgaaaccctgctcctgctgacactccttgcgaccgtgacaggcgggatctttctgttcctgatgtctgggaaggggatcggaaaaatgacactcggcatgtgctgcattatcaccgccagcattctgctttggtatgctcagatccagcctcactggattgccgcctccatcatcctggagtttttcctcattgttctgctgatccccgaacccgagaagcaacggacccctcaggacaaccagctcacatacgtggtgattgctatccttaccgtcgttgccgcgacaatggccaatgaaatgggctttctggagaaaacgaagaaagatttcgggctgggaagcattaccacacagcaaccggagtctaacatcctcgacatcgatctgcgccccgcttccgcctggaccctttacgctgtggccacaacctttattacgcctatgctgagacacagcatcgaaaattcctctgtgaacgtcagcctcaccgcgattgccaatcaggctacagtgctgatgggcctggggaagggatggcccctctccaagatggacatcggcgttcctcttctggccattgggtgttattctcaggtgaaccccatcaccctgacagctgccctcctgcttctggtcgctcattacgccattatcggacctggcctccaggcgaaagccacccgggaggctcaaaagcgcgccgctgccggcatcatgaaaaatccgacggtggacgggattacagtcatcgatctggaccccattccttatgatcccaagttcgaaaaacagctgggacaggtgatgctccttgttctgtgcgtgacccaggtcctgatgatgagaacaacctgggccctctgtgaggcgctgacccttgctacaggccctatcagcacgctgtgggaagggaaccccggacggttttggaataccacaattgccgtgtccatggctaacatcttccgcggcagctacctcgccggggccggactgctgttttctatcatgaagaacaccgctaatacaagacggggcaccggcaacacgggggagacactcggagagaagtggaaaaatcgccttaacgccctgggcaagtccgagttccaaatttataaaaagagcgggatccaggaggttgacagaaccctggcgaaagaaggaattaagcggggcgagaccgatcaccatgccgtgtctagagggtccgctaaactccgctggttcgtcgagcggaatctggtgacaccggaaggaaaggtggttgaccttggctgcggcagagggggatggagctactattgtggcgggctgaagaacgtcaaagaggtgaagggactcaccaaaggcgggcctggacacgaagaacccatccccatgtctacatacggctggaatctggtgcgcctgcagagcggcgtcgatgtctttttcacgcctcccgaaaagtgcgacaccctcctttgtgatattggggagtcctctcctaacccgacagtggaggccggacggaccctgagagtgctgaatctcgtcgaaaactggctgaataacaatacacaattttgcatcaaagtgcttaacccctacatgcctagcgttatcgagaagatggaagctctgcagcgcaagtatggcggggccctcgtgcggaatcccctgtccagaaacagcacccatgagatgtactgggtctccaacgcgtctggaaatattgtgagctccgttaacatgatctctcgcatgctgattaatcggttcacgatgagacacaaaaaggccacctatgaacctgacgtggatctcggcagcgggacacgcaacatcggaattgagtccgagacccccaatcttgacatcatcggcaaacggattgaaaagatcaaacaggagcacgaaacatcttggcattacgatcaggaccacccgtataagacctgggcttaccatggcagctatgagacaaagcaaaccgggtccgccagctctatggtcaacggagtggtgagactgctgacgaaaccttgggacgtcattcccatggttacacagatggctatgaccgataccacaccttttggccagcagcgcgtgttcaaggaaaaagtggacacgagaacccaagagcccaaggaggggaccaaaaagctcatgaagatcaccgccgaatggctgtggaaagagcttggaaagaaaaagacacctcggatgtgtacccgcgaagagtttacaagaaaagtccggtccaatgctgccctgggcgcgattttcaccgatgagaacaagtggaaaagcgccagagaagctgtggaggactctgggttttgggaactcgttgataaggagcggaatctgcacctggaaggaaagtgcgagacgtgtgtgtacaacatgatgggcaaacgcgagaagaaactcggcgagttcgggaaggccaaaggatccagagctatctggtacatgtggctgggcgcccggtttcttgagttcgaagccctggggtttctcaatgaggaccactggttcagccgcgaaaactctctgtccggagtcgagggcgaggggcttcataagctgggctatattctcagagatgtgagcatgaaggaaggaggcgcgatgtacgctgacgataccgccgggtgggacacacggatcaccctggaggatctgaaaaatgaagagatggttacaaaccacatggaaggagagcataagaaactcgccgaggctatcttcaagctgacctatcagaataaagtggtccgcgtgcagagacccacgccgcggggcacagttatggacattatctcccgcagagaccagcgggggagcggacaagtggtcacctacggccttaacacatttaccaacatggaagcccagctgattcgccagatggagggggaaggcgtgttcaagtctatccaacagctcacggtcaccgaggagattgctgtgaagaattggctggttagagtgggacgggaacgccttagcagaatggccatctccggcgatgactgcgtcgtgaaacctctggatgaccggtttgcgtctgccctcacagctctgaacgatatggggaaggtgagaaaagacatccagcagtgggagcccagccgcggatggaatgattggacccaagttcccttctgctcccaccattttcacgaactgattatgaaggacggccgggtgctcgtcgtgccttgtagaaaccaggatgagctgatcgggcgcgcccggatttctcagggagctggctggagccttagagaaacagcctgcctggggaaatcctatgcgcagatgtggtctctcatgtacttccaccgccgggacctgagacttgccgctaatgccatctgtagcgctgttccgtcccattgggtgcccaccagccgcacaacctggtctattcacgccacgcatgagtggatgacaaccgaggatatgctgaccgtctggaaccgggtgtggatccaagaaaatccttggatggaggacaagacacccgtcgaatcctgggaggaaatcccttatctcggcaagagagaggatcagtggtgcggaagcctgattggcctgacctctcgcgctacatgggccaaaaacatccagacggcgattaatcaggtgcggtccctcaaggggaacgaggaatacaccgactacatgcccagcatgaaaagatttcggagagaggaaggagaggccggcgttctgtggtga

SEQ ID NO: 20231 - RNA, 9876 nt, synthetic construct
  misc_feature 1..9876: note = derived and/or modified CDS sequence (opt5) from DENV-2__JQ955624__SS-prME
  source 1..9876: mol_type = other RNA
acagccggcgtgatcattatgctgatccccacagctatggccttccacctcacgaccagaaacggggaacctcatatgattgtcagccggcaggaaaagggaaaaagcctgctttttaagacagaagacggcgttaatatgtgcaccctgatggcgatggatctcggggaactgtgtgaggacacaatcacctacaactgcccgcttctgcgccaaaatgaacccgaggatattgactgttggtgcaactctacaagcacctgggtgacgtatggaacctgtacagctaccggcgagcacagacgggaaaaacgctccgtggccctcgtccctcatgtggggatgggactggagacaagaaccgaaacgtggatgtctagcgagggcgcctggaagcacgctcagcggatcgagacatggatcctgcgccatcccggcttcgccattatggctgccatcctcgcgtacaccattgggacaacccactttcagagagttctgatcttcattcttctgaccgccgtggctccttccatgacaatgcggtgcatcggaatttctaatcgcgattttgtcgaaggcgtgagcgggggatcctgggttgacatcgtgctcgagcacggcagctgtgtcacgaccatggccaaaaacaagcccacactggatttcgaacttatcaagaccgaggctaaacagcctgccacactgagaaagtattgcattgaagcgaaactcaccaatacgacaaccgcctctcggtgtccgacccaaggggagccctccctgaacgaggaacaggacaagcgctttgtgtgcaaacatagcatggtggatagaggatggggcaatggctgtgggctgttcggaaagggcgggatcgtcacatgcgctatgtttacctgcaagaaaaacatggagggaaagattgttcagcctgaaaatctcgagtacacaatcgtggtgacgccccactctggcgaagagaacgccgtcgggaatgacaccggaaaacatggcaaggagattaaagtgacacctcagtccagcatcaccgaagctgagctgacaggctatgggaccgttacgatggaatgttctccccggaccggacttgatttcaacgagatggtgctgctccaaatggaaaataaggcctggctggtccaccgccagtggtttcttgacctgccgctcccttggctgcccggcgccgatacacaggggtccaactggatccagaaagagaccctggtgacattcaagaaccctcacgctaagaaacaagacgttgtggtcctcggaagccaggagggcgcgatgcataccgccctgacgggggctacagaaattcagatgtcctctggcaatcttctgtttaccggacacctcaagtgcagactgcggatggacaaacttcaactgaagggcatgagctactccatgtgtacagggaaattcaaggtggtcaaggagatcgccgaaacccagcatggaaccattgtggttagagtgcagtatgagggcgatgggagcccctgcaaaatccccttcgagattatggacctcgaaaagcgccacgtcctgggacggctgatcacagtgaaccctatcgttacggagaaagattctccggtgaatattgaagccgagcccccttttggcgactcctacatcattatcggggtcgaacccggccagctcaagctgagctggttcaaaaagggatctagcattggccaaatgtttgagaccacaatgagaggggctaagcgcatggccatccttggagataccgcgtgggacttcggctccctcgggggagtgtttacatctattggcaaagctctccatcaggtgttcggggccatctacggcgccgcttttagcggagtttcctggaccatgaagatcctgattggcgtcgtgatcacgtggattgggatgaacagccggtctacatccctgagcgtgtctcttgtcctcgtgggagttgtgaccctgtatctgggcgtcatggtgcaggccgattccgggtgtgttgtgagctggaaaaataaggagctcaaatgcggatccggcatcttcattaccgacaacgtccacacatggaccgaacagtacaagtttcaacctgagtctcccagcaagctggcttccgccatccagaaagcgcacgaagaggggatctgtggcattagatctgtgacacgccttgaaaatctgatgtggaagcagatcacgccggagctcaaccatattctgagcgagaatgaagttaaactgaccatcatgacaggagatattaagggcatcatgcaggccgggaaacggtcccttagacctcaacccaccgagctcaagtatagctggaaaacatggggaaaggctaagatgctgtctaccgaatcccacaaccagacgttcctgatcgacggccctgagaccacagaatgccccaataccaaccgcgcctggaatagcctcgaggtggaggattacgggtttggagtcttcacaaccaacatttggctgaaacttaaggaacggcaggacgtgttttgtgactctaaactgatgtccgctgccgtgaaggataatagagcggtccatgccgacatgggctattggatcgagagcgctctcaacgatacatggaaaattgaaaaggcctctttcatcgaggttaagagctgccactggcctaaatcccacaccctgtggagcaacggcgtgctggagtctgaaatgattatccccaagaatttcgctgggccggtgtcccagcataactaccgccctggatatcacacgcaaacagccggcccctggcatcttgggaaactcgagatggactttgatttctgtgaaggaaccaccgtcgtggttacagaggactgcggcaatcgggggcccagcctgagaaccacgacagcctccggaaagctgatcaccgaatggtgctgtcggtcttgcacactccctccgctgcgctacagaggcgaggatggctgttggtacgggatggagattcggccccttaaagaaaaggaggaaaacctggtgaatagcctcgtcaccgctggacacggccagatcgacaacttttccctggggattctgggaatggcgcttttcctcgaggaaatgctgagaacacgcgtgggcaccaagcatgccgttctgctcgtggctgtctcttttatgacgctgatcaccgggaatatgagcttccgggatcttggaagagtgatggttatggtgggcgccgccatgacagacgatattggcatgggggtcacctatctggctctcctggccgcgtttaaagtgcgccctacattcgctgccggactgcttctgagaaagctcacctccaaagagctgatgatgacgacaatcggcattgtgctcctgtctcagagcaccatccccgagacaatccttgaactgaccgacgccctcgctctggggatgatggtcctgaagattgttcggaacatggagaaataccaacttgccgtgaccatcatggcgattctgtgcgtgcctaatgctgtcatcctccagaacgcctggaaggtgtcctgtacaattctggccgttgtgagcgtctctcccctcctgcttacgtccagccagcagaaggctgattggatccctctggccctcaccatcaaaggactgaatcccacagctatttttctgaccacactttctcgcaccaacaagaaaagatcctggccgctgaatgaagccatcatggcggtgggcatggttagcattctcgcctcttccctgctcaagaacgacatccctatgacggggcccctggtggctggaggccttctgacagtctgctatgtgctgaccggccggagcgccgacctcgagctggaacgcgctgccgatgtcagatgggaggaccaagccgagatttccgggagctctcctatccttagcatcaccatttccgaagatggatctatgagcatcaaaaatgaggaagaggagcagacactgaccattctcatccggacaggcctgctcgtgatttccgggctgttccccgtttctatcccgattacggctgcggcctggtacctttgggaagtgaagaaacagcgcgctggagtcctgtgggacgtgccttctccccctcccgttggcaaggccgagctggaagatggggcctatagaatcaagcagaaaggaatcctcggctactcccaaattggcgctggggtgtataaggagggaacctttcacacaatgtggcacgtcacccggggcgccgtgctgatgcataaagggaagcgcatcgaaccctcctgggcggacgtgagaaaagatcttattagctacggaggcgggtggaagctggagggagagtggaaggaaggcgaggaagttcaggtcctcgctctggagcctggcaaaaacccgcgggccgtgcagacaaagcccgggctgttcaaaaccaacacgggaaccatcggcgccgtgtccctggactttagccctgggacatctggatcccccattgtcgataagaaaggcaaggtggttgggctttacggaaatggcgtggtcaccagaagcggcacatatgtgtctgctatcgcccagtccgaaaagagcatcgaggacaaccctgagattgaagatgacatcttccgcaaaaagcggctgaccattatggatctgcaccccggggcgggaaaaacaaagagatacctccctgctatcgttcgcgaggccattaaacggggcctgagaacgcttatcctggccccgacccgcgtggtcgctgccgaaatggaggaagctctccgggggctgcccatcagatatcaaacccctgccattcgcgcggagcataccggacgggagatcgtggacctcatgtgtcacgccaccttcacaatgagactgctttcccccgttcgggtgcctaattacaacctgattatcatggacgaagctcattttacggatcccgcctctattgctgcccgcggctatatcagcaccagagtcgagatgggggaagccgctggcattttcatgacagcgaccccgcctggatcccgggacccctttccccagagcaatgcccctatcatggatgaggagcgcgaaatccccgagagatcttggaactccggccacgaatgggtgacagacttcaaggggaagaccgtgtggtttgtccctagcattaaagctggaaatgatatcgccgcctgcctgcggaagaacggcaaaaaggttattcagctctctagaaaaacgttcgacagcgagtacatcaagacacgcaccaatgattgggactttgtggtgaccacagatatttccgaaatgggggctaacttcaaggccgagcgggtcatcgacccgagacgctgtatgaaacccgtgatcctgaccgatggagaggaacgggttattcttgcgggccctatgcccgtgacacactctagcgctgcccaaagacgcgggcggatcggcagaaatcctaagaacgagaatgaccagtatatttacatgggagaacccctggagaacgacgaagattgcgcccattggaaagaggctaagatgctcctggacaatatcaacaccccggagggcattatcccttccatgtttgaacccgagcgcgaaaaagtcgatgccatcgacggggagtacagactgcggggagaagcgcgcaagacgttcgtggagctcatgagacggggcgatcttcctgtttggctggcctatcgcgtggctgccgaggggattaactacgctgacagacggtggtgttttgatggaatcaaaaataaccagattctggaagagaatgtcgaagtggagatctggacaaaggagggcgaaagaaagaaactcaagccccgctggctggacgcccggatttattctgatcctcttgctctgaaagagttcaaggagttcgccgcggggagaaaaagcctcaccctgaacctgatcacagagatgggccgcctccccacctttatgacgcagaaggcccggaatgctcttgacaacctggccgtcctgcacaccgctgaagccggaggcagagcctacaatcatgctctctccgagctgccggagacacttgaaaccctgctcctgctgacactccttgcgaccgtgacagggggaattttcctgtttctgatgagcggcaaggggatcggaaaaatgaccctcggcatgtgctgcatcattacggcctctatcctgctttggtatgctcaaattcagcctcactggatcgccgcctccattatcctggagttctttctcatcgttctgctgattcccgaacccgagaagcagcggacacctcaggataaccaactcacctacgtggtgatcgctattcttaccgtcgttgccgcgacaatggccaatgaaatgggcttcctggagaaaaccaagaaagactttgggttcggaagcatcgctacacagcagccggagtccaacattctggatatcgacctccgccccgcctctgcttggacgctgtatgccgtggcgaccacatttatcacccctatgcttagacacagcattgaaaattcctctgtgaacgtcagcctgacagccatcgctaatcaggccaccgtgctcatgggcctggggaagggatggcccctgtccaagatggacattggcgttcctctccttgctatcgggtgttacagccaagtgaaccccattacgctgaccgccgctctgctcctgcttgtcgcccattacgcgatcattggacctggcctgcaggccaaagctacacgggaggcccagaagcgcgctgccgccggcatcatgaaaaatccgaccgtggatgggatcacagtcattgacctcgatcccatcccttatgaccccaagttcgaaaaacagctgggacaagtgatgctgctcgttctttgcgtgacccaggtcctgatgatgagaacgacatgggcgctgtgtgaggctctcaccctggccacaggccctatttctaccctttgggaagggaaccccggacggttttggaataccacaatcgctgtgtccatggccaacattttccgcggcagctacctggccggggctggactcctgttttctatcatgaagaacacgaccaatacaagacggggcaccggcaacacaggggagaccctgggagagaagtggaaaaatcgcctcaactcccttggcaagagcgagttccagatctataaaagatctgggattcaagaggttgatcggacgctggccaaggaaggaatcaaaagaggcgagacagaccaccatgcggtgagccgcgggtccgccaagctgcggtggttcgtcgagagaaatctcgtgaccccggaaggaaaagtgatggatctgggctgcggccgcgggggatggtcttactattgtggcgggcttaagaacgttcgggaggtcaagggactgaccaaaggcgggcctggacacgaagaacccattcccatgagcacatacggctggaatctcgtgagactgcagtccggcgtggacgtctttttcacccctcccgaaaagtgcgatacactgctctgtgacatcggggagagctcccctaacccgacggttgaggctggacgcacccttcgggtgctgaatctggtggaaaactggctcaataacaatacacagttttgcattaaagtcctgaacccctatatgccttctgtgatcgagaagatggaaacccttcagagaaaatacggcggggccctggttcgcaatcccctcagccggaactccacacatgagatgtactgggtgtctaacgctagcggaaatatcgtctcctctgtgaacatgattagcagaatgctgatcaatcgcttcaccatgcggcacaagaaggccacgtatgaacctgatgttgacctgggctccgggaccagaaacattggaatcgagagcgagacacccaatctcgatattatcggcaaacgcatcgaaaagattaaacaagagcacgaaacctcttggcattacgaccaggaccacccgtataagacatgggcgtaccatggctcctatgagaccaaacagacagggagcgcctcttccatggtgaacggagtcgtgagacttctgaccaagccttgggatgtgatccccatggtcacgcagatggctatgacagacaccaccccttttggccaacagcgggttttcaaggaaaaagtggatacacgcacgcaggagcccaaggaggggaccaaaaagctgatgaaaattacagccgaatggctctggaaggagctgggaaagaaaaagacccctagaatgtgtacacgggaagagtttaccagaaaagtgcggagcaatgctgcccttggcgctatcttcacagacgagaacaagtggaaatctgcccgcgaagcggtcgaggattccagattttgggaactggtggacaaggagcggaatctccacctggaagggaaatgcgagacctgtgtttacaacatgatgggaaagcgcgagaagaaaatgggcgagttcggcaaggccaaagggagcagagctatttggtatatgtggctgggagcccggtttctcgagttcgaagctctgggctttcttaatgaggatcactggttctcccgcgaaaacagcctgtctggggtggagggagagggcctccataagctggggtacatccttagagaagtcagcaaaaaggagggcggagccatgtacgccgacgatacggcgggctgggacacccggattacactggaagatctcaagaatgaggaaatggtgaccaaccacatggagggggagcataaaaagctggctgaagccatcttcaaactgacatatcagaataaggttgtgcgcgtccaaagacccaccccgcggggaacggtgatggacatcatttcccgcagagaccagcggggctctgggcaggttggaacatacggcctcaacacctttacaaacatgggggcccaactgatccgccagatggagggcgaaggagtgttcaaaagcattcagcaccttaccacgaccgaggaggtcgctgtgcaggattggctggccagagtcggccgggaaagactctcccgcatggctatctctggggacgattgcgtggttaagcctctggacgatcggtttgccagcgcgcttacagccctgaatgacatgggaaaggtgagaaaagatattcaacagtgggagccctcccgcggctggaacgactggacccaggtccccttctgctctcatcactttcacgaactcatcatgaaggatgggcgggtgctggtggttccttgtagaaatcaggacgagctgatcggacgcgctcggattagccaaggcgccgggtggtccctcagagaaacagcttgcctgggcaaaagctatgcccagatgtggtctcttatgtacttccatcgccgggatctgagactcgcggccaacgctatctgttccgccgtgccgagccactgggtccccacctctcgcacaacctggtccattcatgctcggcacgagtggatgacgacagaggacatgctgaccgtgtggaatagagtttggatccaggaaaacccttggatggaggataagacccccgtggaaagctgggaggaaattccttatcttggaaaacgggaggaccagtggtgcggctccctgatcgggctcacatctagagccacctgggctaagaatatccaaacagccattaaccaggtccgcagcctgatcggatccgaggaatacacggactatatgcccagcatgaagcggtttagacgcgaggaagaggaagcgggcgtgctgtggtga

SEQ ID NO: 20232 - RNA, 9876 nt, synthetic construct
  misc_feature 1..9876: note = derived and/or modified CDS sequence (opt5) from DENV-2__KJ918750__SS-prME
  source 1..9876: mol_type = other RNA
accgccggcatgatcattatgctgatccccacagtgatggctttccacctgacgaccagaaatggggagcctcatatgattgttagccggcaggaaaaggggaaatccctgctttttaagacaaaagacggcaccaatatgtgcacactgatggccatggatctcggggagctgtgtgaagacaccatcacatacaagtgcccgttccttcgccagaacgagcccgaagatattgactgttggtgcaattctaccagcacgtgggttacctatggaacatgtaccacaaccggcgagcacagacgggagaaacgctccgtggcgctggtgcctcatgtcgggatgggactcgaaacgagaacagagacctggatgtctagcgaaggcgcttggaagcacgcccagcggatcgagatctggattctgcgccatcccggctttacaatcatggccgctattctggcctacaccatcgggaccacacacttccagagagtgctcatttttatcctgcttacggctattgccccttccatgaccatgcggtgcatcggaatctctaaccgcgatttcgttgagggcgtgagcgggggatcctgggtcgacattgtgctggaacacggcagctgtgttacaaccatggcgaagaataaacccacactcgattttgagctgatcaagaccgaagccaaacagcctgctacgcttagaaagtattgcattgaggccaaactgacaaacaccaccacagactctcggtgtccgacccaaggggaacccacactcaatgaggagcaggataagcgcttcgtgtgcaagcattccatggtcgacagaggatggggcaacggctgtgggctgtttggaaaaggcgggatcgtgacgtgcgctatgttcacatgcaagaaaattatgaagggaaaaatcgtgcagcctgaaaatctggagtacacagtcgttatcacaccccacagcggcgaagaacatgccgtggggaacgatacaggaaagcacggcaaagaagtgaagattacccctcagtcttccatcacggaggcggagctcaccggctatgggacagtcaccatggaatgtagcccccggacaggactggactttaatgagatggtgcttctgcaaatggaagataaggcctggctcgttcaccgccagtggttcctggaccttccgctgccttggctccccggcgctgacacccaggggtctaactggattcagaaagagacgctggtgacatttaagaatcctcatgccaaaaagcaagatgtcgtggttctgggatcccaggaaggcgctatgcacaccgccctcacaggggccaccgagatccagatgagctccggcaacctgcttttcaccggacatctgaaatgcagactccggatggacaagctgcaacttaagggcatgtcttacagcatgtgtacagggaaattcaaggtggtcaaagagattgctgaaacgcagcacggaaccatcgtgatcagagtccagtatgagggcgatgggtccccctgcaagattccctttgaaatcatggacctggagaaacgccatgtgctcggacggctgattacagttaatcctatcgtgaccgagaaggatagcccggtcaacattgaagcggagccccctttcggcgactcttacatcattatcggggtggaacccggccagctgaagctcaactggtttaaaaagggatccagcatcggccaaatgctggagacaaccatgagaggggccaaacgcatggctattcttggagatacggcctgggacttcggctctctcggcggggtttttacaagcatcgggaaggccctccaccaggtgttcggggctatttacggcgccgcgttttccggagtctcttggaccatgaaaatcctgaccggcgtgattatcacatggatcgggatgaatagccggtccaccagcctgtctgtgtcccttgttctcgtcggaattgtgacactgtatctgggcgtgatggtccaggctgatagcgggtgtgtggtttcttggaagaacaaggaactcaaatgcggatccggcatcttcgtgacggacaatgtccacacctggacagagcagtacaagtttcaacctgagagcccctccaaactggcctctgccattcagaaggctcatgaagaggggatctgtggcattagaagcgtgacccgccttgaaaacctgatgtggaaacagatcacaccggagctcaatcacatcctgtccgaaaacgaggttaagctgaccattatgacgggagatatcaaaggcattatgcaagtggggaagcggtctcttagacctcaacccaccgagctccgctatagctggaagacatggggaaaagccaagatgctgtccaccgaactgcataatcagacattcctcatcgacggccctgagaccgctgaatgccccaacacaaatcgggcctggaacagcctggaggtcgaagactacgggtttggagtgttcaccacgaatatttggcttagactgcgcgagaaacaggatgtcttttgtgactctaagctcatgtccgcggccatcaaagataaccgggctgtgcacgccgacatgggctattggatcgagagcgctctgaatgatacatggaagattgaaaaggcctctttcatcgaggtcaaatcctgccactggcctaagagccataccctgtggtctgacggcgtgcttgaaagcgagatggtgattcccaaaaacttcgcggggccggtctcccagcacaataacagacctggataccatacccaaacagccggcccctggcacctcgggaagctggagatggattttgacttctgtgaaggaaccacggttgtggtgacagaggattgcggcaaccgggggcccagcctgcgcaccacaaccgcttctggaaaactcatcacagaatggtgctgtagatcctgcaccctgcctccgcttcggtatagaggcgaggacggctgttggtacgggatggaaattcgccccctgaaggagaaggaggaaaatctcgtcagctccctggtgacggccggacatggccagatcgataacttttctctggggattcttggaatggctctcttcctggaggaaatgctgcggaccagagttggcacaaaacacgccatcctcctggtggccgtcagctttgtgacccttatcacagggaatatgtccttccgcgacctgggaagagttatggtgatggtcggcgctaccatgacggatgacattggcatgggggtgacatacctcgcgctgctggccgcttttaaggttcggcctaccttcgccgccggacttctgctccgcaaactgacatctaaggagctcatgatgaccaccatcggcattgtgctgcttagccagtcctctatccccgaaacaattctggagctcacggacgctctggccctggggatgatggtccttaaaatggtgagaaacatggagaagtatcaactggcggtgaccatcatggctatcctctgcgtccctaatgccgttattctgcagaacgcctggaaggtgagctgtacaatcctcgctctggtgtccgtcagccccctttttctgacctcttcccagcagaaagccgattggattcctctcgcgctgacaatcaagggactgaatcccaccgctattttccttacgacactgagccggacctctaaaaagcgctcctggccgctcaacgaagccatcatggccgtgggcatggttagcatcctggcttcttccctcctgaaaaatgacattcctatgaccgggccccttgtggccggaggcctgctgacagtctgctacgtgctcaccggcagaagcgctgatctggagcttgaacgggccgcggacgttaagtgggatgaccaagccgagatctccgggagctctcctattctgagcatcacaatttccgaagatggatctatgagcatcaaaaacgaggaggaagaacagacgctcaccattctgatccgcacaggcctcctggtgatctccgggctttttcccgtctctattccgatcaccgctgccgcttggtatctgtgggaagtgaagaagcagagagccggagtcctgtgggacgtgccttctccccctcccgttggcaaagccgagctcgaggatggggcttaccggattaagcagaaaggaatcctgggctattcccaaattggcgcgggggtgtacaaggaaggaacattccacaccatgtggcatgtcacgcgcggcgccgtgcttatgcacaaagggaagagaatcgagccctcctgggctgacgttaagaaagatctgatcagctatggaggcgggtggaagctcgaaggagagtggaaagaaggcgaggaggtgcaggtcctggccctcgaacctggcaagaatccgcgggccgtgcagaccaaacccgggctgtttaagacaaacaccggaacaattggcgctgtgtcccttgacttcagccctgggacctctggatcccccatcgttgataagaaaggcaaggtcgtggggctgtacggaaatggcgtggtcacaagaagcggcgcctacgtgtctgcgattgctcagacggagaaatccatcgaagacaaccctgagattgaagacgatatcttccgcaagcggagactgaccatcatggacctccatcccggggccggaaaaacaaagcgctatctgcctgccattgttcgggaggctatcaagagaggccttcgcaccctgattctcgccccgacccgggtggtcgcggctgagatggaagaggccctgagagggctccccatccgctaccaaacccctgccattcgggctgaacacacgggaagagagatcgtggatctgatgtgtcatgccacctttacaatgcggcttctgagccccattcgcgttcctaattataacctgatcatcatggacgaagctcacttcaccgatcccgcctccattgcggccagaggctacatctctacacgggtggagatgggggaggctgccggcatttttatgaccgctacgccgcctggaagccgcgaccccttcccccagtccaacgcccctatcatggatgaagagagagaaattcccgagcggagctggaactctggccacgagtgggtcacagactttaaagggaagaccgtgtggttcgttccttccatcaaaaccggaaacgatatcgccgcttgcctcagaaagaatggcaaacgcgtgattcagctgagccggaagacatttgactctgaatatgtcaagaccagaacaaacgattgggacttcgtggtgaccacggacatcagcgagatgggggcgaattttaaagccgaacgcgtcattgatccgcggagatgtatgaagcccgttatccttacagacggagaggaacgcgtgattctggctggccctatgcccgtgacccattcctctgccgcccaacggagagggcgcatcggcagaaaccctaaaaatgagaacgatcagtacatctatatgggagagcccctcgaaaatgacgaggattgcgctcactggaaggaagccaaaatgctgctggacaacattaatacaccggagggcatcattcctagcatgttcgaacccgagcgggagaaggtcgatgcgatcgacggggaataccgcctcagaggagaggctcggaaaacctttgtggatcttatgcgcagaggcgacctgcctgtttggctggcctacaaggtggccgctgaagggattaactatgccgatcggagatggtgtttcgacggaacgcgcaataaccagatcctcgaggaaaatgtcgaggtggagatttggaccaaggaaggcgagcggaaaaagctgaaacccagatggcttgatgcgcgcatctactccgaccctctggccctcaaggagttcaaagagtttgctgccgggcggaagtctctgacactgaacctcatcaccgagatgggcagacttcccacattcatgacccagaaggctcgggacgccctggataacctggctgttctccatacagccgaagcgggaggcaaagcctataatcacgctctgagcgagcttccggaaaccctggagacgctcctgctgctcacacttctggccaccgtgaccgggggaatttttctgttcctcatgtccggccgcgggatcggaaagatgacactgggcatgtgctgcattatcaccgctagcattcttctgtggtgtgcccaaatccagcctcactggatcgccgcttctattatcctcgaatttttcctgattgtcctgctcatccccgagcccgagaaacagagaacacctcaggacaaccaacttacgtacgtgattatcgcgatcctgaccgtcgtggccgctacaatggccaatgaaatgggctttctggagaagaccaaaaaggatctcgggctgggaaacattgttacacagcagccggaatccaatatccttgacattgatctgcggcccgccagcgcttggaccctctatgccgtggcgacgaccttcatcacacctatgctgcgccattccattgagaactctagcgtgaatatgtccctgaccgccatcgctaaccaggccacagtcctcatgggccttgggaagggatggcccctgtctaaaatggacattggcgttcctctgctcgctatcgggtgctgtagccaagtgaatcccatcaccctgacggccgcgctttttctgctcgtggcccactacgctattatcggacctggcctgcaggccaaggctacaagagaagcccagaaacgggctgccgcgggcattatgaagaacccgaccgtcgatgggatcacagtgattgacctggatcccatcccttatgaccccaaattcgagaagcagctcggacaagttatgcttctggtgctgtgcgtcacccaggtgctcatcatgcgcaccacatgggccctgtgtgaggctcttacgctggccaccggccctgtctccacactctgggaagggaatcccggaagattttggaacaccacaattgctgtgagcatggccaatatcttccggggctcttacctggccggggcgggactgctcttttgcattatgaacaataccacgcgccttagacggggcacaggccatctgagaaagaccctgggggataaatgtaagtcccgcctcaacaccctgggaaaaagcgagttccagatctacaagaaatctggcattcaagaagttgaccggacacttgctaaggaggggatcaaaagaggagaaaccgatcaccatgccgtgtcccgcggcagcgctaagctgcggtggttcgtcgagagaaatctcgtgacaccggaggggaaggttgtggacctgggatgcggccgcggcgggtggtcttattactgtggaggcctgaaaaacgtccgggaagtgaaggggctcacgaaaggaggccctgggcacgaggaacccatccccatgagcacctatggatggaaccttgtgagactgcagtccggcgttgacgtctttttcattcctcccgagaagtgcgatacactgctctgtgacatcggcgagtctagccctaatccgaccgtggaagccgggcgcacactgcgggtgcttaacctggtcgagaattggctcaacaataacacccagttttgcattaaagttctgaatccctacatgccttccgtgatcgaaaagatggagacgctgcagagaaagtatggaggcgccctcgtgcgcaacccccttagccggaatagcacccacgaaatgtactgggtctctaacgctagcgggaatattgtgtcctctgttaacatgatcagcagaatgctgatcaatcgcttcacaatgagacataaaaaggccacctatgagcctgatgtggacctgggatccggcacacggaacattgggatcgagtctgaaacccccaatctcgatattatcggaaaacgcattgagaagatcaaacaagaacacgagacaagctggcattacgaccaggatcacccgtacaagacctgggcgtatcacggctcctacgaaacgaagcagacaggcagcgcctcttccatggtcaacggggtggttagactgcttaccaaaccttgggacgtggtccccatggtgacccagatggctatgacagatacgaccccttttggacaacagcgggtgttcaaggagaaagtcgacacaagaacccaggagcccaaggaaggcaccaaaaagctgatgaagattaccgccgagtggctctggaaagaactggggaagaaaaagacacctcggatgtgcacccgcgaggaatttacgaaaaaggttagaagcaacgctgccctgggagcgatcttcaccgatgagaataaatggaagtctgcccgggaggctgtggaagacggccgcttttgggagctcgtggacaaggaaagaaacctgcatcttgaggggaaatgtgagacatgcgtctataatatgatgggaaagcgggagaaaaagctgggcgagttcggcaaagccaaggggtcccgcgctatctggtacatgtggctcggagccagatttctggagttcgaggctcttggctttctgaacgaagatcactggttcagccgggaaaattctctctccggggtggagggagaaggcctgcataagctggggtatattctccgcgaggttagcaaaaaggaaggcggagccatgtacgcggacgataccgccggctgggacacaagaatcaccattgaggatctgaaaaacgaagagatgatcacgaatcacatggctggggagcataagaaacttgccgaagctattttcaagctgacatatcagaacaaggtggtccgggtgcaacgccccaccccgagaggaacagttatggacatcatctcccggcgcgatcagagaggcagcggacaggtgggaacctacggcctcaatacgtttaccaacatggaggcccaactgattcggcagatggaaggggagggcatcttcaaatctattcagcaccttacagccaccgaagagatcgcggtccaggactggctggctagagtgggacgcgagcggctcagcagaatggccatttccggcgatgactgtgttgtgaagcctctggatgaccgctttgcccgggctctgacagccctcaatgatatggggaaagtcagaaaggacatccaacagtgggaaccctctcgcggatggaacgactggacccaggtgcccttctgcagccaccattttcacgagctgatcatgaaagatggccggacacttgtcgtgccttgtagaaatcaggacgaactgattgggcgcgctcggatctcccaaggagccggctggtctctcagagagaccgcgtgcctgggaaagagctacgcccagatgtggtcccttatgtatttccatcgccgggatctgagactcgctgccaacgctatttgttctgccgttccgagccactgggtgcccacgtcccggacaacctggagcatccacgcgtctcatgagtggatgaccacagaagacatgctgaccgtctggaatagagtgtggattcaggagaacccttggatggaagataagacacccgtggagtcctgggaagagatcccttacctgggcaaacgcgaggaccagtggtgcggaagcctcattggcctgacgtctcgggccacctgggctaagaacatccaaacagccatcaatcaggttagatcccttattgggaacgaagagtataccgattacatgcccagcatgaaacgctttagacgggaagaggaagaggctggagtgctgtggtga

SEQ ID NO: 20233 - RNA, 9876 nt, synthetic construct
  misc_feature 1..9876: note = derived and/or modified CDS sequence (opt5) from DENV-2__KU517845__SS-prME
  source 1..9876: mol_type = other RNA
accgccggaatcattatcatgatgattcccacagtgatcgctttccacctgacgaccagaaacggggagcctcatatgattgtcagccggcaggaaaaggggaaaagcctcctgtttaagacagagaatggcgttaacatgtgcacccttatggccatggacctgggggaactctgtgaggatacaatcacctacaattgcccgctgcttcgccaaaacgaacccgaggacatcgattgttggtgcaattctacaagcgcgtgggtgacctatggaacgtgtaccgctacaggcgagcacagacgggaaaaacgctccgtggccctggtccctcatgtggggatgggactcgagaccagaacagaaacctggatgtctagcgagggcgcctggaagcacgctcagcggattgagacgtgggttctgcgccatcccggcttcacaatcatggccgctattctggcctacaccatcgggacaacctattttcagagagtgctcattttcatcctgcttaccgcggtcacaccttccatgacgatgcggtgcattggaatctctaaccgcgactttgtggaaggcgttagcgggggatcctgggtggatatcgtcctggagcacggcagctgtgtgaccacaatggccaaaaataagcccaccctcgacttcgaactgattaagacagaggctaaacaccctgccacccttagaaagtactgcatcgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggattgttacctgcgcgatgtttacatgcaagaaaaatatggagggaaagatcgtgcagcctgaaaacctggagtatacgattgtgatcacaccccactctggcgaagagaatgccgtcgggaacgatacaggaaaacatggcaaggagatcaaagtgacccctcagtccagcattacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggatccagaaagagacactggtgaccttcaagaatcctcacgccaagaaacaggatgttgtggtcctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtggtcaaggagatcgccgaaacccaacatggaacaattgtgatcagagttcagtacgagggcgacgggagcccctgcaaaatccccttcgagattatggatctggaaaagcgccacgtgctcggacggctgatcacggtcaatcctattgtgaccgagaaagactctccggttaacatcgaagctgagcccccttttggcgattcctacattatcattggggtggaacccggccagctgaagctcagctggttcaaaaagggatctagcatcggccagatgtttgagacaaccatgagaggggccaagcgcatggccatcctgggagacacagcttgggatttcggctcccttgggggagtctttacctctattggcaaagccctgcatcaagtgttcggggcgatctatggcgctgcctttagcggagtgtcctggacgatgaagattctcatcggcgttgtcattacatggatcgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcattacagataatgtgcacacctggacagaacagtataagtttcagcctgagtctcccagcaagctcgcttccgccatccaaaaagctcacgaagaggggatttgtggcatcagatctgtcacgcgcctggaaaaccttatgtggaagcagattaccccggagctgaatcatatcctcagcgagaacgaagtgaaactgacaatcatggccggagacattaagggcatcatgcaggcggggaaacggtccctgagacctcagcccaccgagcttaagtacagctggaaagcctggggaaaggctaagatgctctctacagaactgcacaatcataccttcctgattgatggccctgagacggccgaatgccccaacaccaatcgcgcttggaactccctcgaggttgaggactatgggtttggagtgttcacaaccaatatctggctgaaacttaaggaacggcaagatgccttttgtgacagcaaactgatgtctgcggccattaaggacaacagagctatccacgccgatatgggctactggatcgagtccgctctcaacgacacatggaaaattgaaaaggccagcttcatcgaggtcaagtcttgccactggcctaaaagccataccctgtggtccaatggcgtgctggagagcgaaatgattatccccaagaacttcgccgggccggtgtctcagcacaattatcgccctggataccatacacagaccgctggcccctggcaccttgggcggctcgagatggattttgacttctgtgaaggaacgacagtcgttgtgaccgaggattgcggcaacagagggccctccctgcggaccacaaccgcgagcggaaaactgattacggaatggtgctgtcgctcctgcacactccctccgctgagataccggggcgaggacggctgttggtatgggatggagatcagaccccttaaggaaaaagaggaaaatctggtgaactctctcgtcaccgccggacatggccagattgataattttagcctgggggtgctgggaatggctcttttcctcgaggaaatgctgcgcacacgggttggcaccaagcacgccatcctgctcgtggccgtctcctttgtgacactgatcaccgggaacatgtctttcagagaccttggacgcgttatggtgatggtcggcgctacgatgaccgatgacattggcatgggggtgacatacctggccctcctggcggcttttaaggttagacctaccttcgccgccggactgcttctgcggaaactcacaagcaaggagctgatgatgaccacgatcggcattgtgctcctgtcccaatctacaatccccgagaccattcttgaactgacagatgctctcgccctggggatgatggtcctgaaaatcgtgcgcaatatggagaagtatcagcttgcggtgaccatcatggctattctgtgcgtccctaacgccgttatcctccagaatgcctggaaagtgagctgtaccacactggctgtggtctccgtgagccccctcctgcttacgtcttcccaacagaaggccgactggattcctctggttctcaccatcaagggactgaaccccacagctatttttctgaccacacttagcagaacctctaaaaagcggtcctggccgctgaatgaagccatcatggcggtgggcatggtcagcatcctcgcctcttccctgctcaaaaacgatattcctatgacggggcccctggtggctggaggccttctgacagtttgctacgtgctgaccggccgcagcgccgacctcgagctggaaagagctgccgacgtccggtgggaggagcaggccgaaatctccgggagctctcctattcttagcatcaccgtgtccgaggatggatctatgagcattaagaatgaagaggaggaacagacactgaccatcctcattcgcacaggcctgctcgtcatctccgggctgttccccgtgtctatcccgattacggctgcggcctggtatctttgggaggttaaaaagcaaagagctggagtgctgtgggacgtcccttctccccctcccgtgggcaaagccgaactggaggatggggcctaccggatcaagcagaagggcattctcggctattcccagatcggcgctggggtttacaaagaaggaacctttcacacaatgtggcatgtgacccgcggcgccgtcctgatgcacaaggggaaaagaattgagccctcctgggcggacgtgaagaaagatcttatcagctacggaggcgggtggaagctggagggagaatggaaggagggcgaagaggtgcaggttctcgctctggaacctggcaaaaacccgcgggccgtccaaacaaagcccggactcttcaaaaccaacacgggaaccatcggcgccgtgtccctggactttagccctgggacatctggatcccccattgtggataagaaaggcaaggtcgtggggctttatggaaatggcgttgtgaccagaagcggcacatacgtctctgctatcgcccagaccgagaagtccattgaggacaaccctgaaatcgaggatgacattttccgcaaaaagcggctgacaatcatggatctgcatcccggggcgggaaaaacgaagagatatctccctgctatcgtgcgcgaagccattaaacggggcctgagaacccttatcctggccccgacacgcgttgtggctgccgagatggaagaggctctccgggggctgcccattagataccagacccctgccatccgcgcggagcacaccggacgggaaattgtcgacctcatgtgtcatgccacattcacgatgagactgcttagccccatccgggtgcctaattataacctgattatcatggatgaggctcactttaccgaccccgcctccatcgctgcccgcggctacatttctacaagagttgaaatgggggaggccgctggcatcttcatgaccgcgacaccgcctggaagccgggacccctttccccagtccaatgcccctattatggatgaggaacgcgagatccccgaaagaagctggaactctggccacgagtgggtgaccgacttcaaggggaagacggtctggtttgtgccttccattaaagctggaaatgatatcgccgcctgcctgcggaagaacggcaaaaaggtgatccaactcagcagaaaaacattcgactctgaatatattaagacccgcaccaatgattgggactttgtcgttacaaccgatatcagcgagatgggggctaacttcaaggccgagcgggtgattgacccgagacgctgtatgaaacccgtgatcctgacagatggagaagaacgggtcattcttgcgggccctatgcccgtgacccattcctctgctgcccagagacgcgggcgggttggcagaaatcctaagaacgaaaatgaccagtacatctacatgggagagcccctggaaaacgatgaggactgcgcccactggaaagaggctaagatgctcctggacaatatcaacacgccggaaggcattatccctagcatgtttgagcccgaacgcgagaaagtggatgccattgacggggaatatagactgcggggagaggcgcgcaagacattcgtcgatctcatgagacggggcgaccttcctgtgtggctggcctaccgcgttgctgccgaggggatcaactatgctgatagacggtggtgttttgacggagtgaaaaataaccaaattctggaagagaatgtcgaagtggagatctggaccaaggagggcgaaagaaagaaactcaagccccgctggctggatgcccggatttactccgaccctcttgctctgaaagagttcaaggagttcgccgcggggagaaaatctctcacactgaacctgatcaccgagatgggccgcctccccacgtttatgacccagaaggcccggaatgctcttgataacctggccgtcctgcatacagctgaagccggaggcagagcctataatcacgctctcagcgagctgccggagacccttgaaacactgctcctgctgaccctccttgcgacagtgaccgggggaatcttcctgtttctgatgtccggcaaggggattggaaaaatgacgctcggcatgtgctgcatcattacagccagcatcctgctttggtacgctcagattcagcctcactggatcgccgcctctatcattctggagttctttctcatcgttctgctgattcccgaacccgagaagcaacggacccctcaggacaaccagctcacctatgtggtgatcgctattcttacagtcgttgccgcgaccatggccaatgaaatgggcttcctggagaaaacaaagaaagattttgggctgggatccatcgctaaccagcaaccggagagcaatatcctcgacattgatctgcgccccgcctccgcttggacgctttacgccgtggcgaccacattcatcacccctatgctgagacattctattgaaaacagctccgtgaatgtctctctcacagccatcgctaaccaggccaccgtgctgatgggcctggggaagggatggcccctcagcaagatggacattggcgttcctcttctggctatcgggtgttactcccaggtgaatcccattacgctgaccgccgctctcctgcttctggtcgcccactatgcgatcatcggacctggcctccaggccaaagctacacgggaggcccaaaagcgcgctgccgccggcattatgaaaaacccgaccgtggacgggatcacagtcattgatctggaccccatcccttacgatcccaagtttgaaaaacagctgggacaggtgatgctccttgttctgtgcgtgacccaggtcctgatgatgagaacgacatgggcgctctgtgaggctctgacccttgccacaggccctattagcaccctgtgggaagggaatcccggacggttctggaacaccacaatcgctgtgtctatggccaacatctttcgcggctcctatctcgccggggctggactgctgttcagcattatgaagaatacggccaacaccagacggggcacaggcaataccggggagacactcggagagaagtggaaaaaccgccttaatgcgctgggcaagtctgaatttcaaatctacaaaaagtccgggattcaggaggttgacagaaccctggccaaagaaggaatcaagcggggcgagacggatcatcacgctgtgagcagagggtctgccaaactccgctggttcgtcgagcggaacctggtgacaccggaaggaaaggtggttgaccttggctgcggcagagggggatggagctattactgtggcgggctgaagaatgtcaaagaggtgaagggactcaccaaaggcgggcctggacatgaggaacccattcccatgtccacctatggctggaacctggtgcgcctgcagtctggcgtcgatgttttctttacacctcccgaaaagtgcgacaccctcctttgtgatatcggggagagctcccctaatccgacagtggaggctggacggacgctgagagtgctgaacctcgtcgaaaattggctgaacaataacacccaattctgcatcaaagtgcttaatccctacatgcctagcgttattgagaagatggaagccctgcagcgcaagtacggcggggcgctcgtgcggaaccccctgtccagaaactctacacacgagatgtattgggtcagcaatgcctccggaaacatcgtgtctagcgttaatatgatttcccgcatgctgatcaaccggtttaccatgagacacaaaaaggctacatacgaacctgacgtggatctcggctctgggacccgcaatattggaatcgagagcgagacgcccaaccttgacatcattggcaaacggatcgaaaagattaaacaggagcatgaaacctcctggcactatgatcaggaccatccgtacaagacatgggcctatcacggcagctacgagaccaagcaaacagggtctgcttccagcatggtcaatggagtggtgagactgctgaccaaaccttgggacgtcatccccatggttacacagatggccatgaccgatacgacacctttcggccagcagcgcgtgtttaaggaaaaagtggacaccagaacccaagagcccaaggaggggaccaagaagattatgaagatcacggctgaatggctctggaaagagctgggaaagaaaaagacccctcggatgtgtacacgcgaagagttcaccagaaaagtccggtctaacgccgcgcttggcgccatttttacagatgagaataagtggaaatccgctagagaagccgtggaggacagcgggttctgggaactggttgataaggagcggaacctccacctggaaggaaagtgcgagacctgtgtgtataatatgatgggcaaacgcgagaagaaactgggcgaatttgggaaggctaaaggatctagagccatctggtacatgtggctcggcgcccggttcctggagtttgaagcgcttgggttcctgaacgaggaccattggttttcccgcgaaaatagcctctccggagtcgagggcgaggggctgcacaaacttggctacatcctgagagatgtgagcaagaaagaaggaggcgctatgtatgccgacgatacagccgggtgggacacccggattacgctcgaggatctgaagaacgaagagatggttacctctcatatgaaaggagaacaccgcaagctggctgaggccatcttcaaactcacataccagaataaggtggtcagagtgcagcggcccaccccgcgcggcacagttatggacattatcagcagacgggaccagcgcgggtccggacaagtggtcacctatggcctgaacacgttcacaaacatggaggctcagcttattagacagatggaaggggagggcgtgtttaagtctatccaacagctgaccgtcacagaagagatcgccgtgaaaaattggctcgttcgggtgggacgcgagagactgagccggatggcgatttccggcgatgactgcgtcgtgaagcctcttgatgacagattcgcctctgctctgaccgccctcaacgatatggggaaagtgcgcaaggacatccagcagtgggaacccagccggggatggaatgattggacgcaagttcccttttgctcccatcacttccacgagctgattatgaaagacggcagagtgctggtcgtgccttgtcgcaaccaggatgaactcatcgggcgggctagaatttctcagggagccggctggagcctgcgcgagaccgcgtgccttgggaagtcctacgcccagatgtggagcctgatgtattttcatcggagagacctccgcctggctgccaatgctatctgttctgccgttccgtcccactgggtgcccacaagccggaccacatggtctatccatgctacccacgaatggatgacaaccgaggatatgcttacggtctggaacagagtgtggattcaagagaatccttggatggaagacaagacacccgtcgagtcctgggaagagatcccttacctgggcaaacgcgaagatcagtggtgcggaagcctcattggcctgacctcccgggccacctgggcgaagaacatccagacagccattaatcaggtgagatctctgatcgggaacgaggagtataccgactacatgcccagcatgaaacggttcagacgcgaagaggaagaggctggagttctctggtga

SEQ ID NO: 20234 - RNA, 9876 nt, synthetic construct
  misc_feature 1..9876: note = derived and/or modified CDS sequence (opt5) from DENV-2__KU517847__SS-prME
  source 1..9876: mol_type = other RNA
accgccggaatcattatcatgatgattcccacagtgatggctttccacctgacgaccagaaacggggagcctcatatgatcgtcagccggcaggaaaaggggaaaagcctcctgtttaagacagagaatggcgttaacatgtgcacccttatggccatggacctgggggaactctgtgaggatacaattacctacaattgcccgctgcttagacaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcacagagaacgaagtgaaactgaccatcatgacaggagacatcaagggcattatgcaggccgggaaacggagcctgagacctcagcccaccgagcttaagtactcctggaaagcgtggggaaaggccaaggttctcagcacggaactgcacaatcataccttcctgatcgatggccctgagacagctgaatgccccaacaccaatcgcgcctggaactctctcgaggtggaggactatgggtttggagtcttcacaaccaatatttggctgaaacttaaggaacggcaagatgtgtcctgtgacagcaaactgatgtctgctgccatcaaggacaacagagcggtgcacgccgatatgggctactggattgagtccgctctcaacgacacatggaaaatcgaaaaggccagctttatcgaggtcaagtcttgccactggcctaaaagccataccctgtggtccaatggcgttctggagagcgaaatgattatccccaagaacttcgctgggccggtgtctcagcacaattatcgccctggataccatacgcagacagccggcccctggcaccttgggcggctcgagatggatttcgacttttgtgaaggaaccaccgtggtcgtgacagagaactgcggcaatagagggccctccctgcggaccacgacagccagcggaaaactgattaccgaatggtgctgtcgctcctgcacactccctccgctgagataccggggcgaggatggctgttggtatgggatggagatcagaccccttaaggaaaaagaggaaaacctggttaattctctcgtgaccgctggacatggccagattgacaacttcagcctgggggtcctgggaatggcgctttttctcgaggaaatgctgcgcacacgggtgggcaccaagcacgccatcctgctcgttgctgtgtccttcgtcacgctgattaccgggaatatgtcttttagagatcttggacgcgtgatggttatggtgggcgccacaatgaccgacgatatcggcatgggggtcacatacctggccctcctggctgccttcaaggtgagacctacctttgcggctggactgcttctgcggaaactcacgagcaaggagctgatgatgacaaccatcggcattgtgctcctgtcccaatctacaatccccgagaccattcttgaactgaccgacgccctcgccctggggatgatggtcctgaaaatcgttcgcaacatggagaagtatcagcttgctgtgacaattatggccatcctgtgcgtgcctaatgcggtcatcctccagaacgcttggaaagtgagctgtacggccctggccgttgtgtccgtcagccccctcctgcttacctcttcccaacagaagacagattggattcctctggctctcaccatcaagggactgaatcccacagccattttcctgaccacgcttagcagaacatctaaaaagcggtcctggccgctgaacgaagctatcatggccgtgggcatggttagcattctcgcgtcttcctttctgaaaaatgacatccctatgaccgggcccctcgtggccggaggcctgcttaccgtctgctacgtgctgacaggccgcagcgctgatctggagctcgaaagagccgctgacatccggtgggaggagcaggccgaaatttccgggagctctcctatcctgagcattaccatctccgaggacggatctatgagcattaagaacgaagaggaggaacagacacttacgatcctgattcgcaccggcctcctggtcatctccggactcttccccgcctctatcccgattacagctgcggcctggtatctgtgggaggtgaaaaagcaaagagctggagttctttgggatgtgccttcccctcctcccgtcggccgggccgaactggaggacggggcctaccgcatcaaacagaagggcattctgggctattcccagatcggcgctggggtgtacaaggaaggaacctttcacacaatgtggcatgttaccagaggcgccgtgctcatgcacaaagggaagcggattgagccctcttgggcggatgtcaaaaaggacctgatcagctacggaggcgggtggaaacttgagggagaatggaaggagggcgaagaggtgcaagtgctggctctcgaacctggcaagaacccgagagccgttcaaacgaaacccgggctgttcaagaccaatacaggaaccatcggcgccgtctccctcgattttagccctgggacatctggatcccccattgtggacaaaaagggcaaagtggtcgggctgtatggaaacggcgtggttacccgcagcggcacatacgtgtctgctatcgcccagacggagaagtccattgaggataatcctgaaatcgaggacgatattttccggaagaaaagacttaccatcatggacctgcatcccggggcgggaaagacaaaacgctatctgcctgctatcgtccgggaagccattaagagaggcctccgcaccctgatccttgccccgacccgggtggttgctgccgagatggaagaggctctgagagggctccccattcgctaccagacacccgctatccgggcggagcacacgggaagagaaattgtggatctgatgtgtcatgccaccttcacaatgcggctcctgagccccatccgcgtccctaactataatcttattatcatggacgaggctcactttaccgatcccgcctccatcgctgccagaggctacatttctacacgggtggaaatgggggaggccgctggcatcttcatgaccgcgacgccgcctggaagccgcgacccctttccccagtccaacgcccctattatggacgaggaaagagagatccccgaacggagctggaactctggccacgagtgggttacagatttcaaagggaagaccgtgtggtttgtcccttccattaaggctggaaacgacatcgccgcctgcctgcgcaaaaatggcaagaaagtgatccaactgagccgcaagaccttcgattctgaatatattaaaacacggaccaacgactgggattttgtggtcacaaccgacatcagcgagatgggggctaatttcaaggccgagagagttattgatccgcgccggtgtatgaagcccgtgatcctcacggacggagaagagagagtgattctggcgggccctatgcccgtcacacattcctctgctgcccagcgccgggggagagtgggccgcaaccctaaaaatgaaaacgatcagtacatctacatgggagagccccttgaaaatgacgaggattgcgcccactggaaggaggctaaaatgctgctcgacaacatcaacaccccggaaggcattatccctagcatgtttgagcccgaaagagagaaggttgacgccattgatggggaatatcggctgcgcggagaggcgagaaaaacattcgtggacctgatgcggcgcggcgatctccctgtctggcttgcctacagagtggctgccgaggggatcaattatgctgaccggagatggtgttttgatggagttaagaacaatcaaattctggaagagaacgtggaagtcgagatctggaccaaagagggcgaacgcaagaagctgaaaccccggtggctcgacgccagaatttactccgatcctctggctcttaaggagttcaaagagttcgccgcggggcgcaagtctctgacgctcaatctgatcaccgagatgggccggctgcccacatttatgacccagaaagccagaaacgctctcgacaatcttgccgtgctgcatacagctgaagccggaggccgggcctataaccacgctctgagcgagctcccggagaccctggaaacacttctgctcctgaccctgctcgcgacggtcacagggggaatcttcctttttctgatgtccggcaaggggattggaaagatgaccctgggcatgtgctgcatcgtgaccgccagcattctcctgtggtacgctcagatccagcctcactggattgccgcctctatcatccttgagttctttctgattgttctcctgatccccgaacccgagaaacaacgcacacctcaggataatcagctgacctatgtggtgattgctatcctcacagtcgttgccgcgacgatggccaacgaaatgggcttccttgagaagaccaaaaaggactttgggctgggatccattacaacccagcaaccggagagcaatatcctggatatcgacctcagacccgcttccgcctggacactgtacgctgtggccaccacgttcattacccctatgcttcggcattctatcgaaaacagctccgtgaatgtctctctgacagcgattgccaaccaggctaccgtgctcatgggcctggggaaaggatggcccctgagcaagatggatatcggcgttcctctccttgccattgggtgttactcccaggtgaatcccatcacactgaccgctgccctgctcctgcttgtcgctcactatgccattatcggacctggcctgcaggcgaaggccacgcgcgaggctcagaaaagagccgctgccggcatcatgaagaacccgacagtggacgggattaccgtcatcgacctcgatcccattccttacgaccccaaatttgaaaagcagctgggacaggtgatgctgctcgttctttgcgtgacacaggtcctgatgatgcggaccacctgggccctgtgtgaggcgctcacactggctacgggccctatcagcaccctttgggaagggaatcccggacgcttctggaacacaaccattgccgtgtctatggctaacatctttagaggctcctatctggccggggccggactcctgttcagcatcatgaaaaatacagctaacacccggcgcggcacgggcaatacaggggagaccctgggagagaagtggaagaacagactcaatgcccttggcaaatctgaatttcaaatttacaagaaatccgggatccaggaggttgatcggaccctggcgaaggaaggaattaaaagaggcgagacagaccatcacgccgtgagccgcgggtctgctaagctgcggtggttcgtcgagagaaacctcgtgaccccggaaggaaaagtggttgatctgggctgcggccgcgggggatggagctattactgtggcgggcttaagaatgtcaaggaggtgaaaggactgacaaagggcgggcctggacatgaagaacccatccccatgtccacgtatggctggaacctcgtgcggctgcagtctggcgtcgacgttttctttacccctcccgaaaaatgcgatacactgctctgtgacattggggagagctcccctaatccgaccgtggaggccggaagaacacttcgcgtgctgaacctggtcgaaaattggctcaacaataacacccaattctgcatcaaggtgctgaatccctacatgcctagcgttatcgagaaaatggaagcccttcagcggagatacggcggggccctggtgcgcaatcccccttcccggaactctacgcacgagatgtattgggtcagcaatgcgtccggaaacattgtgtctagcgttaatatgatctccagaatgctcattaaccgctttaccatgcggcacaagaaggccacatacgaacccgatgtggacctgggctctgggaccagaaatatcggaattgagagcgaggtcccgaacctggatatcatcggcaaacgcattgaaaagatcaaacaggagcatgaaacatcctggcactatgaccaggatcatccttacaagacctgggcttatcacggcagctacgagacaaaacaaaccgggtctgcctccagcatggtgaatggagtggtcagactccttacgaagccctgggacgttattcctatggtgacacagatggctatgaccgacaccacacccttcggccagcagcgggtgtttaaggaaaaagtcgatacgcgcacccaagagcctaaggaggggaccaaaaagctgatgaaaatcaccgccgaatggctgtggaaggagctcggaaagaaaaagacacccagaatgtgtacccgggaagagttcacaagaaaagtgcggtctaacgctgccctgggcgcgatttttaccgacgagaataagtggaaatccgcccgcgaagctgttgaggatagcgggttctgggaacttgtggacaaggagagaaacctgcacctcgaaggaaaatgcgagacgtgtgtctataatatgatgggcaagcgggagaagaaactgggcgaatttgggaaggccaaaggatctcgcgctatctggtacatgtggctgggcgccagattcctcgagtttgaagccctggggttccttaacgaggatcattggttttcccgggaaaatagcctgtccggagtggagggcgaggggctccacaagctgggctacattcttcgcgacgttagcaaaaaggaaggaggcgcgatgtatgctgatgacaccgccgggtgggatacaagaatcaccctggaggacctcaagaacgaagagatggtgacaaatcatatggaaggagagcacaaaaagctggccgaggctatcttccggctgacctaccagaacaaagtcgtgcgcgttcagagaccgacgcctcggggcacagtgatggatattatctctcgcagagaccagcgggggagcggacaagtcgtgacctatggcctcaacacattcaccaatatggaagcccagctgattcgccagatggagggggaaggcgtctttaagtccatccaacatcttacggctaccgaggagattgccgtgaaaaactggctggttagagtgggacgggaaagactctctcgcatggcgatcagcggcgacgattgcgtcgtgaagcccttcgacgatcggtttgccaatgctctgacagcccttaacgacatggggaaggtgagaaaagatatccagcagtgggagccctcccgcggatggaatgactggacccaggttcctttctgctctcaccactttcatgaactgattatgaaggatggccgggtgctcgtcgtgccgtgtagaaaccaagacgagctgatcgggcgcgctcggattagccagggagccggctggtccctgagagaaacagcgtgcctcgggaaatcttacgcccagatgtggagcctgatgtatttccaccgccgggatcttagactggctgccaatgctatctgttccgccgttcccagccattgggtgcctacctctcgcacaacctggtccattcacgctacgcacgagtggatgacaaccgaggacatgctcaccgtctggaaccgggtgtggatccaggaaaatccctggatggaggataagacacctgtcgaaagctgggaggaaatcccctacctgggcaaaagagaggaccaatggtgcggatctcttattggcctgacctcccgggccacatgggcgaagaacatccagacggccattaatcaggtgagaagcctcatcgggaacgaggaatataccgattacatgccttccatgaagcgctttcggagagaggaagaggaagctggagttctgtggtga

SEQ ID NO: 20235 - RNA, 9876 nt, synthetic construct
  misc_feature 1..9876: note = derived and/or modified CDS sequence (opt5) from DENV-2__JQ955623__SS-prME
  source 1..9876: mol_type = other RNA
accgccggcatgatcattatgctgatccccacagctatggccttccacctcacgaccagaaacggggagcctcatatgattgtgagccggcaggaaaagggaaaatccctgctttttaagacagaggacggcgtcaatatgtgcaccctgatggcgatggatctcggggaactgtgtgaggacacaatcacctacaactgcccgcttctgcgccaaaatgaacccgaggatattgactgttggtgcaactctacaagcacctgggttacgtatggaacctgtacagctaccggcgagcacagacgggaaaaacgctccgtggccctcgtgcctcatgtcgggatgggactggagacaagaaccgaaacgtggatgtctagcgagggcgcctggaagcacgctcagcggatcgagacatggatcctgcgccatcccggcttcaccattatggccgctatcctcgcctacacaattgggaccacccactttcagagagtgctgatcttcattcttctgacagcggttgccccttccatgacgatgcggtgcatcggaatttctaatcgcgattttgtggaaggcgtcagcgggggatcctgggtggacatcgttctcgagcacggcagctgtgtgaccacaatggctaaaaacaagcccaccctggatttcgaacttatcaagacagaggccaaacagcctgctaccctgagaaagtattgcattgaagccaaactcacgaatacaaccaccgcgtctcggtgtccgacacaaggggagccctccctgaacgaggaacaggacaagcgctttgtctgcaaacatagcatggtggatagaggatggggcaatggctgtgggctgttcggaaagggcgggatcgtgacctgcgccatgtttacatgcaagaaaaacatggagggaaagattgtccagcctgaaaatctcgagtacacgatcgttgtgaccccccactctggcgaagagaacgctgtggggaatgacacaggaaaacatggcaaggagattaaagtcacccctcagtccagcatcacagaagccgagctgaccggctatgggacggtgaccatggaatgttctccccggacaggacttgatttcaacgagatggttctgctccaaatggaaaataaggcttggctggtgcaccgccagtggtttcttgacctgccgctcccttggctgcccggcgccgatacccaggggtccaactggatccagaaagagacactggtcaccttcaagaaccctcacgccaagaaacaagacgtggttgtgctcggaagccaggagggcgctatgcatacggcgctgacaggggccaccgaaattcagatgtcctctggcaatcttctgtttacaggacacctcaagtgcagactgcggatggacaaacttcaactgaagggcatgagctactccatgtgtaccgggaaattcaaggtcgtgaaggagatcgctgaaacccagcatggaacaattgtcatcagagtgcagtatgagggcgatgggagcccctgcaaaattcccttcgagatcatggacctcgaaaagcgccacgttctgggacggctgatcacggtgaaccctattgtcaccgagaaagattctccggtgaatatcgaagccgagcccccttttggcgactcctacattatcgttggggtggaacccggccagctcaagctgagctggttcaaaaagggatctagcattggccaaatgtttgagacaaccatgagaggggccaagcgcatggctatccttggagatacagcctgggacttcggctccctggggggagtctttacctctattggcaaagcgctccatcaggtgttcggggctatctacggcgccgcctttagcggagtgtcctggacgatgaagatcctgattggcgttgtcatcacatggattgggatgaacagccggtctacctccctgagcgtgtctcttgtgctcgtcggaatcgtgaccctgtatctgggcgttatggtgcaggctgattccgggtgtgtcgtgagctggaaaaataaggagctcaaatgcggatccggcattttcatcacagacaacgttcacacctggacagaacagtacaagtttcaacctgagtctcccagcaagctggcctccgctatccagaaagcccacgaagaggggatttgtggcatcagatctgtgacgcgccttgaaaatctgatgtggaagcagattaccccggagctcaaccatatcctgagcgagaatgaagtcaaactgacaattatgaccggagatatcaagggcatcatgcaggcggggaaacggtcccttagacctcaacccacagagctcaagtatagctggaaaacctggggaaaggccaagatgctgtctacggaacctcacaaccagaccttcctgattgacggccccgagacagctgaatgccctaataccaaccgcgcctggaattccctcgaggtggaggattacgggtttggagttttcacaaccaacatctggctgaaacttaaggaacggcaggacgtgttttgtgacagcaaactgatgtctgctgccattaaggataatagagcggtccatgccgacatgggctattggatcgagtccgctctcaacgatacatggaaaattgaaaaggccagcttcatcgaggtgaagtcttgccactggcccaaaagccacaccctgtggtccaacggcgtgctggagagcgaaatgatcattccgaagaatttcgctgggcctgtctctcagcataactaccgccccggatatcacacgcaaacagccggcccctggcatcttgggaaactcgagatggactttgatttctgtgaaggaaccaccgttgtggtgacagaggactgcggcaatcgggggccttccctgagaaccacgacagccagcggaaagctgatcaccgaatggtgctgtcggtcctgcacactcccgcccctgcgctacagaggcgaggatggctgttggtacgggatggagattcggcctcttaaagaaaaggaggaaaacctggtcaattctctcgtgaccgctggacacggccagatcgacaactttagcctgggggttctgggaatggcgcttttcctcgaggaaatgctgagaacacgcgtgggcaccaagcatgccgtcctgctcgtggctgtttcctttatgacgctgattaccgggaatatgtctttccgggatcttggaagagtgatggtcatggtgggcgccgccatgacagacgatatcggcatgggggttacctatctggctctcctggccgcgtttaaagtgcgccccacattcgctgccggactgcttctgagaaagctcaccagcaaagagctgatgatgacgacaattggcatcgtcctcctgtcccagtctaccatccctgagacaattcttgaactgaccgacgccctcgctctggggatgatgatcctgaagattgtgcggaacatggagaaataccaacttgccgtgaccatcatggcgattctgtgcgtccccaatgctgttatcctccagaacgcctggaaggtgagctgtacaatcctggccgtggtctccgtgagccctctcctgcttacgtcttcccagcagaaggctgattggattcccctggccctcaccatcaaaggactgaatccgacagctatttttctgaccacacttagccgcaccaacaagaaaagatcttggcctctgaatgaagccatcatggcggttggcatggtgtccattctcgccagctctctgctcaagaacgacatccccatgacggggcctctggtcgctggaggccttctgacagtgtgctatgttctgaccggccggtccgccgacctcgagctggaacgcgctgccgatgtgagatgggaggaccaagccgagatcagcgggtccagccccattctttctatcaccattagcgaagatggatccatgtctatcaaaaatgaggaagaggagcagacactgaccattctcatccggacaggcctgctcgtcattagcgggctgttcccggtgtccatccctatcacggctgcggcctggtacctttgggaagtcaagaaacagcgcgctggagtgctgtgggacgttccctctcctccccccgtgggcaaggccgagctggaagatggggcctatagaattaagcagaaaggaatcctcggctacagccaaattggcgctggggtctataaggagggaacctttcacacaatgtggcacgtgacccggggcgccgttctgatgcataaagggaagcgcatcgaaccttcctgggcggacgtgagaaaagatcttatttcttacggaggcgggtggaagctggagggagagtggaaggaaggcgaggaagtccaggtgctcgctctggagccgggcaaaaacccccgggccgtgcagacaaagcctgggctcttcaaaaccaacacgggaaccatcggcgccgttagcctggacttttcccccgggacaagcggatctcctatcgtcgataagaaaggcaaggtggtggggctttacggaaatggcgtcgtgaccagatccggcacatatgttagcgctattgcccagaccgaaaagtctatcgaggacaaccccgagattgaagatgacatcttccgcaaaaagcggctgacaattatggatctgcaccctggggcgggaaaaacgaagagatacctcccggctatcgtgcgcgaggccatcaaacggggcctgagaacccttattctggcccccacacgcgtcgtggctgccgaaatggaggaagctctccgggggctgcctatcagatatcaaacccccgccattcgcgcggagcataccggacgggagatcgttgacctcatgtgtcacgccacattcacgatgagactgctttcccctgtgcgggtccccaattacaacctgattatcatggacgaagctcattttaccgatccggccagcattgctgcccgcggctatatctccacaagagtggagatgggggaagccgctggcatcttcatgaccgcgacacctcccggatctcgggacccctttcctcagagcaatgcccccattatggatgaggagcgcgaaatccctgagagatcctggaacagcggccacgaatgggttaccgacttcaaggggaagacggtgtggtttgtcccgtctattaaagctggaaatgatatcgccgcctgcctgcggaagaacggcaaaaaggtgattcagctctccagaaaaacattcgacagcgagtacatcaagacccgcaccaatgattgggactttgtggtcacaaccgatatctctgaaatgggggctaacttcaaggccgagcgggttattgaccccagacgctgtatgaaacctgtgatcctgacagatggagaggaacgggtgattcttgcgggccccatgcctgtcacccacagctccgctgcccaaagacgcgggcggatcggcagaaatcccaagaacgagaatgaccagtatatttacatgggagaaccgctggagaacgacgaagattgcgcccattggaaagaggctaagatgctcctggacaatatcaacacgcctgagggcatcattccctctatgtttgaacctgagcgcgaaaaagtggatgccatcgacggggagtacagactgcggggagaagcgcgcaagacattcgttgatctcatgagacggggcgaccttcccgtgtggctggcctatcgcgtcgctgccgaggggattaactacgctgatagacggtggtgttttgacggaatcaaaaataaccagattctggaggaaaatgtggaggttgaaatctggaccaaggagggcgagagaaagaaactcaagcctcgctggctggatgcccggatttatagcgacccccttgctctgaaagaattcaaggagttcgccgcggggagaaaatccctcacactgaacctgatcaccgaaatgggccgcctcccgacgtttatgacccagaaggcccggaatgctcttgataacctggccgtgctgcacacagctgaggccggaggcagagcctacaatcatgctctctctgaactgcctgagacccttgagacactgctcctgctgaccctccttgcgacagtcaccgggggaatcttcctgtttctgatgagcggcaaggggattggaaaaatgacgctcggcatgtgctgcatcattacagcctccatcctgctttggtatgctcaaattcagccccactggatcgccgccagcatcattctggaattctttctcatcgtgctgctgattcccgagcctgaaaagcagcggaccccgcaggacaaccaactcacctacgtcgtgatcgctattcttacagttgtggccgcgaccatggccaatgagatgggcttcctggaaaaaacaaagaaagattttgggctgggatctatcgctacgcagcagctcgagtccaacatcctggacattgaccttcgccccgccagcgcttggaccctgtatgccgtggcgacaaccttcatcacacctatgctcagacactccattgagaattctagcgtcaacgtttccctgaccgccatcgctaatcaggccacggtgctgatgggcctcgggaagggatggcccctttctaagatggatattggcgtgcctctgctggctatcgggtgttacagccaagtcaaccccattaccctcacagccgctctgcttctgctcgtggcccattacgcgatcatcggacctggcctgcaggccaaagctacccgggaagcccagaagcgcgctgccgccggcattatgaaaaatccgacagttgacgggatcaccgtgattgatctggaccccatcccttatgatcccaagtttgagaaacagctcggacaagtcatgcttctggtgctgtgcgtcacgcaggtgctcatgatgagaacaacctgggcgctgtgtgaagctcttacactggccaccggccctatttccaccctctgggaggggaaccccggacggttctggaatacaacgatcgctgttagcatggccaacatctttcgcggctcttacctggccggggctggactgctcttctccattatgaagaacaccacaaataccagacggggcacaggcaacaccggggaaacgcttggagagaagtggaaaaatcgcctgaacagcctgggcaagtctgagtttcagatctataaaagatccgggattcaagaagtggaccggacactcgccaaggagggaatcaaaagaggcgaaaccgatcaccatgcggtcagccgcgggtctgccaagctgcggtggttcgtggagagaaatcttgttaccccggagggaaaagtggtcgacctgggctgcggccgcgggggatggagctactattgtggcgggctcaagaacgtgcgggaagtgaagggactgacaaaaggcgggcctggacacgaggaacccattcccatgtccacctacggctggaatctggttagactccagtctggcgtcgatgtgttctttacacctcccgagaagtgcgacacgcttctgtgtgatatcggggaaagctcccctaacccgaccgtggaggctggacgcacactgcgggtcctcaatctggttgagaactggcttaataacgacacccagttctgcatcaaagtgctgaatccctatatgcctagcgtgattgaaaagatggaggccctccagagaaaatacggcggggctctggtccgcaaccccctgtcccggaattctacacatgaaatgtactgggtgagcaacgcctccggaaacatcgtttctagcgtgaatatgatttccagaatgctcatcaaccgctttaccatgcggcacaagaaggcgacgtatgagcctgatgtcgaccttggctctgggaccagaaatattggaatcgaaagcgagacacccaacctggacatcattggcaaacgcatcgagaagattaaacaagaacacgagacctcctggcattacgatcaggaccacccgtataagacatgggcctaccatggcagctatgaaaccaaacagacagggtctgcttccagcatggtgaatggagttgtgagactgctcaccaagccttgggatgtcatccccatggtgacgcagatggccatgacagacaccacccctttcggccaacagcgggtgtttaaggagaaagtcgatacacgcacgcaggaacccaaggaggggaccaaaaagctgatgaaaattacagctgagtggctttggaaggaactgggaaagaaaaagacccctagaatgtgtacacgggaggaattcaccagaaaagttcggtctaacgccgctctcggcgccatctttacagacgagaataagtggaaatccgcgcgcgaggccgtggaagatagcagattctgggagctggtgaacaaggaacggaatctgcacctcgaggggaaatgcgaaacctgtgtctacaacatgatgggaaagcgcgagaagaaaattggcgagtttggcaaggctaaagggtctagagccatctggtatatgtggctgggagctcggttccttgaatttgaggccctgggcttcctcaatgaagaccactggttttcccgcgagaacagcctgtccggggtggaaggagagggccttcataagctggggtacatcctcagagaggttagcaaaaaggaaggcggagccatgtacgcggatgacacggctggctgggatacccggattacactggaggacctgaagaatgaagagatggtgaccaaccacatggaaggggagcataaaaagctcgccgaggccatcttcaaactgacatatcagaataaggtcgtgcgcgttcaaagacccaccccgcggggaacggtgatggacattatctctcgcagagatcagcggggcagcgggcaggtcggaacatacggccttaacaccttcacaaacatgggggctcaactgattcgccagatggaaggcgagggagtgtttaaaggcatccagcacctcaccgccacggaagagaccgctgttcatgactggctggccagagtggggcgggagagactttcccgcatggcgatctctggagatgactgcgtcgtgaagcctctggatgaccggttcgccagcgctctcacagccctgaatgatatgggcaaggtcagaaaagacattcagcaatgggaaccctcccgcgggtggaacgattggacccaggtgcccttttgctctcaccacttccatgagctgatcatgaaggacggacgggttctcgtggtcccttgtagaaatcaggatgaactgattggccgcgctcggatcagccagggggccggctggtcccttagagagacagcgtgcctgggaaaatcttatgcccaaatgtggagcctcatgtactttcaccgccgggacctgagacttgctgccaacgctatttgttccgccgtgccgagccattgggtgcccacctctcgcacaacctggtccatccacgctcggcacgaatggatgacgacagaggatatgctgaccgtttggaatagagtgtggatccaggagaacccttggatggaagacaagacccccgtcgagagctgggaagagattccttatctcggcaaacgggaagaccagtggtgcgggtctctgatcggactgacatccagagccacctgggcgaagaatattcagacagccatcaaccaagtgcgcagcctcattggctccgaggagtacacggattatatgccctctatgaagcggttcagacgcgaagaggaagaggctggggttctgtggtga

SEQ ID NO: 20236 - RNA, 9876 nt, synthetic construct
  misc_feature 1..9876: note = derived and/or modified CDS sequence (opt5) from DENV-2__KR779782__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaaagcctcctgtttaagacggaaaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaacaggggatttgtggcatcagatctgtgacgcgcctggagaaccttatgtggaagcagattaccccggaactgaatcatatcctcacagagaacgaggttaaactgaccattatgacaggagacatcaagggcatcatgcaggccgggaaacggagcctgagacctcaacccaccgaacttaagtactcctggaaagcgtggggaaaggccaagatgctcagcacggagctgcacaatcataccttcctgattgatggccctgaaacagctgagtgccccaacaccaatcgcgcctggaactctctcgaagtggaggactatgggtttggagtcttcacaaccaatatctggctgaaacttaaggagcggcaggatgtgttttgtgactccaaactgatgagcgctgccattaaggacaacagagcggtgcacgccgatatgggctactggatcgaatctgctctcaacgacacatggaaaattgagaaggcctccttcatcgaagtcaagagctgccactggcctaaatctcataccctgtggagcaatggcgttctggagtccgagatgatcattcccaagaacttcgctgggccggtgagccagcacaattatcgccctggataccatacgcagacagccggcccctggcaccttgggcggctcgaaatggattttgacttctgtgagggaaccaccgtggtcgtgacagaagattgcggcaacagagggccctctctgcggaccacgacagcctccggaaaactgatcaccgagtggtgctgtcgcagctgcacactccctccgctgagataccggggcgaagacggctgttggtatgggatggagattagaccccttaaggagaaagaagagaatctggttaactccctcgtgaccgctggacatggccaaatcgataatttttctctgggggtcctgggaatggcgcttttcctcgaagagatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggaactgatgatgacaaccatcggcatcgtgctcctgagccagtccacaattcccgagtctatccttgagctgaccgatgccctcgccctggggatgatggtcctgaaaattgttcgcaatatggaaaagtatcagcttgctgtgaccatcatggccattctgtgcgtgcctaacgcggtcatcctccaaaatgcttggaaagtgagctgtacaacgctggccgttgtgtccgtcagccccctcctgcttacctcttcccagcagaaggccgactggatccctctggctctcacaattaagggactgaaccccaccgccatctttctgacaacccttagcagaacgtctaaaaagcggtcctggccgctgaatgaggctattatggccgtgggcatggttagcatcctcgcgtcttccctgctcaaaaacgatattcctatgacagggcccctggtggccggaggccttctgaccgtctgctacgtgctgaccggccgcagcgctgacctcgaactggagagagccgctgacgtccggtgggaagaacaggccgagatctccgggagctctcctatccttagcattacaatctccgaagatggatctatgagcattaagaatgaggaagaggagcaaaccctgacaatcctcattcgcacgggcctgctcgtgatctccgggctgttccccgtttctattccgatcaccgccgctgcgtggtatctttgggaagtgaaaaagcagagagccggagtcctgtgggacgtgccttctccccctcccgttggcaaagctgagctggaagatggggcctaccggatcaagcagaagggcattctcggctattcccagatcggcgccggggtgtacaaagagggaacatttcacaccatgtggcatgtcacacgcggcgctgtgctgatgcacaaggggaaaagaattgaaccctcctgggccgacgtgaagaaagatcttatcagctacggaggcgggtggaagctggagggagagtggaaggaaggcgaggaagttcaagtcctcgcgctggagcctggcaaaaacccgcgggctgtgcagaccaagcccggactcttcaaaacgaacaccggaacaattggcgccgtgtccctggactttagccctgggacctctggatcccccatcgtcgataagaaaggcaaggtggttgggctttatggaaatggcgtggtcacaagaagcggcacctacgtgtctgccatcgctcagacagaaaagtccattgaggacaaccctgagatcgaagatgacattttccgcaaaaagcggctgacgatcatggatctgcatcccggggccggaaaaaccaagagatatctccctgcgattgttcgcgaggctatcaaacggggcctgagaacacttatcctggccccgacccgcgtggtcgccgctgaaatggaggaagccctccgggggctgcccattagataccagacccctgctatccgcgccgagcacacaggacgggagattgtggacctcatgtgtcatgcgacgttcaccatgagactgcttagccccatccgggttcctaattataacctgattatcatggatgaagcccactttacagaccccgcttccattgccgctcgcggctacatctctaccagagtggagatgggggaagccgccggcatcttcatgacagctaccccgcctggaagccgggacccctttccccaatccaatgcgcctattatggatgaggagcgcgaaatccccgagagaagctggaactctggccacgaatgggtcacggacttcaaggggaagacagtgtggtttgtgccttccattaaagccggaaatgatatcgctgcctgcctgcggaagaacggcaaaaaggtcattcagctcagcagaaaaaccttcgactctgagtatatcaagacccgcacaaatgattgggactttgttgtgaccacagatatcagcgaaatgggggccaacttcaaggctgagcgggtgattgacccgagacgctgtatgaaacccgtcatcctgaccgatggagaggaacgggtgattcttgccggccctatgcccgttacgcattcctctgcggctcagagacgcgggcgggtgggcagaaatcctaagaacgagaatgaccaatacatctacatgggagaacccctggagaacgatgaagactgcgcccactggaaagaggccaagatgctcctggacaatattaacacaccggagggcatcatccctagcatgtttgaacccgagcgcgaaaaagtcgatgctattgacggggagtatagactgcggggagaagcccgcaagaccttcgtggatctcatgagacggggcgaccttcctgtttggctggcgtaccgcgtggccgctgaggggatcaactatgccgatagacggtggtgttttgacggagtcaaaaataaccagattctggaggaaaatgtggaggtcgaaatctggacaaaggagggcgagagaaagaaactcaagccccgctggctggatgctcggatttactccgaccctcttgccctgaaagagttcaaggagttcgctgccgggagaaaatctctcaccctgaacctgatcacggaaatgggccgcctccccacctttatgacacagaaggcgaagaatgcccttgataacctggctgtgctgcataccgccgaggctggaggccgggcctataatcacgccctcagcgaactgccggagacacttgagaccctgctcctgctgacactccttgctaccgttacaggcgggattttcctgtttctgatgtccgggaaagggatcggaaagatgacactcggcatgtgctgcatcattaccgcgagcatcctgctttggtacgcccagattcaacctcactggatcgctgcctctattatcctggagttctttctcatcgtgctgctgattcccgagcccgaaaaacagagaacccctcaggacaaccagctcacatatgtggtcatcgccattcttaccgttgtggctgccacaatggcgaatgagatgggcttcctggaaaagacgaaaaaggattttgggctgggatccatcaccacacaacagccggagagcaacattctcgacatcgatctgcggcccgcctccgcttggaccctttacgccgtggctacaaccttcatcacgcctatgctgcgccattctattgagaatagctccgtcaacgtgtctctcaccgccatcgcgaatcaggccacagttctgatgggcctggggaagggatggcccctcagcaaaatggacattggcgtgcctcttctggctatcgggtgttactcccaggtcaaccccattaccctgacagccgctctcctgcttctggtggcccactatgctatcattggacctggcctccaagccaaggcgaccagagaagcccagaaacgggctgccgctggcatcatgaagaatccgacggtcgacgggatgacagtgatcgatctggaccccattccttacgatcccaaatttgagaagcagctgggacaggttatgctccttgtgctgtgcgtcacccaagtgctgatgatgcgcacaacctgggccctctgtgaagccctgacccttgcgacaggccctatcagcacgctgtgggaggggaaccccggaagattctggaataccacaattgctgtttctatggccaacatctttcggggctcctatctcgctggggccggactgctgttcagcattatgaagaacaccgccaatacacgcagaggcaccggcaacacgggggaaacactcggagagaaatggaagaatcggcttaacgctctgggcaaatctgagtttcagatctacaagaaatccgggatccaggaagtggaccgcaccctggccaaggagggaattaaaagaggcgaaaccgatcatcacgcggtcagccgggggtctgccaagctcagatggttcgtggagcgcaatctggtgacaccggagggaaaggttgtcgaccttggctgcggcagagggggatggagctattactgtggcgggctgaaaaacgtgaaggaagtgaaaggactcaccaagggcgggcctggacatgaggaacccatccccatgtccacatatggctggaatctggtcagactgcaatctggcgttgatgtgttctttacgcctcccgagaaatgcgacaccctcctttgtgatattggggaaagctcccctaacccgacagtggaggctggacgcaccctgcgggtcctgaatctcgtggagaactggctgaataacaatacacagttctgcatcaaggttcttaacccctacatgcctagcgtgattgaaaagatggaggccctgcagagaaaatacggcggggctctcgtccgcaatcccctgtcccggaactctacccacgaaatgtattgggtgagcaacgcctccggaaatatcgtttctagcgtgaacatgatctccagaatgctgattaatcgctttacgatgcggcacaagaaagcgacctacgagcctgacgtcgatctcggctctgggacaagaaacatcggaattgaaagcgagacccccaatcttgacatcattggcaagcgcatcgagaaaatcaagcaggaacatgagacatcctggcactatgatcaagaccatccgtacaagacctgggcctatcacggcagctacgaaacaaaacagaccgggtctgcttccagcatggtgaacggagtggtccggctgctgacgaagccttgggacgttattcccatggtgacacagatggccatgaccgataccacacctttcggccagcaaagagtgtttaaagagaaggtcgacacgcgcacccaggaacccaaagaggggacaaagaagctcatgaaaatcaccgctgagtggctgtggaaggaacttggcaaaaagaaaacacctagaatgtgtacccgggaggagttcacacgcaaggtgagatctaatgccgctctgggcgccatttttaccgatgagaacaaatggaagtccgcgcgggaggccgttgaagacagcgggttctgggagctcgtggataaggaaagaaatctgcacctggagggaaaatgcgaaacgtgtgtctataacatgatgggcaagcgggagaaaaagctcggcgagtttgggaaagctaagggatctcgcgccatctggtacatgtggctgggcgctagattccttgaatttgaggccctggggttcctcaatgaagaccattggttttcccgggagaacagcctgtccggagtggaaggcgaggggcttcacaagctgggctacattctccgcgatgttagcaaaaaggagggaggcgccatgtatgcggacgataccgctgggtgggacacaagaatcaccctggaagatctgaaaaatgaggaaatggtgacaaaccatatggagggagaacacaagaaactcgccgaggccattttcaagctgacctaccagaataaggtcgtgcgggttcagcgccccacgccgagaggcacagtgatggacatcatctctcggcgcgaccaaagagggagcggacaggtcgtgacctatggccttaacacattcaccaacatggaggctcagctgattcggcaaatggaaggggagggcgtctttaaatccatccagcagctcacggtgaaggaagagattgccgttaaaaattggctgatccgcgtgggaagagagcggctttctcgcatggctattagcggcgatgactgcgtcgtgaagcctctggatgacagattcgcctccgcgctcaccgccctgaacgatatggggaaagtgcggaaggacatccagcaatgggaaccctctagaggatggaatgattggacacaggttcccttttgcagccatcacttccacgagctgatcatgaaggacggccgcgtgctcgtcgtgccttgtcggaaccaggatgaactgattgggagagctcgcatctcccagggagccggctggtctcttcgggagaccgcttgcctggggaaaagctacgcccaaatgtggtccctcatgtattttcatagacgcgacctgcggcttgcggccaatgctatttgtagcgccgttccgtctcactgggtgcccacatccagaaccacatggagcatccatgctacccacgaatggatgacgacagaggatatgctgaccgtctggaaccgcgtgtggattcaggagaatccttggatggaagacaagacccccgtcgagtcttgggaagagatcccttacctcggcaaacgggaagatcagtggtgcggatccctgatcggcctgacaagcagagccacctgggctaagaacattcagacagccatcaatcaagtgcgctccctcattgggaacgaggagtatacggactacatgccctctatgaaacggttcagacgggaagaggaagaggcgggagttctgtggtga

SEQ ID NO: 20237 - RNA, 9876 nt, synthetic construct
  misc_feature 1..9876: note = derived and/or modified CDS sequence (opt5) from DENV-2__KM279608__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagtgaccggcgagcacagacgggaaaaacgctccgtcgcgctggtgcctcatgttgggatgggactcgagacaagaaccgaaacgtggatgtctagcgagggcgcttggaagcacgcccagcggatcgagacatggattctgcgccatcccggcttcaccatcatggccgctattctggcctacacaatcgggaccacctatctccagagagtgctgatttttatccttctgacagctgtcacgccttccatggccatgcggtgcattggaatctctaaccgcgacttcgtggaaggcgttagcgggggatcctgggtggatatcgtcctcgagcacggcagctgtgtgaccacaatggcgaaaaataagcccaccctggactttgaacttattaagacagaggccaaacaccctgctaccctgagaaagtactgcgtggaagccaaactcacgaacacaaccaccgcttctcggtgtccgacacagggggagccctccctgaatgaggaacaagataagcgcttcgtctgcaaacatagcatggttgacagaggatggggcaacggctgtgggctgtttggaaagggcgggatcgtgacctgcgccatgttcacatgcaagaaaaatatggagggaaaggtggtccagcctgaaaacctcgagtatacgattgtgatcaccccccactctggcgaagagaatgcggttgggaacgatacaggaaaacatggcaaggagattaaagtgacccctcagtccagcatcacagaagccgagctgaccggctacgggacggtcaccatggaatgttctccccggacaggacttgactttaatgagatggtgctgctccagatggaaaacaaggcttggctggttcaccgccaatggttccttgatctgccgctcccttggctgcccggcgccgacacccaggggtccaactggatccagaaagagacactggtgacctttaagaatcctcacgctaagaaacaggatgtcgtggtcctcggaagccaagagggcgccatgcatacggccctgacaggggctaccgaaattcagatgtcctctggcaaccttctgttcacaggacacctcaagtgcagactgcggatggacaaacttcagctgaagggcatgagctattccatgtgtaccgggaaatttaaggtggttaaggagatcgcggaaacccaacatggaacaattgtgatcagagtccagtacgagggcgacgggagcccctgcaaaattcccttcgagatcatggatctcgaaaagcgccacgtgctgggacggctgatcacggttaatcctattgtgaccgagaaagacaacccggtcaatatcgaagccgagccccctttcggcgattcttacattatcattggggtggaacccggccagctcaagctgtcctggtataaaaagggaagctctatcggccagatgtttgagacaaccatgagaggggctaagcgcatggccattcttggagacacagcctgggatttcggcagcctggggggagtgtttacctccatcggcaaagctctccatcaagttttcggggccatctacggcgcggctttttctggagtcagctggacgatgaagattctgatcggcgtggtgattacatggatcgggatgaactcccggagcacctctctgtccgtcagccttgtgctcgttggagtggtcaccctgtatctgggcgtgatggttcaggccgactctgggtgtgtggtctcctggagaaataaagagctcaagtgcggaagcggcattttcatcacagataacgtgcacacctggacagaacagtacaaatttcagcctgagtccccctctaagctggccagcgctatccaaaaggcccacgaagaggggatttgtggcatccgctccgttacgcggcttgaaaatctgatgtggaaacagattaccccggagctcaaccatatcctgacagagaatgaagtgaagctgaccattatgacaggagacatcaaaggcatcatgcaggctgggaagagatctcttcgccctcagcccaccgagctcaaatatagctggaaggcctggggaaaagcgaagatgctgtccacggaactgcacaaccataccttcctcattgatggccctgagacagccgaatgccccaataccaaccgggcttggaatagcctggaggtcgaggactacgggtttggagtgttcacaaccaacatctggcttaagctgaaagaaagacaagatgtgttttgtgactctaagctcatgtccgccgctattaaagacaaccgcgccgtccacgcggatatgggctattggatcgagagcgccctgaatgacacatggaagattgaaaaagcttctttcatcgaggttaagtcctgccactggcctaagagccataccctgtggtctaacggcgtgcttgagagcgaaatgatcattcccaaaaattttgccgggccggtgtcccagcacaactaccggcctggataccatacgcagacagctggcccctggcacctcgggagactggagatggatttcgacttctgtgaaggaaccaccgtcgtggttacagaggattgcggcaatcgggggcccagcctgcgcaccacgacagcctctggaaagctcatcaccgaatggtgctgtagatcctgcacactgcctccgcttcggtatagaggcgaggacggctgttggtacgggatggagattcgccccctgaaagaaaaggaggaaaacctcgtgaatagcctggtcaccgccggacatggccagatcgataacttttccctgggggtgcttggaatggctctcttcctggaggaaatgctgcggacaagagttggcaccaaacacgcgattctcctggtggccgtctcttttgtgacgcttatcaccgggaatatgagcttccgcgacctgggaagagttatggtgatggtcggcgctacaatgaccgatgacattggcatgggggtgacatatctcgccctgctggccgcttttaaggtgcggcctaccttcgccgcgggacttctgctccgcaagctgacgtccaaagagctcatgatgacaaccatcggcatcgtcctgctttctcaaagcacaattcccgagtccatcctggaactcaccgatgctctggccctggggatgatggttcttaagattgtgagaaacatggagaaataccagctggccgtgaccatcatggctattctctgcgtccctaatgccgtgatcctggaaaacgcgtggaaggtttcttgtacaacgctcgctgtggtcagcgtgtcccccctgcttctgaccagctctcagcaaaaagccgactggatccctctcgccctgacaattaagggactgaatcccaccgctatctttcttacaaccctgtcccggacgagcaagaaacgctcttggccgctcaacgaggccattatggctgttggcatggtgtccatcctggccagctctctcctgaagaatgatattcctatgacagggccccttgtcgcgggaggcctgctgaccgtgtgctatgtcctcaccggcagatccgccgacctggaacttgagcgggctgccgacgtgcgctgggaggaacaggctgagatcagcgggtccagccctatcctgtctattacaatcagcgaagatggatccatgtctattaaaaacgaggaggaagagcagaccctcacaatcctgattagaacgggcctcctggttatcagcgggcttttccccgtgtccattccgatcaccgccgccgcttggtacctgtgggaagtcaagaaacagcgggcgggagtgctgtgggacgttccttctccccctcccgtgggcaaggccgagctcgaagatggggcttatcgcatcaaacaaaagggaattctgggctacagccagatcggcgccggggtctacaaggagggaacatttcacaccatgtggcatgtgacaagaggcgccgtgcttatgcacaaagggaagcggattgagccctcctgggctgacgttaaaaaggatctgatctcttatggaggcgggtggaaactcgaaggagagtggaaggaaggcgaggaagtccaggtgctggccctcgagcctggcaagaacccgagagcggtgcagaccaaacccgggctgttcaagacgaataccggaacaattggcgctgtcagccttgacttttcccctgggaccagcggatctcccatcgtggataaaaagggcaaagttgtggggctgtacggaaacggcgtcgtgacacgctccggcacctatgttagcgccatcgcccaaacagagaagtctattgaagacaatcctgagatcgaagatgacattttccggaagaaaagactgacgatcatggatctccatcccggggctggaaagaccaaacgctacctgcctgccattgtgcgggaggcgatcaagagaggccttcgcacactgatcctcgctccgacccgggtcgtggccgccgaaatggaggaggctctgagagggctccccattcgctatcagacccctgccatccgggctgaacacacaggaagagagattgttgacctgatgtgtcatgccacgtttaccatgcggcttctgtcccccatccgcgtgcctaactacaatctgattatcatggatgaagcgcacttcacagaccccgccagcattgctgccagaggctatatctccacccgggtcgagatgggggaggctgccggcatcttcatgacagccaccccgcctggatctcgcgacccctttccccagagcaacgctcctattatggatgaagagagagaaatccccgagcggtcctggaatagcggccacgaatgggtgacggacttcaaagggaagacagtgtggtttgtcccttctattaaggcgggaaacgatatcgccgcttgcctcagaaaaaatggcaagaaagttattcagctgtcccgcaagaccttcgacagcgagtacatcaaaacccggacaaacgattgggactttgtggtgaccacagatatctctgagatgggggccaatttcaaggccgaaagagtcattgacccgcgccggtgtatgaagcccgtgatccttaccgatggagaggaaagagttattctggctggccctatgcccgtgacgcatagctccgccgcgcaacgccgggggagagtcggccgcaaccctaaaaatgagaacgaccagtacatctatatgggagaacccctcgagaatgatgaggactgcgctcactggaaggaagccaaaatgctgctggacaacattaacacaccggagggcatcatcccttctatgtttgaacccgagagagaaaaggtggatgccattgacggggagtaccggctccgcggagaggctagaaaaaccttcgttgatcttatgcggcgcggcgacctgcctgtgtggctggcctataaggtcgcggccgaagggatcaattacgctgatagacggtggtgttttgacggagtgaaaaacaatcagattctcgaggaaaacgtcgaggtggagatctggacaaaggaaggcgagagaaagaaactgaagccccgctggcttgatgcccggatttatagcgaccctctggctctcaaagaattcaaggagtttgccgctgggagaaaatccctgaccctgaatctcatcacggaaatgggccgccttcccaccttcatgacacaaaaggccaagaacgcgctggataatctggccgttctccataccgctgaggccggaggccgggcttacaaccacgccctgtctgagcttccggaaacactggagaccctcctgctgctcacacttctggccaccgtgacggggggaattttcctgtttctcatgagcggcaaagggatcggaaagatgacactgggcatgtgctgcatcattaccgcttccatccttctgtggtatgcgcagattcagcctcactggatcgccgctagcattatcctcgaattctttctgatcgtgctgctcattcccgagcccgaaaaacagagaacccctcaagacaatcagcttacatacgtcgttatcgccattctgaccgtggtggccgctacaatggccaacgagatgggcttcctggagaagacgaaaaaggattttgggctcggatctatcaccacacagcagccggaatccaatattctggacatcgatcttcggcccgcgagcgcctggaccctgtacgctgtcgccacaaccttcatcacgcctatgctccgccattccattgagaactctagcgtgaatgtttccctgaccgctatcgccaaccaagcgacagtgctgatgggcctcgggaagggatggcccctttctaaaatggacattggcgtccctctgctggccatcgggtgttatagccaggtgaatcccattaccctcacagctgccctgcttctgctcgtcgctcactacgccatcattggacctggcctgcaggctaaggccaccagagaagcgcagaaacgggccgctgccggcatcatgaagaacccgacggtggacgggatcacagttattgatctggaccccatcccttatgatcccaaatttgagaagcaactcggacaggtgatgcttctggtcctgtgcgtgacccaggttctcatgatgcgcacaacctgggctctgtgtgaagcccttaccctggccacaggccctatttccacgctctgggaggggaatcccggaagattctggaacaccacaatcgcggtgagcatggctaacatttttcggggctcttacctggccggggctggactgctcttctccatcatgaagaataccgccaacacacgcagaggcaccggcaatacgggggagacacttggagaaaaatggaagaaccggctgaatgccctgggcaaaagcgagtttcagatctataagaaatctgggattcaagaagtcgaccgcaccctcgctaaggagggaatcaaaagaggcgagaccgatcatcacgccgtgtcccgggggagcgcgaagctgagatggttcgtggaacgcaaccttgttacaccggagggaaaggtcgtggacctgggctgcggccgggggggatggtcttactattgtggcgggctcaaaaatgtgaaggaagtcaaaggactgaccaagggcgggcctggacatgaggaacccattcccatgagcacatacggctggaacctggttagactccagtccggcgtggatgtgtttttcacgcctcccgagaaatgcgacacccttctgtgtgatatcggggagtctagccctaatccgacagtcgaagccggacgcaccctgcgggtgctcaacctggttgagaattggcttaacaataacacacagttctgcattaaggtgctgaatccctacatgccttccgtcatcgaaaagatggaggctctccaaagaaaatatggcggggccctggtgcgcaaccccctgagccggaactccacccacgaaatgtactgggtttctaatgctagcggaaacatcgtgtcctctgtcaatatgattagcagaatgctcatcaaccgctttacgatgcggcacaagaaagccacctatgagcctgacgtggatcttggctccgggacaagaaatattggaatcgagtctgaaacccccaacctggacattatcggcaagcgcatcaaaaagattaagcaggagcatgaaacaagctggcactacgatcaggaccatccgtataaaacctgggcgtaccacggctcctatgagacaaagcagaccgggagcgcctcttccatggtgaatggagtcgttcggctgctcacgaaaccttgggacgtgatccccatggtgacacaaatggctatgaccgataccacacctttcggccagcagagagtctttaaggaaaaagtggacacgcgcacccaggagcccaaggaggggacaaagaaactgatgaagattaccgccgaatggctttggaaagagctgggaaagaaaaagacacctagaatgtgtacccgggaagagttcacacgcaaagttagaagcaacgctgccctcggcgctatctttaccgatgagaataagtggaagtctgcccgggaagcggtggaggactccgggttctgggaactggtcgataaagagagaaacctgcacctcgaaggaaagtgcgagacgtgtgtgtacaatatgatgggcaaacgggagaagaaactgggcgaatttgggaaggccaagggaagccgcgctatttggtacatgtggcttggcgccagattcctggagtttgaagctctcgggttcctgaacgaggaccattggttttctcgggaaaattcccttagcggagttgagggcgaggggctgcacaaactcggctatatcctgcgcgatgtgtccaagaaagaaggaggcgccatgtacgccgacgataccgcggggtgggacacaagaattaccctggaggatctcaagaacgaagagatggtcacaaatcatatggaaggagagcacaaaaagctggctgaggccatcttcaagcttacctatcaaaacaaagtggttcgggtgcagcgccccacgccgagaggcacagtcatggacatcattagccggcgcgaccagagagggtctggacaggtggtcacctacggcctgaacacatttaccaatatggaagcccaactcatccggcagatggagggggaaggcgtgttcaagagcattcagcaactgacggttaaagaggagatcgctgtgaagaactggcttattcgcgtcggaagagaacggctgtcccgcatggccatctctggcgatgactgcgtggtgaaacctctcgatgacagattcgctagcgccctgaccgcgctgaatgatatggggaaggttcggaaggacatccagcagtgggagccctccagaggatggaacgattggacacaggtgcccttttgctctcatcacttccacgaactcattatgaaagacggccgcgtcctggtggttccttgtcggaatcaagatgagcttatcgggagagcccgcattagccagggagctggctggtccctgcgggaaaccgcctgcctcgggaagtcttatgctcagatgtggagcctgatgtactttcatagacgcgaccttcggctggccgcgaacgccatctgttccgctgtgccgagccactgggtccccacatctagaaccacatggtccattcatgccacccacgagtggatgacgacagaggatatgctcaccgtgtggaatcgcgtctggatccaggaaaacccttggatggaggacaaaacccccgtggaaagctgggaggaaatcccttatctgggcaagcgggaggatcaatggtgcggatctctgattggcctcacatccagagctacctgggccaaaaatatccagacagctattaaccaggttcgcagcctgatcgggaatgaggaatacacggactacatgccctccatgaagcggttcagacgggaggaagaggaagccggagtgctttggtga

SEQ ID NO: 20238 - RNA, 9876 nt, synthetic construct
  misc_feature 1..9876: note = derived and/or modified CDS sequence (opt5) from DENV-2__KM279605__SS-prME
  source 1..9876: mol_type = other RNA
accgccggaatcattatcatgatgattcccaccgtgatggctttccacctgacgaccagaaacggggagcctcatatgatcgtctcccggcaggaaaagggaaaatccctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagacaacccggtgaatatcgaagctgagcccccttttggcgattcttacattatcattggggtcgaacccggccagctgaagctctcctggttcaaaaagggaagctctatcggccagatgtttgagacaaccatgagaggggccaagcgcatggccattctgggagacacagcttgggatttcggcagccttgggggagtgtttacctccatcggcaaagccctgcatcaagtgttcggggcgatctatggcgctgccttttctggagttagctggacgatgaagattctcatcggcgtcgtgattacatggatcgggatgaactcccggagcacctctctgtccgtgagcctggtccttgtgggagttgtgaccctctacctgggcgtcatggtgcaggccgactctgggtgtgttgtgtcctggaaaaataaggagctgaaatgcggaagcggcattttcatcacagataacgtccacacctggacagaacagtataagtttcagcctgagtccccctctaagctcgctagcgccatccaaaaagctcacgaagaggggatttgtggcatcagatccgtgacgcgcctggaaaatcttatgtggaagcagattaccccggagctgaaccatatcctcacagagaatgaagttaaactgaccattatgacaggagacatcaagggcatcatgcaggccgggaaacggtctctgagacctcagcccaccgagcttaagtacagctggaaagcgtggggaaaggccaagatgctctccacggaactgcacaaccataccttcctgattgatggccctgagacagctgaatgccccaataccaaccgcgcctggaatagcctcgaggtggaggactatgggtttggagtcttcacaaccaacatctggctgaaacttaaggaacggcaagatgtgttttgtgactctaaactgatgtccgctgccattaaggacaacagagcggtgcacgccgatatgggctactggatcgagagcgctctcaatgacacatggaaaattgaaaaggcctctttcatcgaggtcaagtcctgccactggcctaaaagccataccctgtggtctaacggcgttctggagagcgaaatgatcattcccaagaatttcgctgggccggtgtcccagcacaactatcgccctggataccatacgcagacagccggcccctggcaccttgggcggctcgagatggattttgacttctgtgaaggaaccaccgtggtcgtgacagaggattgcggcaatagagggcccagcctgcggaccacgacagcctctggaaaactgatcaccgaatggtgctgtcgctcctgcacactccctccgctgagataccggggcgaggacggctgttggtatgggatggagattagaccccttaaggaaaaagaggaaaacctggttaatagcctcgtgaccgctggacatggccagatcgataacttttccctgggggtcctgggaatggcgcttttcctcgaggaaatgctgcgcacacgggtgggcaccaagcacgccattctgctcgttgctgtgtcttttgtcacgctgatcaccgggaatatgagcttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtccaaggagctgatgatgacaaccatcggcatcgtgctcctgtctcaaagcacaattcccgagtccatccttgaactgaccgatgccctcgccctggggatgatggtcctgaaaattgttcgcaacatggagaagtatcagcttgctgtgaccatcatggccattctgtgcgtgcctaatgcggtcatcctcgaaaacgcttggaaagtgtcttgtacaacgctggccgttgtgagcgtcagccccctcctgcttaccagctctcagcaaaaggccgactggatccctctggctctcacaattaagggactgaatcccaccgccatctttctgacaaccctttccagaacgagcaaaaagcggtcttggccgctgaacgaggctattatggccgtgggcatggtttccatcctcgcgagctctctgctcaaaaatgatattcctatgacagggcccctggtggccggaggccttctgaccgtctgctacgtgctgaccggccgctccgctgacctcgaactggagagagccgctgacgtccggtgggaggaacaggccgagatcagcgggtccagccctatcctttctattacaatcagcgaagatggatccatgtctattaagaacgaggaggaagaacagaccctgacaatcctcattcgcacgggcctgctcgtgatcagcgggctgttccccgtttccattccgatcaccgccgctgcgtggtatctttgggaagtgaaaaagcagagagccggagtcctgtgggacgtgccttctccccctcccgttggcaaagctgagctggaagatggggcctaccggatcaagcaaaagggcattctcggctatagccagatcggcgccggggtgtacaaagagggaacatttcacaccatgtggcatgtcacacgcggcgctgtgctgatgcacaaggggaaaagaattgagccctcctgggccgacgtgaagaaagatcttatctcttacggaggcgggtggaagctggaaggagagtggaaggaaggcgaggaagttcaggtcctcgcgctggagcctggcaaaaacccgcgggctgtgcagaccaagcccggactcttcaaaacgaataccggaacaattggcgccgtgagcctggacttttcccctgggaccagcggatctcccatcgtcgataagaaaggcaaggtggttgggctttatggaaacggcgtggtcacaagatccggcacctacgtgagcgccatcgctcaaacagagaagtctattgaagacaatcctgagatcgaagatgacattttccgcaaaaagcggctgacgatcatggatctgcatcccggggccggaaaaaccaagagatatctccctgcgattgttcgcgaggctatcaaacggggcctgagaacacttatcctggccccgacccgcgtggtcgccgctgaaatggaggaggccctccgggggctgcccattagataccagacccctgctatccgcgccgaacacacaggacgggagattgtggacctcatgtgtcatgcgacgttcaccatgagactgctttcccccatccgggttcctaactataatctgattatcatggatgaagcccactttacagaccccgctagcattgccgctcgcggctacatctccaccagagtggagatgggggaggccgccggcatcttcatgacagctaccccgcctggatctcgggacccctttccccagagcaacgcgcctattatggatgaagaacgcgaaatccccgagagatcctggaatagcggccacgaatgggtcacggacttcaaggggaagacagtgtggtttgtgccttctattaaagccggaaacgatatcgctgcctgcctgcggaagaatggcaaaaaggtcattcagctctccagaaaaaccttcgacagcgagtatatcaagacccgcacaaacgattgggactttgttgtgaccacagatatctctgagatgggggccaatttcaaggctgaacgggtgattgacccgagacgctgtatgaaacccgtcatcctgaccgatggagaggaacgggtgattcttgccggccctatgcccgttacgcatagctccgcggctcaaagacgcgggcgggtgggcagaaaccctaagaatgagaacgaccagtacatctacatgggagaacccctggagaatgatgaggactgcgcccactggaaagaagccaagatgctcctggacaacattaacacaccggagggcatcatcccttctatgtttgaacccgagcgcgaaaaagtcgatgctattgacggggagtatagactgcggggagaggcccgcaagaccttcgtggatctcatgagacggggcgaccttcctgtttggctggcgtacaaagtggccgctgaagggatcaattatgccgatcgcagatggtgttttgacggagtcaagaacaatcagattctggaggaaaacgtggaggtcgagatctggacaaaggaaggcgagcggaaaaagctcaaacccagatggctggatgctcgcatttacagcgaccctcttgccctgaaggagttcaaagagttcgctgccgggcggaagtccctcaccctgaatctgatcacggaaatgggcagactccccacctttatgacacaaaaggcgaaaaacgcccttgataatctggctgtgctgcataccgccgaggctggaggccgcgcctataaccacgccctctctgagctgccggaaacacttgagaccctgctcctgctgacactccttgctaccgttacaggcgggattttcctgtttctgatgagcgggaaggggatcggaaaaatgacactcggcatgtgctgcatcattaccgcgtccatcctgctttggtacgcccagattcagcctcactggatcgctgccagcattatcctggagttctttctcatcgtgctgctgattcccgagcccgaaaagcagcggacccctcaagacaatcagctcacatatgtggtcatcgccattcttaccgttgtggctgccacaatggcgaacgagatgggcttcctggagaaaacgaagaaggattttgggctgggatctatcaccacacagcagccggaatccaatattctcgacatcgatctgagacccgccagcgcttggaccctttacgccgtggctacaaccttcatcacgcctatgctgcggcattccattgagaactctagcgtcaatgtgtccctcaccgccatcgcgaaccaagccacagttctgatgggcctggggaaaggatggcccctctctaagatggacattggcgtgcctcttctggctatcgggtgttacagccaggtcaatcccattaccctgacagccgctctcctgcttctggtggcccactatgctatcattggacctggcctccaggccaaagcgacccgcgaagcccagaagagagctgccgctggcatcatgaaaaacccgacggtcgacgggatcacagtgattgatctggaccccatcccttacgatcccaagtttgagaagcaactgggacaggttatgctccttgtgctgtgcgtcacccaggtgctgatgatgcggacaacctgggccctctgtgaagccctgacccttgcgacaggccctatttccacgctgtgggaggggaatcccggacgcttctggaacaccacaatcgctgttagcatggccaacatttttagaggctcttatctcgctggggccggactgctgttctccatcatgaaaaataccgccaacacacggcgcggcaccggcaatacgggggagacactcggagaaaagtggaaaaacagacttaatgctctgggcaagagcgagtttcagatctacaaaaagtctgggattcaagaagtggaccggaccctggccaaagagggaatcaagcgcggcgagaccgatcatcacgcggtctccagagggagcgccaagctccggtggttcgtggaaagaaacctggtgacaccggagggaaaagttgtcgaccttggctgcggccgcgggggatggtcttattactgtggcgggctgaagaatgtgaaagaagtgaagggactcaccaaaggcgggcctggacatgaggaacccattcccatgagcacatatggctggaacctggtccggctgcagtccggcgttgatgtgttctttacgcctcccgagaagtgcgacaccctcctttgtgatatcggggagtctagccctaatccgacagtggaagctggaagaaccctgcgcgtcctgaacctcgtggagaattggctgaacaataacacacagttctgcattaaggttcttaatccctacatgccttccgtgatcgagaaaatggaggccctgcaacggaagtacggcggggctctcgtcagaaaccccctgagccgcaactccacccacgaaatgtattgggtgtctaatgccagcggaaacatcgtttcctctgtgaatatgattagccggatgctgatcaacagatttacgatgcgccacaaaaaggcgacctacgagcctgacgtcgatctcggctccgggacacggaatattggaatcgagtctgaaacccccaaccttgacattatcggcaaaagaatcgagaagattaagcaggaacatgagacaagctggcactatgatcaggaccatccgtacaaaacctgggcctatcacggctcctacgaaacaaagcagaccgggagcgcttcttccatggtgaatggagtggtccgcctgctgacgaaaccttgggacgttatccccatggtgacacaaatggccatgaccgataccacacctttcggccagcagcgggtgtttaaggagaaagtcgacacgagaacccaggagcccaaggaagggacaaagaaactcatgaagattaccgctgagtggctgtggaaagaacttggaaagaaaaagacacctcgcatgtgtaccagagaggagttcacacggaaagtgcgcagcaacgccgctctgggcgccatctttaccgatgaaaataagtggaagtctgcgagagaggccgttgaagactccgggttctgggagctcgtggataaagaacggaacctgcacctggagggaaagtgcgagacgtgtgtctataatatgatgggcaaaagagaaaagaaactcggcgagtttgggaaggctaagggaagccgggccatttggtacatgtggctgggcgctcgcttccttgaatttgaggccctggggttcctcaacgaagaccattggttttctagagaaaattccctgagcggagtggagggcgaagggcttcacaaactgggctacatcctccgggatgtttccaagaaagagggaggcgccatgtatgcggacgataccgctgggtgggacacacgcattaccctggaagatctgaagaacgaggaaatggtgacaaatcatatggagggagagcacaaaaagctcgccgaagccatcttcaagctgacctaccaaaacaaagtcgtgagagttcagcggcccacgccgcgcggcacagtgatggacatcattagcagacgggaccagcgcgggtctggacaggtcgtgacctatggccttaacacattcaccaatatggaggctcaactgatcagacagatggaaggggagggcgtctttaagagcattcagcaactcacggtgaaagaggaaatcgccgttaagaactggctgattcgggtgggacgcgagagactttcccggatggctatctctggcgatgactgcgtcgtgaaacctctggatgaccgcttcgccagcgcgctcaccgccctgaatgatatggggaaggtgagaaaggacatccagcagtgggaaccctcccggggatggaacgattggacacaggttcccttttgctctcatcacttccacgagctgattatgaaagacggcagagtgctcgtcgtgccttgtcgcaatcaagatgaactgatcgggcgggctagaattagccagggagccggctggtcccttcgcgagaccgcttgcctggggaagtcttacgcccagatgtggagcctcatgtattttcatcggagagacctgcgccttgcggccaacgctatctgttccgccgttccgagccactgggtgcccacatctcggaccacatggtccattcatgctacccacgagtggatgacgacagaagatatgctgaccgtctggaatagagtgtggatccaggagaacccttggatggaagacaaaacccccgtcgagagctgggaagagatcccttacctcggcaagcgcgaggatcaatggtgcggatctctgattggcctgacatcccgggccacctgggctaaaaatatccagacagccattaaccaggtgagaagcctcatcgggaatgaagagtatacggactacatgccctccatgaagcgcttccggagagaagaggaagaggcgggagttctgtggtga

SEQ ID NO: 20239 - RNA, 9876 nt, synthetic construct
  misc_feature 1..9876: note = derived and/or modified CDS sequence (opt5) from DENV-2__KM279609__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattctctgcgtgcccaacgcggtcatcctgcagaatgcttggaaagtgagctgtacaacgctcgccgttgtgtccgtcagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcaaagagccggagtcctgtgggacgtgccgagccctccccctgttggcaaagctgaactcgaggatggggcctaccggatcaagcagaagggcattctgggctattcccagatcggcgccggggtgtacaaagaaggaacatttcacaccatgtggcatgtcacacgcggcgctgtgcttatgcacaaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcaaaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcagacagagaagtccattgaggacaaccccgaaatcgaggatgacattttccgcaaaaagcggctgacgatcatggatctccatcctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaattataacctgattatcatggatgaggcccactttacagaccctgcttccattgccgctcgcggctacatctctaccagagtggaaatgggggaggccgccggcatcttcatgacagctacacccccgggaagccgggacccttttccccagtccaatgcgcccattatggatgaggaacgcgagatccctgaaagaagctggaactctggccacgagtgggtcacggacttcaaggggaagacagtgtggtttgtgccctccattaaagccggaaatgatatcgctgcctgcctccggaagaacggcaaaaaggtcattcaactgagcagaaaaaccttcgactctgaatatatcaagacccgcacaaatgattgggactttgttgtgaccacagatatcagcgagatgggggccaacttcaaggctgagcgggtgattgaccctagacgctgtatgaaaccggtcatccttaccgatggagaggaacgggtgattctggccggccccatgcctgttacgcattcctctgcggctcagagacgcgggcgggtgggcagaaatcccaagaacgaaaatgaccagtacatctacatgggagagcctctcgaaaacgatgaggactgcgcccactggaaagaggccaagatgctgctggacaatattaacacacccgaaggcatcatcccgagcatgtttgagcctgaacgcgagaaagtcgatgctattgacggggaatatagactccggggagaggcccgcaagaccttcgtggatcttatgagacggggcgacctgcccgtttggctggcgtaccgcgtggccgctgaggggatcaactatgccgatagacggtggtgttttgacggagtcaaaaataaccaaattctcgaagagaatgtggaagtcgagatctggacaaaggagggcgaaagaaagaaactgaagcctcgctggcttgatgctcggatttactccgaccccctggccctcaaagagttcaaggagttcgctgccgggagaaaatctctgaccctgaacctcatcacggagatgggccgccttcctacctttatgacacagaaggcgaagaatgccctggataacctggctgtgctccataccgccgaagctggaggccgggcctataatcacgccctgagcgagcttcccgagacactggaaaccctcctgctgctcacacttctggctaccgttacagggggaattttcctgtttctcatgtccggcaaagggatcggaaagatgacactgggcatgtgctgcatcattaccgcgagcatccttctgtggtacgcccagattcagccgcactggatcgctgcctctattatcctcgagttctttctgatcgtgctgctcattcctgaacccgagaaacaaagaacaccccaggacaaccagcttacatatgtggtcatcgccattctgaccgttgtggctgccacaatggcgaatgaaatgggcttcctggagaagacgaaaaaggattttgggctcggatccatcaccacacagcaacctgagagcaacattctggacatcgatcttcggccggcctccgcttggaccctgtacgccgtggctacaaccttcatcacgcccatgctccgccattctattgaaaatagctccgtcaacgtgtctctgaccgccatcgcgaatcaggccacagttctgatgggcctcgggaagggatggcctcttagcaaaatggacattggcgtgcccctgctggctatcgggtgttactcccaggtcaaccctattaccctcacagccgctctgcttctgctcgtggcccactatgctatcattggacccggcctgcaggccaaggcgaccagagaggcccaaaaacgggctgccgctggcatcatgaagaatcctacggtcgacgggatgacagtgatcgatctggacccgattccctacgatcctaaatttgaaaagcagctcggacaggttatgcttctggtgctgtgcgtcacccaggtgctcatgatgcgcacaacctgggccctgtgtgaggcccttaccctggcgacaggccccatcagcacgctctgggaagggaaccctggaagattctggaataccacaattgctgtttctatggccaacatctttcggggctcctatctggctggggccggactcctgttcagcattatgaagaacaccgccaatacacgcagaggcaccggcaacacgggggagacacttggagagaaatggaagaatcggctgaacgctctgggcaaatctgaatttcaaatctacaagaaatccgggatccaggaggtggaccgcaccctcgccaaggaaggaattaaaagaggcgagaccgatcatcacgcggtcagccgggggtctgccaagctgagatggttcgtggagcgcaatcttgtgacacccgaaggaaaggttgtcgacctgggctgcggcagagggggatggagctattactgtggcgggctcaaaaacgtgaaggaggtgaaaggactgaccaagggcgggccgggacatgaagaacctatccccatgtccacatatggctggaatctggtcagactccagtctggcgttgatgtgttctttacgccccctgaaaaatgcgacacccttctgtgtgatattggggagagctcccccaaccctacagtggaggctggacgcaccctgcgggtcctcaatctggtggaaaactggcttaataacaatacacaattctgcatcaaggttctgaacccgtacatgcccagcgtgattgagaagatggaagccctccagagaaaatacggcggggctctggtccgcaatcctctgtcccggaactctacccacgagatgtattgggtgagcaacgcctccggaaatatcgtttctagcgtgaacatgatctccagaatgctcattaatcgctttacgatgcggcacaagaaagcgacctacgaacccgacgtcgatcttggctctgggacaagaaacatcggaattgagagcgagacccctaatctggacatcattggcaagcgcatcgagaagatcaagcaggagcatgaaacatcctggcactatgatcaggaccatccctacaagacctgggcctatcacggcagctacgagacaaaacaaaccgggtctgcttccagcatggtgaacggagtggtccggctgctcacgaagccgtgggacgttattcctatggtgacacagatggccatgaccgataccacacccttcggccagcagagagtgtttaaagaaaaggtcgacacgcgcacccaagagcctaaagaggggacaaagaagctgatgaaaatcaccgctgaatggctttggaaggagctgggcaaaaagaaaacacccagaatgtgtacccgggaagagttcacacgcaaggtgagatctaatgccgctctcggcgccatttttaccgatgagaacaaatggaagtccgcgcgggaagccgttgaggacagcgggttctgggaactggtggataaggagagaaatctgcacctcgaaggaaaatgcgagacgtgtgtctataacatgatgggcaagcgggagaaaaagctgggcgaatttgggaaagctaagggatctcgcgccatctggtacatgtggcttggcgctagattcctggagtttgaagccctcgggttcctgaatgaggaccattggttttcccgggaaaacagcctttccggagtggagggcgaggggctgcacaagctcggctacattctgcgcgatgttagcaaaaaggaaggaggcgccatgtatgcggacgataccgctgggtgggacacaagaatcaccctggaggatctcaaaaatgaagagatggtgacaaaccatatggaaggagagcacaagaaactggccgaggccattttcaaacttacctaccagaataaggtcgtgcgggttcagcgccctacgcccagaggcacagtgatggacatcatctctcggcgcgaccagagagggagcggacaagtcgtgacctatggcctgaacacattcaccaacatggaagctcagctcattcggcagatggagggggaaggcgtctttaaatccatccaacagctgacggtgaaggaggagattgccgttaaaaattggcttatccgcgtgggaagagaacggctgtctcgcatggctattagcggcgatgactgcgtcgtgaagccgctcgatgacagattcgcctccgcgctgaccgccctgaacgatatggggaaagtgcggaaggacatccagcagtgggagccttctagaggatggaatgattggacacaagttcccttttgcagccatcacttccacgaactcatcatgaaggacggccgcgtgctggtcgtgccctgtcggaaccaggatgagcttattgggagagctcgcatctcccagggagccggctggtctctgcgggaaaccgcttgcctcgggaaaagctacgcccagatgtggtccctgatgtattttcatagacgcgaccttcggctggcggccaatgctatttgtagcgccgttccttctcactggatcccgacatccagaaccacatggagcattcatgctacccacgagtggatgacgacagaggatatgctcaccgtgtggaaccgcgtctggatccaagaaaatccctggatggaggacaagacccctgtggaatcttgggaggaaatcccctacctgggcaaacgggaggatcagtggtgcggatccctgattggcctcacaagcagagccacctgggctaagaacatccagacagccattaatcaggtccgctccctgatcgggaacgaggaatatacggactacatgccttctatgaaacggttcagacgggaggaagaggaagcgggagtgctttggtga

SEQ ID NO: 20240 - RNA, 9876 nt, synthetic construct
  misc_feature 1..9876: note = derived and/or modified CDS sequence (opt5) from DENV-2__KM279607__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctatctccagagagttctgatttttatccttctgacagccgtgacgccttccatggcgatgcggtgcattggaatctctaaccgcgacttcgtcgaaggcgtgagcgggggatcctgggttgatatcgtgctcgagcacggcagctgtgtcaccacaatggccaaaaataagcccaccctggactttgaacttattaagacagaggctaaacaccctgccaccctgagaaagtactgcgtggaagctaaactcacgaacacaaccaccgcctctcggtgtccgacacagggggagccctccctgaatgaggaacaagataagcgcttcgtgtgcaaacatagcatggtcgacagaggatggggcaacggctgtgggctgtttggaaagggcgggatcgttacctgcgcgatgttcacatgcaagaaaaatatggagggaaaggtggtgcagcctgaaaacctcgagtatacgattgtcatcaccccccactctggcgaagagaatgccgtggggaacgatacaggaaaacatggcaaggagattaaagttacccctcagtccagcatcacagaagctgagctgaccggctacgggacggtgaccatggaatgttctccccggacaggacttgactttaatgagatggtcctgctccagatggaaaacaaggcctggctggtgcaccgccaatggttccttgatctgccgctcccttggctgcccggcgctgacacccaggggtccaactggatccagaaagagacactggttacctttaagaatcctcacgccaagaaacaggatgtggtcgtgctcggaagccaagagggcgccatgcatacggctctgacaggggcgaccgaaattcagatgtcctctggcaaccttctgttcacaggacacctcaagtgcagactgcggatggacaaacttcagctgaagggcatgagctattccatgtgtaccgggaaatttaaggtcgtgaaggagatcgccgaaacccaacatggaacaattgttatcagagtgcagtacgagggcgacgggagcccctgcaaaattcccttcgagatcatggatctcgaaaagcgccacgtcctgggacggctgatcacggtgaatcctattgttaccgagaaagacaacccggtgaatatcgaagctgagccccctttcggcgattcttacattatcattggggtcgaacccggccagctcaagctgtcctggtataaaaagggaagctctatcggccagatgtttgagacaaccatgagaggggccaagcgcatggccattcttggagacacagcttgggatttcggcagcctggggggagtgtttacctccatcggcaaagccctccatcaagtgttcggggcgatctacggcgctgccttttctggagttagctggacgatgaagattctgatcggcgtcgtgattacatggatcgggatgaactcccggagcacctctctgtccgtgagccttgtcctcgtgggagttgtgaccctgtatctgggcgtcatggtgcaggccgactctgggtgtgttgtgtcctggaaaaataaggagctcaaatgcggaagcggcattttcatcacagataacgtccacacctggacagaacagtacaagtttcagcctgagtccccctctaagctggctagcgccatccaaaaagctcacgaagaggggatttgtggcatcagatccgtgacgcgccttgaaaatctgatgtggaagcagattaccccggagctcaaccatatcctgacagagaatgaagttaaactgaccattatgacaggagacatcaagggcatcatgcaggccgggaaacggtctcttagacctcagcccaccgagctcaagtatagctggaaagcgtggggaaaggccaagatgctgtccacggaactgcacaaccataccttcctcattgatggccctgagacagctgaatgccccaataccaaccgcgcctggaatagcctggaggtggaggactacgggtttggagtcttcacaaccaacatctggcttaaactgaaggaacggcaagatgtgttttgtgactctaaactcatgtccgctgccattaaggacaacagagcggtgcacgccgatatgggctattggatcgagagcgctctgaatgacacatggaaaattgaaaaggcctctttcatcgaggtcaagtcctgccactggcctaaaagccataccctgtggtctaacggcgttcttgagagcgaaatgatcattcccaagaattttgctgggccggtgtcccagcacaactaccgccctggataccatacgcagacagccggcccctggcacctcgggcggctggagatggatttcgacttctgtgaaggaaccaccgtggtcgtgacagaggattgcggcaatagagggcccagcctgcggaccacgacagcctctggaaaactcatcaccgaatggtgctgtcgctcctgcacactgcctccgcttagatatcggggcgaggacggctgttggtacgggatggagattagacccctgaaggaaaaagaggaaaacctcgttaatagcctggtgaccgctggacatggccagatcgataacttttccctgggggtccttggaatggcgctcttcctggaggaaatgctgcgcacacgggtgggcaccaagcacgccattctcctggttgctgtgtcttttgtcacgcttatcaccgggaatatgagcttcagagacctgggacgcgtgatggttatggtgggcgccacaatgaccgatgacattggcatgggggtcacatatctcgccctgctggctgcctttaaggtgagacctaccttcgcggctggacttctgctccggaaactgacgtccaaggagctcatgatgacaaccatcggcatcgtgctgctttctcaaagcacaattcccgagtccatcctggaactcaccgatgccctggccctggggatgatggtccttaaaattgttcgcaacatggagaagtaccagctggctgtgaccatcatggccattctctgcgtgcctaatgcggtcatcctggaaaacgcttggaaagtgtcttgtacaacgctcgccgttgtgagcgtctcccccctgcttctgaccagctctcagcaaaaggccgactggatccctctcgctctgacaattaagggactgaatcccaccgccatctttcttacaaccctgtccagaacgagcaaaaagcggtcttggccgctcaacgaggctattatggccgtgggcatggtttccatcctggcgagctctctcctgaaaaatgatattcctatgacagggccccttgtggccggaggcctgctgaccgtctgctatgtgctcaccggccgctccgctgacctggaacttgagagagccgctgacgtccggtgggaggaacaggccgagatcagcgggtccagccctatcctgtctattacaatcagcgaagatggatccatgtctattaagaacgaggaggaagagcagaccctcacaatcctgattcgcacgggcctcctggtgatcagcgggcttttccccgtttccattccgatcaccgccgctgcgtggtacctgtgggaagtgaaaaagcagagagccggagtcctgtgggacgtgccttctccccctcccgttggcaaagctgagctcgaagatggggcctatcggatcaagcaaaagggaattctgggctacagccagatcggcgccggggtgtacaaagagggaacatttcacaccatgtggcatgtcacacgcggcgctgtgcttatgcacaaggggaaaagaattgagccctcctgggccgacgtgaagaaagatctgatctcttatggaggcgggtggaagctcgaaggagagtggaaggaaggcgaggaagttcaggtcctggcgctcgagcctggcaaaaacccgcgggctgtgcagaccaagcccgggctgttcaaaacgaataccggaacaattggcgccgtgagccttgacttttcccctgggaccagcggatctcccatcgtcgataagaaaggcaaggtggttgggctgtacggaaacggcgtggtcacaagatccggcacctatgtgagcgccatcgctcaaacagagaagtctattgaagacaatcctgagatcgaagatgacattttccgcaaaaagcggctgacgatcatggatctccatcccggggccggaaaaaccaagagatacctgcctgcgattgttcgcgaggctatcaaacggggccttagaacactgatcctcgccccgacccgcgtggtcgccgctgaaatggaggaggccctgcgggggctccccattagatatcagacccctgctatccgcgccgaacacacaggacgggagattgtggacctgatgtgtcatgcgacgtttaccatgagacttctgtcccccatccgggttcctaactacaatctgattatcatggatgaagcccacttcacagaccccgctagcattgccgctcgcggctatatctccaccagagtggagatgggggaggccgccggcatcttcatgacagctaccccgcctggatctcgggacccctttccccagagcaacgcgcctattatggatgaagagcgcgaaatccccgagagatcctggaatagcggccacgaatgggtcacggacttcaaggggaagacagtgtggtttgtgccttctattaaagccggaaacgatatcgctgcctgcctccggaagaatggcaaaaaggtcattcagctgtccagaaaaaccttcgacagcgagtacatcaagacccgcacaaacgattgggactttgttgtgaccacagatatctctgagatgggggccaatttcaaggctgaacgggtgattgacccgagacgctgtatgaaacccgtcatccttaccgatggagaggaacgggtgattctggccggccctatgcccgttacgcatagctccgcggctcaaagacgcgggcgggtgggcagaaaccctaagaatgagaacgaccagtacatctatatgggagaacccctcgagaatgatgaggactgcgcccactggaaagaagccaagatgctgctggacaacattaacacaccggagggcatcatcccttctatgtttgaacccgagcgcgaaaaagtcgatgctattgacggggagtacagactccggggagaggcccgcaagaccttcgtggatcttatgagacggggcgacctgcctgtttggctggcgtataaagtggccgctgaagggatcaattacgccgatcgcagatggtgttttgacggagtcaagaacaatcagattctcgaggaaaacgtggaggtcgagatctggacaaaggaaggcgagcggaaaaagctgaaacccagatggcttgatgctcgcatttatagcgaccctctggccctcaaggaattcaaagagtttgctgccgggcggaagtccctgaccctgaatctcatcacggaaatgggcagacttcccaccttcatgacacaaaaggcgaaaaacgccctggataatctggctgtgctccataccgccgaggctggaggccgcgcctacaaccacgccctgtctgagcttccggaaacactggagaccctcctgctgctcacacttctggctaccgttacggggggaattttcctgtttctcatgagcggcaaggggatcggaaaaatgacactgggcatgtgctgcatcattaccgcgtccatccttctgtggtatgcccagattcagcctcactggatcgctgccagcattatcctcgaattctttctgatcgtgctgctcattcccgagcccgaaaagcagcggacccctcaagacaatcagcttacatacgtggtcatcgccattctgaccgttgtggctgccacaatggcgaacgagatgggcttcctggagaaaacgaagaaggattttgggctcggatctatcaccacacagcagccggaatccaatattctggacatcgatcttagacccgccagcgcttggaccctgtacgccgtggctacaaccttcatcacgcctatgctccggcattccattgagaactctagcgtcaatgtgtccctgaccgccatcgcgaaccaagccacagttctgatgggcctcgggaaaggatggcccctttctaagatggacattggcgtgcctctgctggctatcgggtgttatagccaggtcaatcccattaccctcacagccgctctgcttctgctcgtggcccactacgctatcattggacctggcctgcaggccaaagcgacccgcgaagcccagaagagagctgccgctggcatcatgaaaaacccgacggtcgacgggatcacagtgattgatctggaccccatcccttatgatcccaagtttgagaagcaactcggacaggttatgcttctggtgctgtgcgtcacccaggtgctcatgatgcggacaacctgggccctgtgtgaagcccttaccctggcgacaggccctatttccacgctctgggaggggaatcccggacgcttctggaacaccacaatcgctgttagcatggccaacatttttagaggctcttacctggctggggccggactgctcttctccatcatgaaaaataccgccaacacacggcgcggcaccggcaatacgggggagacacttggagaaaagtggaaaaacagactgaatgctctgggcaagagcgagtttcagatctataaaaagtctgggattcaagaagtggaccggaccctcgccaaagagggaatcaagcgcggcgagaccgatcatcacgcggtctccagagggagcgccaagctgcggtggttcgtggaaagaaaccttgtgacaccggagggaaaagttgtcgacctgggctgcggccgcgggggatggtcttactattgtggcgggctcaagaatgtgaaagaagtgaagggactgaccaaaggcgggcctggacatgaggaacccattcccatgagcacatacggctggaacctggtccggctccagtccggcgttgatgtgtttttcacgcctcccgagaagtgcgacacccttctgtgtgatatcggggagtctagccctaatccgacagtggaagctggaagaaccctgcgcgtcctcaacctggtggagaattggcttaacaataacacacagttctgcattaaggttctgaatccctacatgccttccgtgatcgaaaaaatggaggccctccaacggaagtatggcggggctctggtcagaaaccccctgagccgcaactccacccacgaaatgtactgggtgtctaatgccagcggaaacatcgtttcctctgtgaatatgattagccggatgctcatcaacagatttacgatgcgccacaaaaaggcgacctatgagcctgacgtcgatcttggctccgggacacggaatattggaatcgagtctgaaacccccaacctggacattatcggcaaaagaatcgagaagattaagcaggaacatgagacaagctggcactacgatcaggaccatccgtataaaacctgggcctaccacggctcctatgaaacaaagcagaccgggagcgcttcttccatggtgaatggagtggtcaaactgctcacgaagccttgggacgttatccccatggtgacacaaatggccatgaccgataccacacctttcggccagcagcgcgtgtttaaagagaaggtcgacacgcggacccaggagcccaaggaagggacaaaaaagctgatgaaaattaccgctgagtggctttggaaggaactgggaaaaaagaaaacacctagaatgtgtacccgcgaggagttcacaagaaaggtgcggagcaacgccgctctcggcgccatctttaccgatgaaaataagtggaaatctgcgcgcgaggccgttgaagactccgggttctgggagctggtggataaggaaagaaacctgcacctcgagggaaaatgcgagacgtgtgtctacaatatgatgggcaagcgggaaaaaaagctgggcgagtttgggaaggctaaaggaagcagagccatttggtacatgtggcttggcgctcggttcctggaatttgaggccctcgggttcctgaacgaagaccattggttttctcgcgagaattcccttagcggagtggagggcgaagggctgcacaagctcggctatatcctgagagatgtttccaaaaaggagggaggcgccatgtacgcggacgataccgctgggtgggacacacggattaccctggaagatctcaaaaacgaggaaatggtgacaaatcatatggagggagagcacaagaagctggccgaagccatcttcaaacttacctatcaaaacaaggtcgtgcgcgttcagagacccacgccgcggggcacagtgatggacatcattagccgcagagaccagcgggggtctggacaggtcgtgacctacggcctgaacacatttaccaatatggaggctcaactcatccgccagatggaaggggagggcgtcttcaaaagcattcagcaactgacggtgaaggaggaaatcgccgttaaaaactggcttattagagtgggacgggagcgcctgtccagaatggctatctctggcgatgactgcgtcgtgaagcctctcgatgaccggttcgccagcgcgctgaccgccctgaatgatatggggaaggtgcgcaaagacatccagcagtgggaaccctccagaggatggaacgattggacacaggttcccttttgctctcatcacttccacgagctcattatgaaggacggccgggtgctggtcgtgccttgtagaaatcaagatgaacttatcgggcgcgctcggattagccagggagccggctggtccctgagagagaccgcttgcctcgggaaatcttatgcccagatgtggagcctgatgtactttcatcgccgggaccttagactggcggccaacgctatctgttccgccgttccgagccactgggtgcccacatctcgcaccacatggtccattcatgctacccacgagtggatgacgacagaagatatgctcaccgtctggaatcgggtgtggatccaggagaacccttggatggaagacaagacccccgtcgagagctgggaagagatcccttatctgggcaaaagagaggatcaatggtgcggatctctgattggcctcacatcccgcgccacctgggctaagaatatccagacagccattaaccaggtgcggagcctgatcgggaatgaagagtacacggactacatgccctccatgaagagattccgccgggaagaggaagaggcgggagttctttggtga

SEQ ID NO: 20241 - RNA, 9876 nt, synthetic construct
  misc_feature 1..9876: note = derived and/or modified CDS sequence (opt5) from DENV-2__KM279606__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcaccccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagacaacccggtgaatatcgaagctgagcccccttttggcgattcttacattatcattggggtcgaacccggccagctgaagctctcctggtataaaaagggaagctctatcggccagatgttcgagacaaccatgagaggggccaagcgcatggccattctgggagacacagcttgggattttggcagccttgggggagtgttcacctccatcggcaaagccctgcatcaagtgtttggggcgatctacggcgctgccttctctggagttagctggacgatgaagattctcatcggcgtcgtgattacatggatcgggatgaactcccggagcacctctctgtccgtgagcctggtccttgtgggagttgtgaccctctatctgggcgtcatggtgcaggccgactctgggtgtgttgtgtcctggaaaaataaggagctgaaatgcggaagcggcatttttatcacagataacgtccacacctggacagaacagtacaagttccagcctgagtccccctctaagctcgctagcgccatccaaaaagctcacgaagaggggatttgtggcatcagatccgtgacgcgcctggaaaatcttatgtggaagcagattaccccggagctgaaccatatcctcacagagaatgaagttaaactgaccattatgacaggagacatcaagggcatcatgcaggccgggaaacggtctctgagacctcagcccaccgagcttaagtatagctggaaagcgtggggaaaggccaagatgctctccacggaactgcacaaccatacctttctgattgatggccctgagacagctgaatgccccaataccaaccgcgcctggaatagcctcgaggtggaggactacgggttcggagtctttacaaccaacatctggctgaaacttaaggaacggcaagatgtgttctgtgactctaaactgatgtccgctgccattaaggacaacagagcggtgcacgccgatatgggctattggatcgagagcgctctcaatgacacatggaaaattgaaaaggcctcttttatcgaggtcaagtcctgccactggcctaaaagccataccctgtggtctaacggcgttctggagagcgaaatgatcattcccaagaatttcgctgggccggtgtcccagcacaactaccgccctggataccatacgcagacagccggcccctggcaccttgggcggctcgagatggatttcgacttttgtgaaggaaccaccgtggtcgtgacagaggattgcggcaatagagggcccagcctgcggaccacgacagcctctggaaaactgatcaccgaatggtgctgtcgctcctgcacactccctccgctgagatatcggggcgaggacggctgttggtacgggatggagattagaccccttaaggaaaaagaggaaaacctggttaatagcctcgtgaccgctggacatggccagatcgataacttctccctgggggtcctgggaatggcgctttttctcgaggaaatgctgcgcacacgggtgggcaccaagcacgccattctgctcgttgctgtgtctttcgtcacgctgatcaccgggaatatgagctttagagaccttggacgcgtgatggttatggtgggcgccacaatgaccgatgacattggcatgggggtcacatatctggccctcctggctgccttcaaggtgagacctacctttgcggctggactgcttctgcggaaactcacgtccaaggagctgatgatgacaaccatcggcatcgtgctcctgtctcaaagcacaattcccgagtccatccttgaactgaccgatgccctcgccctggggatgatggtcctgaaaattgttcgcaacatggagaagtaccagcttgctgtgaccatcatggccattctgtgcgtgcctaatgcggtcatcctcgaaaacgcttggaaagtgtcttgtacaacgctggccgttgtgagcgtctcccccctcctgcttaccagctctcagcaaaaggccgactggatccctctggctctcacaattaagggactgaatcccaccgccatcttcctgacaaccctttccagaacgagcaaaaagcggtcttggccgctgaacgaggctattatggccgtgggcatggtttccatcctcgcgagctctctgctcaaaaatgatattcctatgacagggcccctggtggccggaggccttctgaccgtctgctatgtgctgaccggccgctccgctgacctcgaactggagagagccgctgacgtccggtgggaggaacaggccgagatcagcgggtccagccctatcctttctattacaatcagcgaagatggatccatgtctattaagaacgaggaggaagagcagaccctgacaatcctcattcgcacgggcctgctcgtgatcagcgggctgtttcccgtttccattccgatcaccgccgctgcgtggtacctttgggaagtgaaaaagcagagagccggagtcctgtgggacgtgccttctccccctcccgttggcaaagctgagctggaagatggggcctatcggatcaagcaaaagggaattctcggctacagccagatcggcgccggggtgtacaaagagggaacattccacaccatgtggcatgtcacacgcggcgctgtgctgatgcacaaggggaaaagaattgagccctcctgggccgacgtgaagaaagatcttatctcttatggaggcgggtggaagctggaaggagagtggaaggaaggcgaggaagttcaggtcctcgcgctggagcctggcaaaaacccgcgggctgtgcagaccaagcccgggctctttaaaacgaataccggaacaattggcgccgtgagcctggacttctcccctgggaccagcggatctcccatcgtcgataagaaaggcaaggtggttgggctttacggaaacggcgtggtcacaagatccggcacctatgtgagcgccatcgctcaaacagagaagtctattgaagacaatcctgagatcgaagatgacatttttcgcaaaaagcggctgacgatcatggatctgcatcccggggccggaaaaaccaagagatacctccctgcgattgttcgcgaggctatcaaacggggcctgagaacacttatcctggccccgacccgcgtggtcgccgctgaaatggaggaggccctccgggggctgcccattagatatcagacccctgctatccgcgccgaacacacaggacgggagattgtggacctcatgtgtcatgcgacgttcaccatgagactgctttcccccatccgggttcctaactacaatctgattatcatggatgaagcccacttcacagaccccgctagcattgccgctcgcggctatatctccaccagagtggagatgggggaggccgccggcatctttatgacagctaccccgcctggatctcgggaccccttcccccagagcaacgcgcctattatggatgaagagcgcgaaatccccgagagatcctggaatagcggccacgaatgggtcacggactttaaggggaagacagtgtggttcgtgccttctattaaagccggaaacgatatcgctgcctgcctgcggaagaatggcaaaaaggtcattcagctctccagaaaaacctttgacagcgagtacatcaagacccgcacaaacgattgggacttcgttgtgaccacagatatctctgagatgggggccaattttaaggctgaacgggtgattgacccgagacgctgtatgaaacccgtcatcctgaccgatggagaggaacgggtgattcttgccggccctatgcccgttacgcatagctccgcggctcaaagacgcgggcgggtgggcagaaaccctaagaatgagaacgaccagtacatctatatgggagaacccctggagaatgatgaggactgcgcccactggaaagaagccaagatgctcctggacaacattaacacaccggagggcatcatcccttctatgttcgaacccgagcgcgaaaaagtcgatgctattgacggggagtacagactgcggggagaggcccgcaagacctttgtggatctcatgagacggggcgaccttcctgtttggctggcgtataaagtggccgctgaagggatcaattacgccgatcgcagatggtgtttcgacggagtcaagaacaatcagattctggaggaaaacgtggaggtcgagatctggacaaaggaaggcgagcggaaaaagctcaaacccagatggctggatgctcgcatttatagcgaccctcttgccctgaaggaatttaaagagttcgctgccgggcggaagtccctcaccctgaatctgatcacggaaatgggcagactccccaccttcatgacacaaaaggcgaaaaacgcccttgataatctggctgtgctgcataccgccgaggctggaggccgcgcctacaaccacgccctctctgagctgccggaaacacttgagaccctgctcctgctgacactccttgctaccgttacggggggaatttttctgttcctgatgagcggcaaggggatcggaaaaatgacactcggcatgtgctgcatcattaccgcgtccatcctgctttggtatgcccagattcagcctcactggatcgctgccagcattatcctggaatttttcctcatcgtgctgctgattcccgagcccgaaaagcagcggacccctcaagacaatcagctcacatacgtggtcatcgccattcttaccgttgtggctgccacaatggcgaacgagatgggctttctggagaaaacgaagaaggatttcgggctgggatctatcaccacacagcagccggaatccaatattctcgacatcgatctgagacccgccagcgcttggaccctttacgccgtggctacaacctttatcacgcctatgctgcggcattccattgagaactctagcgtcaatgtgtccctcaccgccatcgcgaaccaagccacagttctgatgggcctggggaaaggatggcccctctctaagatggacattggcgtgcctcttctggctatcgggtgttatagccaggtcaatcccattaccctgacagccgctctcctgcttctggtggcccactacgctatcattggacctggcctccaggccaaagcgacccgcgaagcccagaagagagctgccgctggcatcatgaaaaacccgacggtcgacgggatcacagtgattgatctggaccccatcccttatgatcccaagttcgagaagcaactgggacaggttatgctccttgtgctgtgcgtcacccaggtgctgatgatgcggacaacctgggccctctgtgaagccctgacccttgcgacaggccctatttccacgctgtgggaggggaatcccggacgcttttggaacaccacaatcgctgttagcatggccaacattttcagaggctcttacctcgctggggccggactgctgttttccatcatgaaaaataccgccaacacacggcgcggcaccggcaatacgggggagacactcggagaaaagtggaaaaacagacttaatgctctgggcaagagcgagttccagatctataaaaagtctgggattcaagaagtggaccggaccctggccaaagagggaatcaagcgcggcgagaccgatcatcacgcggtctccagagggagcgccaagctccggtggtttgtggaaagaaacctggtgacaccggagggaaaagttgtcgaccttggctgcggccgcgggggatggtcttactattgtggcgggctgaagaatgtgaaagaagtgaagggactcaccaaaggcgggcctggacatgaggaacccattcccatgagcacatacggctggaacctggtccggctgcagtccggcgttgatgtgttcttcacgcctcccgagaagtgcgacaccctcctttgtgatatcggggagtctagccctaatccgacagtggaagctggaagaaccctgcgcgtcctgaacctcgccgagaattggctgaacaataacacacagttttgcattaaggtgcttaatccctacatgccttccgttatcgaaaaaatggaggctctgcaacggaagtatggcggggccctcgtgagaaaccccctgagccgcaactccacccacgaaatgtactgggtctctaatgcgagcggaaacatcgtgtcctctgttaatatgattagccggatgctgatcaacagattcacgatgcgccacaaaaaggccacctatgagcctgacgtggatctcggctccgggacacggaatattggaatcgagtctgaaacccccaaccttgacattatcggcaaaagaatcgagaagattaagcaggaacatgagacaagctggcactacgatcaggaccatccgtataaaacctgggcttaccacggctcctatgaaacaaagcagaccgggagcgcctcttccatggtcaatggagtggtgcgcctgctgacgaaaccttgggacgtcatccccatggttacacaaatggctatgaccgataccacaccttttggccagcagcgggtgttcaaggagaaagtggacacgagaacccaggagcccaaggaagggacaaagaaactcatgaagattaccgccgagtggctgtggaaagaacttggaaagaaaaagacacctcgcatgtgtaccagagaggagtttacacggaaagtccgcagcaacgctgccctgggcgcgatcttcaccgatgaaaataagtggaagtctgccagagaggctgtggaagactccgggttttgggagctcgttgataaagaacggaacctgcacctggagggaaagtgcgagacgtgtgtgtacaatatgatgggcaaaagagaaaagaaactcggcgagttcgggaaggccaagggaagccgggctatttggtacatgtggctgggcgcccgctttcttgaattcgaggccctggggtttctcaacgaagaccattggttctctagagagaattccctgagcggagtcgagggcgaagggcttcacaaactgggctatatcctccgggatgtgtccaagaaagagggaggcgcgatgtacgctgacgataccgccgggtgggacacacgcattaccctggaagatctgaagaacgaggaaatggttacaaatcatatggagggagagcacaaaaagctcgccgaagctatctttaagctgacctatcaaaacaaagtggtcagagtgcagcggcccacgccgcgcggcacagttatggacatcattagcagacgggaccagcgcgggtctggacaggtggtcacctacggccttaacacattcaccaatatggaggcccaactgatcagacagatggaaggggagggcgtgttcaagagcattcagcaactcacggtcaaagaggaaatcgctgtgaagaactggctgattcgggttggacgcgagagactttcccggatggccatctctggcgatgactgcgtggtcaaacctctggatgaccgctttgcgagcgccctcaccgctctgaatgatatggggaaggtgagaaaggacatccagcagtgggaaccctcccggggatggaacgattggacacaggtgcccttctgctctcatcactttcacgagctgattatgaaagacggcagagttctcgtggtcccttgtcgcaatcaagatgaactgatcgggcgggccagaattagccagggagctggctggtcccttcgcgagaccgcctgcctggggaagtcttatgcgcagatgtggagcctcatgtacttccatcggagagacctgcgccttgccgctaacgccatctgttccgctgtgccgagccactgggttcccacatctcggaccacatggtccattcatgccacccacgagtggatgacgacagaagatatgctgaccgtgtggaatagagtctggatccaggagaacccttggatggaagacaaaacccccgtggagagctgggaagagatcccttatctcggcaagcgcgaggatcaatggtgcggatctctgattggcctgacatcccgggctacctgggccaaaaatatccagacagcgattaaccaggtcagaagcctcatcgggaatgaagagtacacggactacatgccctccatgaagcgctttcggagagaagaggaagaggccggagtgctgtggtga

SEQ ID NO: 20242 - RNA, 9876 nt, synthetic construct
  misc_feature 1..9876: note = derived and/or modified CDS sequence (opt5) from DENV-2__JN851113__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaaagcctcctgtttaagacggagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggttagcatcctcgcgtcttccctgctcaaaaacgatattcctatgacagggcccctggtggccggaggccttctgaccgtctgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtttctattccgatcaccgccgctgcgtggtatctttgggaggtgaaaaagcaaagagccggagtcctgtgggacgtgccttctccccctcccgttggcaaagctgaactggaggatggggcctaccggatcaagcagaagggcattctcggctattcccagatcggcgccggggtgtacaaagaaggaacatttcacaccatgtggcatgtcacacgcggcgctgtgctgatgcacaaggggaaaagaattgagccctcctgggccgacgtgaagaaagatcttatcagctacggaggcgggtggaagctggagggagaatggaaggagggcgaagaggttcaggtcctcgcgctggaacctggcaaaaacccgcgggctgtgcaaaccaagcccggactcttcaaaacgaacaccggaacaattggcgccgtgtccctggactttagccctgggacctctggatcccccatcgtcgataagaaaggcaaggtggttgggctttatggaaatggcgtggtcacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggacctcatgtgtcatgcgacgttcaccatgagactgcttagccccatccgggttcctaattataacctgattatcatggatgaggcccactttacagaccccgcttccattgccgctcgcggctacatctctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggtcacggacttcaaggggaagacagtgtggtttgtgccttccattaaagccggaaatgatatcgctgcctgcctgcggaagaacggcaaaaaggtcattcaactcagcagaaaaaccttcgactctgaatatatcaagacccgcacaaatgattgggactttgttgtgaccacagatatcagcgagatgggggccaacttcaaggctgagcgggtgattgacccgagacgctgtatgaaacccgtcatcctgaccgatggagaagaacgggtgattcttgccggccctatgcccgttacgcattcctctgcggctcagagacgcgggcgggtgggcagaaatcctaagaacgaaaatgaccagtacatctacatgggagagcccctggaaaacgatgaggactgcgcccactggaaagaggccaagatgctcctggacaatattaacacaccggaaggcatcatccctagcatgtttgagcccgaacgcgagaaagtcgatgctattgacggggaatatagactgcggggagaggcccgcaagaccttcgtggatctcatgagacggggcgaccttcctgtttggctggcgtaccgcgtggccgctgaggggatcaactatgccgatagacggtggtgttttgacggagtcaaaaataaccaaattctggaagagaatgtggaagtcgagatctggacaaaggagggcgaaagaaagaaactcaagccccgctggctggatgctcggatttactccgaccctcttgccctgaaagagttcaaggagttcgctgccgggagaaaatctctcaccctgaacctgatcacggagatgggccgcctccccacctttatgacacagaaggcgaagaatgcccttgataacctggctgtgctgcataccgccgaagctggaggccgggcctataatcacgccctcagcgagctgccggagacacttgaaaccctgctcctgctgacactccttgctaccgttacaggcgggattttcctgtttctgatgtccgggaaagggatcggaaagatgacactcggcatgtgctgcatcattaccgcgagcatcctgctttggtacgcccagattcagcctcactggatcgctgcctctattatcctggagttctttctcatcgtgctgctgattcccgaacccgagaaacaaagaacccctcaggacaaccagctcacatatgtggtcatcgccattcttaccgttgtggctgccacaatggcgaatgaaatgggcttcctggagaagacgaaaaaggattttgggctgggatccatcaccacacagcaaccggagagcaacattctcgacatcgatctgcggcccgcctccgcttggaccctttacgccgtggctacaaccttcatcacgcctatgctgcgccattctattgaaaatagctccgtcaacgtgtctctcaccgccatcgcgaatcaggccacagttctgatgggcctggggaagggatggcccctcagcaaaatggacattggcgtgcctcttctggctatcgggtgttactcccaggtcaaccccattaccctgacagccgctctcctgcttctggtggcccactatgctatcattggacctggcctccaggccaaggcgaccagagaggcccaaaaacgggctgccgctggcatcatgaagaatccgacggtcgacgggatgacagtgatcgatctggaccccattccttacgatcccaaatttgaaaagcagctgggacaggttatgctccttgtgctgtgcgtcacccaggtgctgatgatgcgcacaacctgggccctctgtgaggccctgacccttgcgacaggccctatcagcacgctgtgggaagggaaccccggaagattctggaataccacaattgctgtttctatggccaacatctttcggggctcctatctcgctggggccggactgctgttcagcattatgaagaacaccgccaatacacgcagaggcaccggcaacacgggggagacactcggagagaaatggaagaatcggcttaacgctctgggcaaatctgaatttcaaatctacaagaaatccgggatccaggaggtggaccgcaccctggccaaggaaggaattaaaagaggcgagaccgatcatcacgcggtcagccgggggtctgccaagctcagatggttcgtggagcgcaatctggtgacaccggaaggaaaggttgtcgaccttggctgcggcagagggggatggagctattactgtggcgggctgaaaaacgtgaaggaggtgaaaggactcaccaagggcgggcctggacatgaagaacccatccccatgtccacatatggctggaatctggtcagactgcagtctggcgttgatgtgttctttacgcctcccgaaaaatgcgacaccctcctttgtgatattggggagagctcccctaacccgacagtggaggctggacgcaccctgcgggtcctgaatctcgtggaaaactggctgaataacaatacacaattctgcatcaaggttcttaacccctacatgcctagcgtgattgagaagatggaagccctgcagagaaaatacggcggggctctcgtccgcaatcccctgtcccggaactctacccacgagatgtattgggtgagcaacgcctccggaaatatcgtttctagcgtgaacatgatctccagaatgctgattaatcgctttacgatgcggcacaagaaagcgacctacgaacctgacgtcgatctcggctctgggacaagaaacatcggaattgagagcgagacccccaatcttgacatcattggcaagcgcatcgagaaaatcaagcaggagcatgaaacatcctggcactatgatcaggaccatccgtacaagacctgggcctatcacggcagctacgagacaaaacaaaccgggtctgcttccagcatggtgaacggagtggtccggctgctgacgaagccttgggacgttattcccatggtgacacagatggccatgaccgataccacacctttcggccagcagagagtgtttaaagaaaaggtcgacacgcgcacccaagagcccaaagaggggacaaagaagctcatgaaaatcaccgctgaatggctgtggaaggagcttggcaaaaagaaaacacctagaatgtgtacccgggaagagttcacacgcaaggtgagatctaatgccgctctgggcgccatttttaccgatgagaacaaatggaagtccgcgcgggaagccgttgaggacagcgggttctgggaactcgtggataaggagagaaatctgcacctggaaggaaaatgcgagacgtgtgtctataacatgatgggcaagcgggagaaaaagctcggcgaatttgggaaagctaagggatctcgcgccatctggtacatgtggctgggcgctagattccttgagtttgaagccctggggttcctcaatgaggaccattggttttcccgggaaaacagcctgtccggagtggagggcgaggggcttcacaagctgggctacattctccgcgatgttagcaaaaaggaaggaggcgccatgtatgcggacgataccgctgggtgggacacaagaatcaccctggaggatctgaaaaatgaagagatggtgacaaaccatatggaaggagagcacaagaaactcgccgaggccattttcaagctgacctaccagaataaggtcgtgcgggttcagcgccccacgccgagaggcacagtgatggacatcatctctcggcgcgaccagagagggagcggacaagtcgtgacctatggccttaacacattcaccaacatggaagctcagctgattcggcagatggagggggaaggcgtctttaaatccatccaacagctcacggtgaaggaggagattgccgttaaaaattggctgatccgcgtgggaagagaacggctttctcgcatggctattagcggcgatgactgcgtcgtgaagcctctggatgacagattcgcctccgcgctcaccgccctgaacgatatggggaaagtgcggaaggacatccagcagtgggagccctctagaggatggaatgattggacacaagttcccttttgcagccatcacttccacgaactgatcatgaaggacggccgcgtgctcgtcgtgccttgtcggaaccaggatgagctgattgggagagctcgcatctcccagggagccggctggtctcttcgggaaaccgcttgcctggggaaaagctacgcccagatgtggtccctcatgtattttcatagacgcgacctgcggcttgcggccaatgctatttgtagcgccgttccgtctcactgggtgcccacatccagaaccacatggagcatccatgctacccacgagtggatgacgacagaggatatgctgaccgtctggaaccgcgtgtggattcaagaaaatccttggatggaggacaagacccccgtcgaatcttgggaggaaatcccttacctcggcaaacgggaggatcagtggtgcggatccctgatcggcctgacaagcagagccacctgggctaagaacattcagacagccatcaatcaggtgcgctccctcattgggaacgaggaatatacggactacatgccctctatgaaacggttcagacgggaggaagaggaagcgggagttctgtggtga

SEQ ID NO: 20243 - RNA, 9876 nt, synthetic construct
  misc_feature 1..9876: note = derived and/or modified CDS sequence (opt5) from DENV-2__GU370050__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaaagcctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggttagcatcctcgcgtcttccctgctcaaaaacgatattcctatgacagggcccctggtggccggaggccttctgaccgtctgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtttctattccgatcaccgccgctgcgtggtatctttgggaggtgaaaaagcaaagagccggagtcctgtgggacgtgccttctccccctcccgttggcaaagctgaactggaggatggggcctaccggatcaagcagaagggcattctcggctattcccagatcggcgccggggtgtacaaagaaggaacatttcacaccatgtggcatgtcacacgcggcgctgtgctgatgcacaaggggaaaagaattgagccctcctgggccgacgtgaagaaagatcttatcagctacggaggcgggtggaagctggagggagaatggaaggagggcgaagaggttcaggtcctcgcgctggaacctggcaaaaacccgcgggctgtgcaaaccaagcccggactcttcaaaacgaacaccggaacaattggcgccgtgtccctggactttagccctgggacctctggatcccccatcgtcgataagaaaggcaaggtggttgggctttatggaaatggcgtggtcacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggacctcatgtgtcatgcgacgttcaccatgagactgcttagccccatccgggttcctaattataacctgattatcatggatgaggcccactttacagaccccgcttccattgccgctcgcggctacatctctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggtcacggacttcaaggggaagacagtgtggtttgtgccttccattaaagccggaaatgatatcgctgcctgcctgcggaagaacggcaaaaaggtcattcaactcagcagaaaaaccttcgactctgaatatatcaagacccgcacaaatgattgggactttgttgtgaccacagatatcagcgagatgggggccaacttcaaggctgagcgggtgattgacccgagacgctgtatgaaacccgtcatcctgaccgatggagaagaacgggtgattcttgccggccctatgcccgttacgcattcctctgcggctcagagacgcgggcgggtgggcagaaatcctaagaacgaaaatgaccagtacatctacatgggagagcccctggaaaacgatgaggactgcgcccactggaaagaggccaagatgctcctggacaatattaacacaccggaaggcatcatccctagcatgtttgagcccgaacgcgagaaagtcgatgctattgacggggaatatagactgcggggagaggcccgcaagaccttcgtggatctcatgagacggggcgaccttcctgtttggctggcgtaccgcgtggccgctgaggggatcaactatgccgatagacggtggtgttttgacggagtcaaaaataaccaaattctggaagagaatgtggaagtcgagatctggacaaaggagggcgaaagaaagaaactcaagccccgctggctggatgctcggatttactccgaccctcttgccctgaaagagttcaaggagttcgctgccgggagaaaatctctcaccctgaacctgatcacggagatgggccgcctccccacctttatgacacagaaggcgaagaatgcccttgataacctggctgtgctgcataccgccgaagctggaggccgggcctataatcacgccctcagcgagctgccggagacacttgaaaccctgctcctgctgacactccttgctaccgttacaggcgggattttcctgtttctgatgtccgggaaagggatcggaaagatgacactcggcatgtgctgcatcattaccgcgagcatcctgctttggtacgcccagattcagcctcactggatcgctgcctctattatcctggagttctttctcatcgtgctgctgattcccgaacccgagaaacaaagaacccctcaggacaaccagctcacatatgtggtcatcgccattcttaccgttgtggctgccacaatggcgaatgaaatgggcttcctggagaagacgaaaaaggattttgggctgggatccatcaccacacagcaaccggagagcaacattctcgacatcgatctgcggcccgcctccgcttggaccctttacgccgtggctacaaccttcatcacgcctattctgcgccattctatcgaaaatagctccgtcaacgtgtctctcaccgccattgcgaatcaggccacagttctgatgggcctggggaagggatggcccctcagcaaaatggacatcggcgtgcctcttctggctattgggtgttactcccaggtcaaccccatcaccctgacagccgctctcctgcttctggtggcccactatgctattatcggacctggcctccaggccaaggcgaccagagaggcccaaaaacgggctgccgctggcatcatgaagaatccgacggtcgacgggatgacagtgattgatctggaccccatcccttacgatcccaaatttgaaaagcagctgggacaggttatgctccttgtgctgtgcgtcacccaggtgctgatgatgcgcacaacctgggccctctgtgaggccctgacccttgcgacaggccctattagcacgctgtgggaagggaaccccggaagattctggaataccacaatcgctgtttctatggccaacatttttcggggctcctatctcgctggggccggactgctgttcagcatcatgaagaacaccgccaatacacgcagaggcaccggcaacacgggggagacactcggagagaaatggaagaatcggcttaacgctctgggcaaatctgaatttcaaatctacaagaaatccgggattcaggaggtggaccgcaccctggccaaggaaggaatcaaaagaggcgagaccgatcatcacgcggtcagccgggggtctgccaagctcagatggttcgtggagcgcaatctggtgacaccggaaggaaaggttgtcgaccttggctgcggcagagggggatggagctattactgtggcgggctgaaaaacgtgaaggaggtgaaaggactcaccaagggcgggcctggacatgaagaacccattcccatgtccacatatggctggaatctggtcagactgcagtctggcgttgatgtgttctttacgcctcccgaaaaatgcgacaccctcctttgtgatatcggggagagctcccctaacccgacagtggaggctggacgcaccctgcgggtcctgaatctcgtggaaaactggctgaataacaatacacaattctgcattaaggttcttaacccctacatgcctagcgtgatcgagaagatggaagccctgcagagaaaatacggcggggctctcgtccgcaatcccctgtcccggaactctacccacgagatgtattgggtgagcaacgcctccggaaatatcgtttctagcgtgaacatgatttccagaatgctgatcaatcgctttacgatgcggcacaagaaagcgacctacgaacctgacgtcgatctcggctctgggacaagaaacattggaatcgagagcgagacccccaatcttgacattatcggcaagcgcatcgagaaaattaagcaggagcataagacatcctggcactatgatcaggaccatccgtacaaaacctgggcctatcacggcagctacgaaacaaagcaaaccgggtctgcttccagcatggtgaacggagtggtccggctgctgacgaaaccttgggacgttatccccatggtgacacagatggccatgaccgataccacacctttcggccagcagagagtgtttaaggagaaagtcgacacgcgcacccaagaacccaaggaggggacaaagaaactcatgaagattaccgctgagtggctgtggaaagaacttggaaagaaaaagacacctagaatgtgtacccgggaggagttcacacgcaaagtgagatctaatgccgctctgggcgccatctttaccgatgagaacaagtggaagtccgcgcgggaggccgttgaagacagcgggttctgggagctcgtggataaagaaagaaatctgcacctggagggaaagtgcgaaacgtgtgtctataacatgatgggcaaacgggagaagaaactcggcgagtttgggaaggctaagggatctcgcgccatttggtacatgtggctgggcgctagattccttgaatttgaggccctggggttcctcaatgaagaccattggttttcccgggagaacagcctgtccggagtggaaggcgaggggcttcacaaactgggctacatcctccgcgatgttagcaagaaagagggaggcgccatgtatgcggacgataccgctgggtgggacacaagaattaccctggaagatctgaagaatgaggaaatggtgacaaaccatatggagggagaacacaaaaagctcgccgaggccatcttccggctgacctaccagaataaggtcgtgcgcgttcagagacccacgccgcggggcacagtgatggacatcatttctcgcagagaccagcgggggagcggacaagtcgtgacctatggccttaacacattcaccaacatggaggctcagctgatccgccagatggaaggggagggcgtctttaaatccattcaacagctcacggtgaaggaagagatcgccgttaaaaattggctgattagagtgggacgggagcgcctttctagaatggctatcagcggcgatgactgcgtcgtgaagcctctggatgaccggttcgcctccgcgctcaccgccctgaacgatatggggaaagtgagaaaggacatccagcagtgggaaccctctcgcggatggaatgattggacacaagttcccttttgcagccatcacttccacgagctgattatgaaggacggccgggtgctcgtcgtgccttgtagaaaccaggatgaactgatcgggcgcgctcggatttcccagggagccggctggtctcttagagagaccgcttgcctggggaaaagctacgcccagatgtggtccctcatgtattttcatcgccgggacctgagacttgcggccaatgctatctgtagcgccgttccgtctcactgggtgcccacatcccgcaccacatggagcattcatgctacccacgaatggatgacgacagaggatatgctgaccgtctggaaccgggtgtggatccaagagaatccttggatggaagacaagacccccgtcgagtcttgggaagagatcccttacctcggcaaaagagaagatcagtggtgcggatccctgattggcctgacaagccgcgccacctgggctaagaacatccagacagccattaatcaggtgcggtccctcatcgggaacgaggagtatacggactacatgccctctatgaaaagattccggagagaagaggaagaggcgggagttctgtggtga

SEQ ID NO: 20244 - RNA, 9876 nt, synthetic construct
  misc_feature 1..9876: note = derived and/or modified CDS sequence (opt5) from DENV-2__JN851129__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcagcgaggaacaagataagcgctttgtgtgcaaacattctatggtcgacagaggatggggcaatggctgtgggctgttcggaaagggcgggatcgttacctgcgcgatgtttacatgcaagaaaaacatggagggaaaggtggtgcagcctgaaaatctggagtatacgattgtcatcaccccccactccggcgaagagaacgccgtggggaatgatacaggaaaacatggcaaggagattaaagttacccctcagagctctatcacagaagctgagctcaccggctacgggacggtgaccatggaatgttccccccggacaggactggacttcaacgagatggtccttctgcagatggaaaataaggcctggctcgtgcaccgccaatggtttctggatcttccgctgccttggctccccggcgctgacacccaggggagcaactggatccagaaagagacactggttaccttcaagaaccctcacgccaagaaacaggatgtggtcgtgctgggatcccaagagggcgccatgcatacggctctcacaggggcgaccgaaattcagatgtctagcggcaatctgctttttacaggacacctgaagtgcagactccggatggacaaactgcagcttaagggcatgtcctatagcatgtgtaccgggaaattcaaggtcgtgaaggagatcgccgaaacccaacatggaacaattgttatcagagtgcagtacgagggcgacgggtctccctgcaaaattcccttcgagatcatggatctggaaaagcgccacgtcctcggacggctgatcacggtgaaccctattgttaccgagaaagactccccggtgaatatcgaagctgagcccccttttggcgatagctacattatcattggggtcgaacccggccagctgaagctctcttggttcaaaaagggaagctccatcggccagatgtttgagacaaccatgagaggggccaagcgcatggccattctgggagacacagcttgggatttcggctctcttgggggagtgtttaccagcatcggcaaagccctgcatcaagtgttcggggcgatctatggcgctgccttttccggagttagctggacgatgaagattctcatcggcgtcgtgattacatggatcgggatgaactctcggtccaccagcctgtctgtgtccctggtccttgtgggagttgtgaccctctacctgggcgtcatggtgcaggccgacagcgggtgtgttgtgtcctggaaaaataaggagctgaaatgcggatctggcattttcatcacagataacgtccacacctggacagaacagtataagtttcagcctgagagcccctccaagctcgcttctgccatccaaaaagctcacgaagaggggatttgtggcatcagaagcgtgacgcgcctggaaaatcttatgtggaagcagattaccccggagctgaaccatatcctctccgagaatgaagttaaactgacaattatgaccggagacatcaagggcatcatgcaggccgggaaacggagcctgagacctcagcccacagagcttaagtactcttggaaagcgtggggaaaggccaagatgctctccaccgaactgcacaaccatacgttcctgattgatggccctgagaccgctgaatgccccaatacaaaccgcgcctggaatagcctcgaggtggaggactatgggtttggagtcttcaccacaaacctgtggcttaaactgaaggaacggcaagatgtgttttgtgactctaaactcatgtccgctgccatcaaggacaatagagcggtgcacgccgatatgggctactggattgagagcgctctgaacgacacctggaaaatcgaaaaggcctctttcattgaggtcaagagctgccactggcctaaatcccatacactgtggagcaacggcgttcttgagtctgaaatgatcatccccaagtccttcgctgggccggtgagccagcacaattatcgccctggataccatacccagacggccggcccctggcacctcgggcggctggagatggattttgacttctgtgaaggaacaaccgtggtcgtgaccgaggattgcggcaacagagggccctccctgcggacaaccacggcctctggaaaactcattacagaatggtgctgtcgcagctgcaccctgcctccgcttagataccggggcgaggacggctgttggtatgggatggagatcagacccctgaaggaaaaagaggaaaatctcgttaactccctggtgacagctggacatggccagattgataatttttctctgggggtccttggaatggcgctcttcctggaggaaatgctgcgcacccgggtgggcacaaagcacgccatcctcctggttgctgtgagctttgtcacccttattacggggaacatgtccttcagagacctgggacgcgtgatggttatggtgggcgccaccatgacagatgacatcggcatgggggtcacctacctcgccctgctggctgcctttaaggtgagacctacattcgcggctggacttctgctccggaaactgacctctaaggagctcatgatgacgacaattggcatcgtgctgcttagccaatccaccatccccgagacaattctggaactcaccgatgccctggccctggggatgatggtccttaaaatcgttcgcaatatggagaagtatcagctggctgtgaccattatggccatcctctgcgtgcctaacgcggtcattctgcagaatgcttggaaagtgagctgtacaacgctcgccgttgtgtctgtctcccccctgcttctgaccagctctcaacagaaggccgactggatccctctcgctctgacaatcaagggactgaaccccaccgccatttttcttacaaccctgtccagaacgagcaaaaagcggtcttggccgctcaatgaagctatcatggccgtgggcatggtttccattctggcgagctccctcctgaaaaacgatatccctatgacagggccccttgtggccggaggcctgctgaccgtctgctacgtgctcaccggccgcagcgctgacctggagcttgaaagagccgctgacgtccggtgggaggagcaggccgaaatttctgggagctcccctatcctgtctatcacaattagcgaggatggatccatgtctatcaagaatgaagaggaggaacagaccctcacaattctgatccgcacgggcctcctggtgattagcgggcttttccccgtttccatcccgattaccgccgctgcgtggtatctgtgggaggtgaaaaagcaaagagccggagtcctgtgggacgtgccttctccccctcccgttggcaaagctgaactcgaggatggggcctaccggatcaagcagaagggaatcctgggctatagccagattggcgccggggtgtacaaagaaggaacatttcacaccatgtggcatgtcacacgcggcgctgtgcttatgcacaaggggaaaagaatcgagccctcctgggccgacgtgaagaaagatctgattagctacggaggcgggtggaagctcgagggagaatggaaggagggcgaagaggttcaggtcctggcgctcgaacctggcaaaaacccgcgggctgtgcaaaccaagcccgggctgttcaaaacgaataccggaacaatcggcgccgtgtctcttgacttttcccctgggaccagcggatctcccattgtcgataagaaaggcaaggtggttgggctgtatggaaacggcgtggtcacaagatccggcacctacgtgagcgccatcgctcagacagagaagtccatcgaggacaaccctgaaattgaggatgacatcttccgcaaaaagcggctgacgattatggatctccatcccggggccggaaaaaccaagagatatctgcctgcgatcgttcgcgaagctattaaacggggccttagaacactgatcctcgccccgacccgcgtggtcgccgctgagatggaagaggccctgcgggggctccccatcagataccagacccctgctattcgcgccgagcacacaggacgggaaatcgtggacctgatgtgtcatgcgacgttcaccatgagacttctgtctcccattcgggttcctaattataacctgatcattatggatgaggcccactttacagaccccgctagcatcgccgctcgcggctacatttccaccagagtggaaatgggggaggccgccggcatcttcatgacagctaccccgcctggaagccgggacccctttccccagtctaatgcgcctatcatggatgaggaacgcgagattcccgaaagatcctggaacagcggccacgagtgggtcacggacttcaaggggaagacagtgtggtttgtgccttctatcaaagccggaaatgatattgctgcctgcctccggaagaacggcaaaaaggtcatccaactgagcagaaaaaccttcgactccgaatatattaagacccgcacaaatgattgggactttgttgtgaccacagatatctctgagatgggggccaacttcaaggctgagcgggtgatcgacccgagacgctgtatgaaacccgtcattcttaccgatggagaagagcgggtgatcctggccggccctatgcccgttacgcatagctccgcggctcagagacgcgggcgggtgggcagaaatcctaagaacgaaaatgaccagtacatttacatgggagagcccctcgaaaacgatgaggactgcgcccactggaaagaggccaagatgctgctggacaatatcaacacaccggaaggcattatcccttctatgtttgagcccgaacgcgagaaagtcgatgctatcgacggggaatatagactccggggagaggcccgcaagaccttcgtggatcttatgagacggggcgacctgcctgtttggctggcgtaccgcgtggccgctgaggggattaattatgccgatagacggtggtgttttgacggaatcaaaaacaaccaaattctcgaagagaatgtcgaagtggagatctggacaaaggagggcgaaagaaagaaactgaagccccgctggcttgatgctcggatttacagcgaccctctggccctcaaagagttcaaggaattcgctgccgggagaaaatccctgaccctgaacctcatcacggagatgggccgccttcccacctttatgacacagaaggcgcggaatgccctggataacctggctgtcctccataccgccgaagctggaggcagagcctataatcacgccctgagcgagcttccggagacactggaaaccctcctgctgctcacacttctggctaccgtgacggggggaattttcctgtttctcatgtctggcaaggggatcggaaaaatgacactgggcatgtgctgcatcattaccgcgtccatccttctgtggtacgcccagattcagcctcactggatcgctgccagcattatcctcgagttctttctgatcgttctgctcattcccgaacccgagaagcaacggacccctcaggacaaccagcttacatatgtggtgatcgccattctgaccgtcgttgctgccacaatggcgaatgaaatgggcttcctggagaaaacgaagaaagattttgggctcggatccatcaccacacagcaaccggagtctaacattctggacatcgatcttcgccccgccagcgcttggaccctgtacgccgtggctacaaccttcatcacgcctatgctcagacattccattgaaaattctagcgtgaacgtctccctgaccgccatcgcgaatcaggccacagtgctgatgggcctcgggaagggatggccccttagcaagatggacattggcgttcctctgctggctatcgggtgttactctcaggtgaaccccattaccctcacagccgctctgcttctgctcgtcgcccactatgctatcattggacctggcctgcaggccaaagcgacccgggaggcccaaaagcgcgctgccgctggcatcatgaaaaatccgacggtggacgggatcacagtcattgatctggaccccatcccttacgatcccaagtttgaaaaacagctcggacaggtgatgcttctggttctgtgcgtgacccaggtcctcatgatgagaacaacctgggccctgtgtgaggcccttaccctggcgacaggccctatttccacgctctgggaagggaaccccggacggttctggaataccacaatcgctgtgagcatggccaacatttttcgcggctcttatctggctggggccggactgctcttctccatcatgaagaataccgccaacacaagacggggcaccggcaacacgggggagacacttggagagaagtggaaaaatcgcctgaacgctctgggcaagagcgaatttcaaatctacaaaaagtctgggattcaggaggttgacagaaccctcgccaaagaaggaatcaagcggggcgagaccgatcatcacgcggtgagcagagggtccgccaaactgcgctggttcgtcgagcggaatcttgtgacaccggaaggaaaggtggttgacctgggctgcggcagagggggatggtcttattactgtggcgggctcaagaacgtcaaagaggtgaagggactgaccaaaggcgggcctggacatgaagagcccattcccatgagcacatatggctggaatctggtgcgcctccagtccggcgtcgatgttttctttacgcctcccgaaaagtgcgacacccttctgtgtgatatcggggagagctcccctaacccgacagtggaggctggacggaccctgagagtgctcaatctggtcgaaaactggcttaataacaatacacaattctgcattaaagtgctgaacccctacatgccttctgttatcgagaagatggaagccctccagcgcaagtacggcggggctctggtgcggaatcccctgagcagaaactccacccacgagatgtattgggtctctaatgccagcggaaacatcgtgtcctctgttaacatgattagccgcatgctcatcaatcggtttacgatgagacacaaaaaggcgacctacgaacctgacgtggatcttggctccgggacacgcaacattggaatcgagagcgagacccccaatctggacattatcggcaaacggatcgaaaagattaaacaggagcatgaaacatcttggcactatgatcaggaccatccgtacaagacctgggcctatcacggctcctacgagacaaagcaaaccgggagcgcttcttccatggtcaacggagtggtgagactgctcacgaaaccttgggacatcattcccatggtcacacagatggccatgaccgataccacacctttcggccagcagcgcgtttttaaggaaaaagtggacacgagaacccaagagcccaaggaggggacaaaaaagctgatgaagatcaccgctgaatggctttggaaagagctgggaaagaaaaagacacctcggatgtgtacccgcgaagagttcacaagaaaagtgcggagcaatgccgctctcggcgccatttttaccgatgagaacaagtggaaatctgcgagagaagccgtcgaggactccgggttctgggaactggtggataaggagcggaatctgcacctcgaaggaaagtgcgagacgtgtgtttataacatgatgggcaaacgcgagaagaaactgggcgaatttgggaaggctaaaggaagcagagccatctggtacatgtggcttggcgctcggttcctggagtttgaagccctcgggttcctgaatgaggaccattggttttcccgcgaaaacagcctttctggagtggagggcgaggggctgcacaagctcggctacattctgagagatgtcagcaagaaagaaggaggcgccatgtatgcggacgataccgctgggtgggacacacggatcaccctggaggatctcaagaatgaagagatggtgacaaaccatatggaaggagagcacaaaaagctggccgaggccatcttcaaacttacctaccagaataaggttgtgcgcgtccagagacccacgccgcggggcacagtgatggacattatctcccgcagagaccagcgggggtctggacaagttgtgacctatggcctgaacacattcaccaatatggaagctcagctcattcgccagatggagggggaaggcgtctttaagagcatccaacagctgacggtgaccgaggagattgccgtcaaaaactggcttgtgagagttggacgggaacgcctgtccagaatggctatctctggcgatgactgcgtggtcaagcctctcgatgaccggttcgccagcgcgctgacagccctgaacgatatggggaaagtgagaaaggacatccagcagtgggagccctcccgcggatggaatgattggacccaagtgcccttttgctctcatcacttccacgaactcattatgaaagacggccgggttctggtggtcccttgtagaaaccaggatgagcttatcgggcgcgctcggattagccagggagccggctggtccctgagagaaacagcttgcctcgggaagagctacgcccagatgtggtctctgatgtattttcatcgccgggaccttagactggcggccaatgctatctgttccgccgtgccgagccactgggttcccacctctcgcacaacctggtccattcatgctacgcacgagtggatgacaaccgaggatatgctcaccgtgtggaaccgggtctggatccaagaaaatccttggatggaggacaagacactggtggaaagctgggaggaaatcccctacctgggcaaaagagaggatcagtggtgcggatccctcattggcctgacctctcgcgccacatgggctaagaacatccagacggccattaatcaggtccggagccttatcgggaacgaggaatataccgactacatgccttccatgaaaagattccggagagaggaagaggaagcgggagtgctgtggtga

SEQ ID NO: 20245 - RNA, 9876 nt, synthetic construct
  misc_feature 1..9876: note = derived and/or modified CDS sequence (opt5) from DENV-2__JN851128__SS-prME
  source 1..9876: mol_type = other RNA
accgccggaatcattatcatgatgattcccaccgtgatggctttccacctgacgaccagaaatggggagcctcatatgatcgtctcccggcaggaaaagggaaaatccctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaccaccctgccacccttagaaaatactgcattgaagctaagctgacgaatacaaccaccgcctctcggtgtccgacacagggggagccctccctcagcgaggaacaagataaacgctttgtgtgcaagcattctatggtcgacagaggatggggcaacggctgtgggctgttcggaaaaggcgggatcgttacctgcgcgatgtttacatgcaagaagaatatggagggaaaagtggtgcagcctgaaaacctggagtatacgattgtcatcacaccccactccggcgaagagaatgccgtggggaacgatacaggaaagcatggcaaagagattaaggttacccctcagagctctatcacagaagctgagctcaccggctacgggacggtgaccatggaatgtagcccccggacaggactggacttcaatgagatggtccttctgcagatggaaaacaaagcctggctcgtgcaccgccaatggtttctggatcttccgctgccttggctccccggcgctgacacccaggggagcaactggatccagaaggagacactggttaccttcaaaaatcctcacgccaagaagcaggatgtggtcgtgctgggatcccaagagggcgccatgcatacggctctcacaggggcgaccgaaattcagatgtctagcggcaacctgctttttacaggacacctgaaatgcagactccggatggacaagctgcagcttaaaggcatgtcctatagcatgtgtaccgggaagttcaaagtcgtgaaggagatcgccgaaacccaacatggaacaattgttatcagagtgcagtacgagggcgacgggtctccctgcaagattcccttcgagatcatggatctggaaaaacgccacgtcctcggacggctgatcacggtgaatcctattgttaccgagaaggactccccggtgaacatcgaagctgagcccccttttggcgatagctacattatcattggggtcgaacccggccagctgaaactctcttggttcaagaaaggaagctccatcggccagatgtttgagacaaccatgagaggggccaagcgcatggccattctgggagacacagcttgggatttcggctctcttgggggagtgtttaccagcatcggcaaggccctgcatcaagtgttcggggcgatctatggcgctgccttttccggagttagctggacgatgaaaattctcatcggcgtcgtgattacatggatcgggatgaactctcggtccaccagcctgtctgtgtccctggtccttgtgggagttgtgaccctctacctgggcgtcatggtgcaggccgacagcgggtgtgttgtgtcctggaagaacaaagagctgaagtgcggatctggcattttcatcacagataatgtccacacctggacagaacagtataaatttcagcctgagagcccctccaagctcgcttctgccatccaaaaggctcacgaagaggggatttgtggcatcagaagcgtgacgcgcctggaaaaccttatgtggaaacagattaccccggagctgaatcatatcctctccgagaacgaagttaagctgacaattatgaccggagacatcaaaggcatcatgcaggccgggaagcggagcctgagacctcagcccacagagcttaaatactcttggaaggcgtggggaaaagccaagatgctctccaccgaactgcacaatcatacgttcctgattgatggccctgagaccgctgaatgccccaacacaaatcgcgcctggaacagcctcgaggtggaggactatgggtttggagtcttcaccacaaatctgtggcttaagctgaaagaacggcaagatgtgttttgtgactctaagctcatgtccgctgccatcaaagacaacagagcggtgcacgccgatatgggctactggattgagagcgctatcaacgacacctggaagattgaaaaagcctctttcatcgaggtcaagagctgccactggcctaagtcccatacactgtggagcaatggcgttctggagtctgaaatgatcattcccaaaaacttcgctgggccggtgtcccagcacaattatcgccctggataccatacccagacggccggcccctggcaccttgggcggctcgagatggattttgacttctgtgaaggaacaaccgtggtcgtgaccgaggattgcggcaacagagggcccagcctgcggacaaccacggcctccggaaagctgatcacagaatggtgctgtcgctcttgcaccctccctccgctgagataccggggcgaggacggctgttggtatgggatggagattagaccccttaaagaaaaggaggaaaatctggttaacagcctcgtgacagctggacatggccagatcgataatttttccctgggggtcctgggaatggcgcttttcctcgaggaaatgctgcgcacccgggtgggcacaaaacacgccattctgctcgttgctgtgtcttttgtcaccctgatcacggggaacatgagcttcagagaccttggacgcgtgatggttatggtgggcgccaccatgacagatgacattggcatgggggtcacctacctggccctcctggctgcctttaaggtgagacctacattcgcggctggactgcttctgcggaagctcacctccaaagagctgatgatgacgacaatcggcatcgtgctcctgtctcaaagcaccattcccgagacaatccttgaactgaccgatgccctcgccctggggatgatgattctgaagatcgtccgcaatatggagaaatatcagcttgctgttaccattatggccatcctgtgcgtgcctaacgcggtgatcctccagaatgcttggaaggtctcctgtacaacgctggccgtggttagcgtgtctcccctcctgcttacctccagccaacagaaagccgactggattcctctggctctcacaatcaagggactgaaccccaccgccatttttctgacaaccctttctagaacgtccaagaaacggagctggccgctgaatgaagctatcatggccgtcggcatggtgtctattctcgcgtccagcctgctcaagaacgatatccctatgacagggcccctggttgccggaggccttctgaccgtgtgctacgtcctgaccggccgctccgctgacctcgagctggaaagagccgctgacgtgcggtgggaggagcaggccgaaatcagcgggtctagccctattctttccatcacaatttctgaggatggaagcatgtccatcaaaaatgaagaggaggaacagaccctgacaattctcatccgcacgggcctgctcgtcatttctgggctgttccccgtgagcatcccgatcaccgccgctgcgtggtatctttgggaggttaagaaacaaagagccggagtgctgtgggacgtcccttctccccctcccgtgggcaaggctgaactggaggatggggcctaccggattaaacagaagggaatcctcggctatagccagattggcgccggggtttacaaggaaggaacatttcacaccatgtggcatgtgacacgcggcgctgtcctgatgcacaaagggaagagaatcgagcccagctgggccgacgtgaaaaaggatcttatttcctacggaggcgggtggaaactggagggagaatggaaggagggcgaagaggtgcaggttctcgcgctggaacctggcaagaacccgcgggctgtccaaaccaaacccggactcttcaagacgaacaccggaacaatcggcgccgtgagcctggacttttctcctgggacctccggaagccccatcgtggataaaaagggcaaagtcgtggggctttatggaaatggcgttgtgacaagatctggcacctacgtctccgccattgctcagacagaaaagtccatcgaggacaaccctgaaattgaggatgacatcttccgcaagaaacggctgacgattatggatctgcatcccggggccggaaagaccaaaagatatctccctgcgatcgtgcgcgaagctatcaagcggggcctgagaacacttattctggccccgacccgcgttgtggccgctgagatggaagaggccctccgggggctgcccatcagataccagacccctgctattcgcgccgagcacacaggacgggaaatcgtcgacctcatgtgtcatgcgacgttcaccatgagactgctttcccccattcgggtgcctaattataacctgatcattatggatgaggcccactttacagaccccgcttctatcgccgctcgcggctacatcagcaccagagttgaaatgggggaggccgccggcattttcatgacagctaccccgcctggatcccgggacccctttccccagagcaatgcgcctatcatggatgaggaacgcgagattcccgaaagatcttggaactccggccacgagtgggtgacggacttcaaagggaagacagtctggtttgtgcctagcatcaaggccggaaatgatattgctgcctgcctgcggaaaaacggcaagaaagtgatccaactctctagaaagaccttcgacagcgaatatatcaaaacccgcacaaatgattgggactttgtcgttaccacagatatttccgagatgggggccaacttcaaggctgagcgggtgatcgacccgagacgctgtatgaagcccgtgattctgaccgatggagaagaacgggtcatccttgccggccctatgcccgtgacgcattctagcgcggctcagagacgcgggcgggttggcagaaatcctaaaaacgaaaatgaccagtacatttacatgggagagcccctggaaaacgatgaggactgcgcccactggaaggaggccaaaatgctcctggacaatatcaacacaccggaaggcatcattccttccatgtttgagcccgaacgcgagaaggtggatgctatcgacggggaatatagactgcggggagaggcccgcaaaaccttcgtcgatctcatgagacggggcgaccttcctgtgtggctggcgtaccgcgttgccgctgaggggattaactatgccgatagacggtggtgttttgacggagtgaagaataaccaaatcctggaagagaatgtcgaagtggagatttggacaaaagagggcgaaagaaagaagctcaaaccccgctggctggatgctcggatctactctgaccctcttgccctgaaggagttcaaagagttcgctgccgggagaaagagcctcaccctgaacctgattacggagatgggccgcctccccacctttatgacacagaaagcgcggaatgcccttgataacctggctgtcctgcataccgccgaagctggaggcagagcctataatcacgccctctccgagctgccggagacacttgaaaccctgctcctgctgacactccttgctaccgtgacaggcgggatcttcctgtttctgatgagcgggaaggggatcggaaagatgacactcggcatgtgctgcattatcaccgcgtctattctgctttggtacgcccagatccagcctcactggattgctgcctccatcatcctggagttctttctcattgttctgctgatccccgaacccgagaaacaacggacccctcaggacaaccagctcacatatgtggtgattgccatccttaccgtcgttgctgccacaatggcgaatgaaatgggcttcctggagaagacgaaaaaggattttgggctgggaagcattaccacacagcaaccggagtccaacatcctcgacatcgatctgcgccccgcctctgcttggaccctttacgccgtggctacaaccttcattacgcctatgctgagacatagcatcgaaaattcctctgtgaacgtcagcctcaccgccattgcgaatcaggccacagtgctgatgggcctggggaaaggatggcccctctccaagatggacatcggcgttcctcttctggctattgggtgttacagccaggtgaaccccatcaccctgacagccgctctcctgcttctggtcgcccactatgctattatcggacctggcctccaggccaaggcgacccgggaggcccaaaaacgcgctgccgctggcatcatgaagaatccgacggtggacgggattacagtcatcgatctggaccccattccttacgatcccaaatttgaaaagcagctgggacaggtgatgctccttgttctgtgcgtgacccaggtcctgatgatgagaacaacctgggccctctgtgaggccctgacccttgcgacaggccctatctctacgctgtgggaagggaaccccggacggttctggaataccacaattgctgtgtccatggccaacatctttcgcggcagctatctcgctggggccggactgctgttctctatcatgaaaaacaccgccaatacaagacggggcaccggcaacacgggggagacactcggagagaagtggaagaatcgccttaacgctctgggcaaatccgaatttcaaatttacaagaaaagcgggatccaggaggttgacagaaccctggccaaggaaggaattaaacggggcgagaccgatcatcacgcggtgtctagagggagcgccaagctccgctggttcgtcgagcggaatctggtgacaccggaaggaaaagtggttgaccttggctgcggcagagggggatggtcctattactgtggcgggctgaagaacgtcaaggaggtgaaaggactcaccaagggcgggcctggacatgaggaacccatccccatgtctacatatggctggaatctggtgcgcctgcagagcggcgtcgatgttttctttacgcctcccgaaaaatgcgacaccctcctttgtgatattggggagtccagccctaacccgacagtggaggctggacggaccctgagagtgctgaatctcgtcgaaaactggctgaataacaatacacaattctgcatcaaggtgcttaacccctacatgccttccgttatcgagaaaatggaagccctgcagcgcaagtacggcggggctctcgtgcggaatcccctgtctagaaacagcacccacgagatgtattgggtctccaacgcctctggaaatattgtgagctccgttaacatgatctctcgcatgctgattaatcggtttacgatgagacacaagaaagcgacctacgaacctgacgtggatctcggcagcgggacacgcaacatcggaattgagtccgagacccccaatcttgacatcatcggcaagcggattgagaaaatcaagcaggagcatgaaacaagctggcactatgatcaggaccatccgtacaaaacctgggcctatcacggctcttacgagacaaagcaaaccgggtccgctagctctatggtcaacggagtggtgagactgctgacgaagccttgggacattatccccatggtcacacagatggccatgaccgataccacacctttcggccagcagcgcgtttttaaagaaaaggtggacacgagaacccaagagcccaaagaggggacaaagaaactcatgaagattaccgctgaatggctgtggaaggagcttggcaaaaagaaaacacctcggatgtgtacccgcgaagagttcacaagaaaggtgcggtccaatgccgctctgggcgccatctttaccgatgagaacaaatggaaaagcgcgagagaagccgtcgaggactctgggttctgggaactcgtggataaggagcggaatctgcacctggaaggaaagtgcgagacgtgtgtttataacatgatgggcaagcgcgagaaaaagctcggcgaatttgggaaagctaagggatccagagccatttggtacatgtggctgggcgctcggttccttgagtttgaagccctggggttcctcaatgaggaccattggtttagccgcgaaaactccctgagcggagtggagggcgaggggcttcacaaactgggctacatcctcagagatgtctctaagaaggaaggaggcgccatgtatgcggacgataccgctgggtgggacacacggatcaccctggaggatctgaaaaatgaagagatggtgacaaaccatatggaaggagagcacaagaaactcgccgaggccattttcaagctgacctaccagaataaagttgtgcgcgtccagagacccacgccgcggggcacagtgatggacatcattagccgcagagaccagcgggggtccggacaagttgtgacctatggccttaacacattcaccaacatggaagctcagctgatccgccagatggagggggaaggcgtctttaagtctattcaacagctcacggtgaccgaggagatcgccgtcaagaattggctggtgagagttggacgggaacgccttagcagaatggctatctccggcgatgactgcgtggtcaaacctctggatgaccggttcgcctctgcgctcacagccctgaacgatatggggaaggtgagaaaagacattcagcagtgggagcccagccgcggatggaatgattggacccaagtgcccttttgctcccatcacttccacgaactgatcatgaaggacggccgggttctcgtggtcccttgtagaaaccaggatgagctgattgggcgcgctcggatctctcagggagccggctggagccttagagaaacagcttgcctggggaaatcctacgcccagatgtggagcctcatgtattttcatcgccgggacctgagacttgcggccaatgctatttgttctgccgtgccgtcccactgggttcccaccagccgcacaacctggtctatccatgctacgcacgagtggatgacaaccgaggatatgctgaccgtgtggaaccgggtctggatccaagaaaatccttggatggaggacaagacactcgtggaatcctgggaggaaattccctacctgggcaagagagaggatcagtggtgcggaagcctgatcggcctcacctcccgcgccacatgggctaaaaacattcagacggccatcaatcaggtccggtctctgattgggaacgaggaatataccgactacatgcctagcatgaagagattccggagagaggaagaggaagcgggagtgctttggtga

SEQ ID NO: 20246 - RNA, 9876 nt, synthetic construct
  misc_feature 1..9876: note = derived and/or modified CDS sequence (opt5) from DENV-2__JN851130__SS-prME
  source 1..9876: mol_type = other RNA
acagccggcatcattatcatgatgattcccacagtgatggctttccacctgacgaccagaaacggggagcctcatatgatcgtgagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaaacctggggaaaggcgaagatgctctctacggaactgcacaatcataccttcctgatcgatggccctgagacagccgaatgccccaacaccaatcgcgcttggaactccctcgaggttgaggactatgggtttggagtgttcacaaccaatatttggctgaaacttaaggaacggcaagatgtcttttgtgacagcaaactgatgtctgccgctatcaaggacaacagagccgtgcacgcggatatgggctactggattgagtccgccctcaacgacacatggaaaatcgaaaaggctagcttcatcgaggtgaagtcttgctattggcctaaaagccacaccctgtggtccaatggcgtcctggagagcgaaatgattatccccaagaacttcgccgggccggtttctcagcataattaccgccctggataccacacgcagacagctggcccctggcatcttgggcggctcgagatggattttgacttctgtgaaggaaccaccgtggtggtcacagaggattgcggcaacagagggccctccctgcggaccacgacagccagcggaaaactgattaccgaatggtgctgtcgctcctgcacactccctccgctgagatatcggggcgaggacggctgttggtacgggatggagatcagaccccttaaggaaaaagaggaaaatctggtgaactctctcgttaccgccggacacggccagattgataattttagcctgggggtgctgggaatggctcttttcctcgaggaaatgctgcgcacacgggtcggcaccaagcatgcgatcctgctcgtggccgtttcctttgtgacgctgattaccgggaacatgtctttcagagaccttggacgcgtcatggtgatggttggcgctacaatgaccgatgacatcggcatgggggtgacatatctggccctcctggccgcttttaaggtcagacctaccttcgccgcgggactgcttctgcggaaactcacgagcaaggagctgatgatgacaaccatcggcattgtgctcctgtcccaatctacaatccccgagaccattcttgaactgaccgatgctctcgccctggggatgatggccctgaaaatcgtgcgcaatatggagaagtaccagcttgctgtcacaattatggccatcctgtgcgttcctaacgcggtgatcctccagaatgcttggaaagtgagctgtacgaccctggccgtcgtgtccgttagccccctcctgcttacatcttcccaacagaaggccgactggattcctctggctctcaccatcaagggactgaaccccacagccatttttctgaccacgcttagcagaacatctaaaaagcggtcctggccgctgaatgaagctatcatggccgtgggcatggtcagcattctcgcgtcttccctgctcaaaaacgatatccctatgaccgggcccctggtggccggaggccttctgaccgtttgctatgtgctgacaggccgcagcgctgacctcgagctggaaagagccgctgacgtccggtgggaggagcaggccgaaatctccgggagctctcctattcttagcatcaccatttccgaggatggatctatgagcatcaagaatgaagaggaggaacagacactgacgattctcatccgcaccggcctgctcgtgatttccgggctgttccccgtctctatcccgatcacagccgctgcgtggtacctttgggaggtgaaaaagcaaagagccggagttctgtgggacgtgccttctccccctcccgtcggcaaagctgaactggaggatggggcctatcggattaagcagaagggaatcctcggctactcccagattggcgccggggtgtacaaagaaggaacctttcacacaatgtggcacgttacccgcggcgctgtgctgatgcataaggggaaaagaatcgagccctcctgggccgacgtcaagaaagatcttattagctatggaggcgggtggaagctggagggagaatggaaggagggcgaagaggtccaggtgctcgcgctggaacctggcaaaaacccgcgggctgttcaaacgaagcccggactcttcaaaaccaacacaggaaccatcggcgccgtctccctggactttagccctgggacatctggatcccccatcgtggataagaaaggcaaggtggtcgggctttacggaaatggcgtggttaccagaagcggcacatatgtgtctgccattgctcagacggagaagtccatcgaggacaaccctgaaattgaggatgacatcttccgcaaaaagcggctgaccattatggatctgcaccccggggccggaaaaacaaagagatacctccctgcgatcgtccgcgaagctatcaaacggggcctgagaacccttattctggccccgacccgcgtggttgccgctgagatggaagaggccctccgggggctgcccatcagatatcagacccctgctattcgcgccgagcatacgggacgggaaatcgtggacctcatgtgtcacgcgaccttcacaatgagactgcttagccccattcgggtccctaattacaacctgatcattatggatgaggcccattttaccgaccccgcttccatcgccgctcgcggctatatctctacaagagtggaaatgggggaggccgccggcattttcatgaccgctacgccgcctggaagccgggacccctttccccagtccaatgcgcctatcatggatgaggaacgcgagattcccgaaagaagctggaactctggccacgagtgggttacagacttcaaggggaagaccgtgtggtttgtcccttccatcaaagccggaaatgatattgctgcctgcctgcggaagaacggcaaaaaggtgatccaactcagcagaaaaaccttcgactctgaatacatcaagacacgcaccaatgattgggactttgtggtcacaaccgatattagcgagatgggggccaacttcaaggctgagcgggttatcgacccgagacgctgtatgaaacccgtgattctgacggatggagaagaacgggtgatccttgccggccctatgcccgtcacacactcctctgcggctcagagacgcgggcgggtgggcagaaatcctaagaacgaaaatgaccagtacatttatatgggagagcccctggaaaacgatgaggactgcgcccattggaaagaggccaagatgctcctggacaatatcaacaccccggaaggcatcattcctagcatgtttgagcccgaacgcgagaaagttgatgctatcgacggggaatacagactgcggggagaggcccgcaagacattcgtggatctcatgagacggggcgaccttcctgtctggctggcgtatcgcgtggccgctgaggggattaactacgccgatagacggtggtgttttgacggagttaaaaataaccaaatcctggaagagaatgtggaagtcgagatttggaccaaggagggcgaaagaaagaaactcaagccccgctggctggatgctcggatctattccgaccctcttgccctgaaagagttcaaggagttcgctgccgggagaaaatctctcacgctgaacctgattaccgagatgggccgcctccccacatttatgacccagaaggcgcggaatgcccttgataacctggctgtgctgcacacagccgaagctggaggcagagcctacaatcatgccctcagcgagctgccggagacccttgaaacactgctcctgctgaccctccttgctacggtcacagggggaatcttcctgtttctgatgtccggcaaggggatcggaaaaatgaccctcggcatgtgctgcattatcaccgcgagcattctgctttggtatgcccagatccagcctcactggattgctgcctctatcatcctggagttctttctcattgtgctgctgatccccgaacccgagaagcaacggacacctcaggacaaccagctcacctacgttgtgattgccatccttacagtggtcgctgccacgatggcgaatgaaatgggcttcctggagaaaaccaagaaagattttgggctgggatccattacaacccagcaaccggagagcaacatcctcgacatcgatctgcgccccgcctccgcttggacactttacgccgttgctaccacgttcattacccctatgctgagacactctatcgaaaatagctccgtgaacgtgtctctcacagccattgcgaatcaggccaccgtcctgatgggcctggggaagggatggcccctcagcaagatggacatcggcgtgcctcttctggctattgggtgttattcccaggttaaccccatcacactgaccgccgctctcctgcttctggtggcccattacgctattatcggacctggcctccaggccaaagcgacgcgggaggcccaaaagcgcgctgccgctggcatcatgaaaaatccgacagtcgacgggattaccgtgatcgatctggaccccattccttatgatcccaagtttgaaaaacagctgggacaggtcatgctccttgtgctgtgcgttacacaggtgctgatgatgagaaccacctgggccctctgtgaggccctgacacttgcgacgggccctatcagcaccctgtgggaagggaaccccggacggttctggaatacaaccattgctgtctctatggccaacatctttcgcggctcctacctcgctggggccggactgctgttcagcatcatgaagaacacagccaataccagacggggcacgggcaacacaggggagaccctcggagagaagtggaaaaatcgccttaacgctctgggcaagtctgaatttcaaatttataaaaagtccgggatccaggaggtggacagaaccctggccaaagaaggaattaagcggggcgagacagatcaccatgcggttagcagagggtctgccaaactccgctggttcgtggagcggaatctggtcaccccggaaggaaaggtggtggaccttggctgcggcagagggggatggagctactattgtggcgggctgaagaacgttaaagaggtcaagggactcacaaaaggcgggcctggacacgaggaacccatccccatgtccacgtacggctggaatctggtgcgcctgcagtctggcgtggatgtcttctttacccctcccgaaaagtgcgacacactcctttgtgatattggggagagctcccctaacccgaccgttgaggctggacggacactgagagtgctgaatctcgtggaaaactggctgaataacaatacccaattctgcatcaaagtccttaacccctacatgcctagcgtgatcgagaagatggaagccctgcagcgcaagtatggcggggctctcgttcggaatcccctgtccagaaactctacgcatgagatgtactgggtgagcaacgcctccggaaatattgtctctagcgtgaacatgatctcccgcatgctgattaatcggtttaccatgagacacaaaaaggcgacatatgaacctgacgttgatctcggctctgggacccgcaacatcggaattgagagcgagatccccaatcttgacatcattggcaaacggatcgaaaagattaaacaggagcacgaaacatcctggcattacgatcaggaccacccgtataagacctgggcctaccatggcagctatgagacaaagcaaaccgggtctgcttccagcatggtgaacggagtcgtgagactgctgacgaaaccttgggacgtgatccccatggtcacacagatggccatgaccgataccacacctttcggccagcagcgcgtttttaaggaaaaagtggacacgagaacccaagagcccaaggaggggaccaaaaagctcatgaagattaccgctgaatggctgtggaaagagcttggaaagaaaaagacacctcggatgtgtacccgcgaagagttcacaagaaaagtgcggtctaatgccgctctgggcgccatctttaccgatgagaacaagtggaaatccgcgagagaagccgtcgaggacagcgggttctgggaactcgtggataaggagcggaatctgcacctggaaggaaagtgcgagacgtgtgtttacaacatgatgggcaaacgcgagaagaaactcggcgaatttgggaaggctaaaggatctagagccatttggtacatgtggctgggcgctcggttccttgagtttgaagccctggggttcctcaatgaggaccactggttttcccgcgaaaacagcctgtccggagtggagggcgaggggcttcataagctgggctatatcctcagagatgtcagcaagaaagaaggaggcgccatgtacgcggacgataccgctgggtgggacacacggatcaccctggaggatctgaagaatgaagagatggtgacaaaccacatggaaggagagcataaaaagctcgccgaggccattttcaaactgacctatcagaataaggttgtgcgcgtccagagacccacgccgcggggcacagtgatggacatcatttctcgcagagaccagcgggggagcggacaagttgtgacctacggccttaacacattcaccaacatggaagctcagctgatccgccagatggagggggaaggcgtctttaagtccattcaacagctcacggtgaccgaggagatcgccgtcaaaaattggctggtgagagttggacgggaacgcctttctagaatggctatcagcggcgatgactgcgtggtcaagcctctggatgaccggttcgcctccgcgctcacagccctgaacgatatggggaaagtgagaaaggacattcagcagtgggagccctctcgcggatggaatgattggacccaagtgcccttttgcagccaccatttccacgaactgatcatgaaagacggccgggttctcgtggtcccttgtagaaaccaggatgagctgattgggcgcgctcggatctcccagggagccggctggtctcttagagaaacagcttgcctgggaaagagctatgcccagatgtggtccctcatgtactttcaccgccgggacctgagacttgcggccaatgctatttgtagcgccgtgccgtctcattgggttcccacctcccgcacaacctggagcatccacgctacgcatgagtggatgacaaccgaggatatgctgaccgtgtggaaccgggtctggatccaagaaaatccttggatggaggacaagacacccgtggaatcttgggaggaaattccttatctcggcaaaagagaggatcagtggtgcggatccctgatcggcctgaccagccgcgccacatgggctaagaacattcagacggccatcaatcaggtccggtccctcattgggaacgaggaatacaccgactacatgccctctatgaaaagattccggagagaggaagaggaagcgggagtgctgtggtga

SEQ ID NO: 20247 - RNA, 9876 nt, synthetic construct
  misc_feature 1..9876: note = derived and/or modified CDS sequence (opt5) from DENV-2__JN851125__SS-prME
  source 1..9876: mol_type = other RNA
accgccggaatcattatcatgatgattcccaccgtgatggctttccacctgacgacccggaacggggaacctcatatgatcgtgagccggcaggaaaagggaaaaagcctcctgtttaagacggagaatggcgttaacatgtgcacccttatggccatggacctgggggaactctgtgaggatacaattacctacaattgcccgctgcttaaacaaaacgaacccgaggacatcgattgttggtgcaattctacaagcacctgggtgacgtatggaacctgtacagcgaccggcgagcaccgccgggaaaagcggtccgtggctctggtccctcatgtggggatgggactcgagacacgcaccgaaacgtggatgtctagcgagggcgcctggaaacacgcccagcggatcgagacatgggttctgcggcatcccggcttcaccgtgatggctgccattctggcttacacaatcgggaccacctattttcagcgcgtcctcattttcatcctgcttacagccgtggcgccttccatgacgatgagatgcattggaatctctaaccgggactttgttgaaggcgtgagcgggggatcctgggtcgatattgtgctggagcacggcagctgtgtgaccacaatggccaagaataagcccaccctcgacttcgaactgatcaaaacagaggctaagcaccctgccacccttcgcaaatactgcatcgaagctaagctgacgaacacaaccaccgcctctagatgtccgacacagggggagccctccctcaatgaggaacaagataaacggtttgtctgcaagcatagcatggttgaccgcggatggggcaacggctgtgggctgttcggaaagggcgggattgtgacctgcgcgatgtttacatgcaaaaagaatatggagggaaaagtggtccagcctgaaaacctggagtatacgatcgtgattacaccccactctggcgaagagaatgccgttgggaacgatacaggaaagcatggcaaagagatcaaggtgacccctcagtccagcattacagaagctgagctcaccggctacgggacggtcaccatggaatgttctcccagaacaggactggacttcaatgagatggtgcttctgcagatggaaaacaaagcctggctcgttcaccggcaatggtttctggatcttccgctgccttggctccccggcgctgacacccaggggtccaactggatccagaaggagacactggtgaccttcaagaatcctcacgccaaaaagcaggatgtcgtggtcctgggaagccaagagggcgccatgcatacggctctcacaggggcgaccgaaatccagatgtcctctggcaacctgctttttacaggacacctgaaatgccgcctcagaatggacaagctgcagcttaaaggcatgagctattccatgtgtaccgggaagttcaaggtggttaaagagattgccgaaacccaacatggaacaatcgtgattcgggtccagtacgagggcgacgggagcccctgcaagatccccttcgagattatggatctggagaagcggcacgtgctcggacgcctgatcacggttaatcctatcgtgaccgagaaggactctccggtcaacattgaagctgagcccccttttggcgattcctacatcattatcggggtggaacccggccagctgaaactcagctggttcaagaagggatctagcattggccagatgtttgagacaaccatgagaggggccaaaagaatggccatcctgggagacacagcttgggatttcggctcccttgggggagtgtttacctctattggcaaggccctgcatcaagttttcggggcgatctatggcgctgcctttagcggagtctcctggacgatgaaaatcctcattggcgtggtgatcacatggattgggatgaatagccgctctacctccctgagcgtctctctggtgcttgttggagtggtcaccctctacctgggcgtgatggttcaggccgactccgggtgtgtggtcagctggaagaacaaagagctgaagtgcggatccggcatcttcattacagataatgtgcacacctggacagaacagtataagtttcagcctgagtctcccagcaaactcgcttccgccatccaaaaggctcacgaagaggggatctgtggcattcggtctgttacgagactggaaaaccttatgtggaaacagatcaccccggagctgaatcatattctcagcgagaacgaagtgaagatgacaatcatgaccggagacattaaaggcatcatgcaggccgggaagcgctccctgcggcctcagcccacagagctgaaatacagctggaaggcgtggggaaaggccaaaatgctttctaccgaactccacaatcatacgttcctgatcgatggccctgagaccgctgaatgccccaacacaaatagagcctggaactccctggaggtcgaggactatgggtttggagtgttcaccacaaatatttggctcaagctgaaagaacgccaagatgtgagctgtgactctaaacttatgtccgctgccatcaaagacaaccgggcggtccacgccgatatgggctactggattgagagcgctctgaacgacacctggaagatcgaaaaggcctcttttattgaggttaaaagctgccactggcctaagtcccatacactctggagcaatggcgtgctggagtctgaaatgatcatccccaaaaacttcgctgggccggtgtcccagcacaattatagacctggataccatacccagacggccggcccctggcacctggggcgccttgagatggatttcgacttttgtgaaggaacaaccgtcgtggttaccgaggattgcggcaaccgggggcccagcctcagaacaaccacggcctccggaaagctgattacagaatggtgctgtcggtcttgcaccctgcctccgctccgctacagaggcgaggacggctgttggtatgggatggagatccggcccctgaaagaaaaggaggaaaatcttgtgaacagcctggtcacagctggacatggccagattgataatttctccctcggggtgctgggaatggcgctgtttcttgaggaaatgctcagaacccgcgttggcacaaagcacgccatcctgctggtggctgtctctttcgtgaccctcattacggggaacatgagctttcgggacctgggaagagttatggtgatggtcggcgccaccatgacagatgacatcggcatgggggtgacctaccttgccctgctcgctgccttcaaagtgcgccctacatttgcggctggactgctgcttagaaagctgacctccaaagagctcatgatgacgacaattggcatcgtcctgctctctcaaagcaccatccccgagacaattctggaacttaccgatgccctggccctcgggatgatggttctgaaggtggtgcggaatatggagaaatatcagctggctgtcaccatcatggccattctttgcgtgcctaacgcggttatcctgcagaatgcttggaaggtgtcctgtacaacgctcgccgtcgtgagcgttttccccctgctcctgacctcttcccaacagaaggccgactggattcctcttgctctgacaatcaaaggactcaaccccaccgccatctttctgacaaccctgagccgcacgtctaagaaaagatcctggccgcttaatgaagctattatggccgtgggcatggtcagcatcctggcgtcttccctcctgaagaacgatattcctatgacagggcccctcgtggccggaggcctgcttaccgtctgctacgtgctgaccggccggagcgctgacctggagctcgaacgcgccgctgacgttagatgggaggagcaggccgaaatctccgggagctctcctattctgagcatcacaatctccgaggatggatctatgagcattaaaaatgaagaggaggaacagacccttacaatcctgattcggacgggcctcctggtgatctccggactgttccccgtctctattccgatcaccgccgctgcgtggtatctgtgggaggtgaagaaacaacgcgccggagttctttgggacgtgccttctccccctcccgtcggcaaggctgaactggaggatggggcctacagaattaagcagaaaggaatcctgggctattcccagatcggcgccggggtgtacaaggaaggaacatttcacaccatgtggcatgtgacacggggcgctgttctcatgcacaaagggaagcgcattgagccctcctgggccgacgtcaaaaaggatctgatcagctacggaggcgggtggaaacttgagggagaatggaaagagggcgaagaggtccaggtgctggcgctcgaacctggcaagaacccgagagctgtccaaaccaaacccgggctgttcaagacgaacaccggaacaattggcgccgtgtccctcgactttagccctgggacctctggatcccccatcgttgataaaaagggcaaggtggtcgggctgtatggaaatggcgtggttacacggagcggcacctacgtgtctgccattgctcagacagagaaatccatcgaggacaaccctgaaatcgaggatgacattttcagaaagaaacgccttacgatcatggatctgcatcccggggccggaaagaccaaacggtatctgcctgcgattgtcagagaagctatcaagcgcggcctccggacactgattcttgccccgaccagagtggttgccgctgagatggaagaggccctgcgcgggctccccatccggtaccagacccctgctatcagagccgagcacacaggacgcgaaattgtggacctgatgtgtcatgcgacgttcaccatgcggctcctgagccccatcagagtccctaattataaccttattatcatggatgaggcccactttacagaccccgcttccattgccgctcggggctacatctctacccgcgtggaaatgggggaggccgccggcattttcatgacagctaccccgcctggaagcagagacccctttccccagtccaatgcgcctatcatggatgaggaacgggagatccccgaacgcagctggaactctggccacgagtgggtgacggacttcaaggggaaaacagtctggtttgttccttccattaaggccggaaatgatatcgctgcctgcctgcgcaaaaacggcaagaaagtgattcaactgagccggaagaccttcgactctgaatatatcaagaccagaacaaatgattgggactttgtggtcaccacagatattagcgagatgggggccaacttcaaagctgagcgcgtgatcgacccgcggagatgtatgaagcccgttatcctcaccgatggagaagaaagagtgattctggccggccctatgcccgtcacgcattcctctgcggctcagcggagagggcgcgtgggccggaatcctaaaaacgaaagcgaccagtacatctacatgggagagccccttgaaaatgatgaggactgcgcccactggaaggaggccaaaatgctgctcgacaacattaatacaccggaaggcatcattccttccatgtttgagcccgaaagagagaaggttgatgctatcgacggggaatatcgcctgagaggagaggcccggaaaaccttcgtggatctgatgcgcagaggcgacctccctgtctggcttgcgtaccgggtggccgctgaggggatcaactatgccgatcgcagatggtgttttgacggagtcaagaacaatcaaattctggaagagaacgtggaagttgagatctggacaaaggagggcgaacggaaaaagctgaaacccagatggctcgatgctcgcatttactctgaccctctggcccttaaggagttcaaagagttcgctgccgggagaaagagcctgaccctcaatctgatcacggagatgggcagactgcccacctttatgacacagaaggcgcgcaacgccctcgataatcttgctgtgctgcataccgccgaagctggaggccgggcctataaccacgccctgtccgagctcccggagacactggaaacccttctgctcctgacactgctcgctaccgtgacaggcgggattttcctttttctgatgagcgggaaagggatcggaaagatgacactgggcatgtgctgcattatcaccgcgtctatcctcctgtggtacgcccagattcagcctcactggatcgctgcctccattatccttgagttctttctgattgtcctcctgatccccgaacccgagaaacaaagaacccctcaggacaatcagctgacatatgttgtgatcgccattctcaccgtggtcgctgccacaatggcgaacgaaatgggcttccttgagaagacgaaaaaggattttgggctgggaagctccaccacacagcaacatgagtctaatatcctggacattgatctccggccggccagcgcttggaccctgtacgccgtggctacaaccttcatcacgcccatgcttcgccactccattgaaaactctagcgttaatgtgtccctgaccgccatcgcgaaccaggccacagtcctcatgggcctggggaagggatggcctctgagcaaaatggacatcggcgtgcccctccttgctattgggtgttactctcaggtcaatcctatcaccctgacagccgctctgctctccctggtggcccattatgctattatcggacccggccttcaggccaaggcgaccagagaggcccaaaaacgggctgccgctggcattatgaagaaccctacggttgacgggatcacagtgattgatctggacccgatcccctacgatcctaaatttgaaaagcagctcggacaggtcatgctgctggtgctctgcgttacccaggtgcttatgatgcgcacaacctgggccctgtgtgaggccctgaccctcgcgacaggccccatcagcacgctgtgggaagggaatcctggaagattctggaacaccacaattgctgtctctatggccaatatctttcggggctcctatcttgctggggccggactcctcttcagcattatgaagaacaccgccaacacacgcagaggcaccggcaatacgggggagacactgggagagaaatggaagaaccggctgaatgctctcggcaaatctgaatttcaaatctacaagaaaagcgggattcaggaggtggaccgcacccttgccaaggaaggaatcaaaagaggcgagaccgatcaccatgcggtgtcccgggggtctgccaagctgagatggttcgttgagcgcaacctggtcacacccgaaggaaaggtggtggacctcggctgcggcagagggggatggagctattactgtggcgggctgaaaaatgtcaaggaggttaaaggacttaccaagggcgggccgggacacgaagaacctatccccatgtccacatatggctggaacctggtgagactccagagcggcgtggatgtcttctttacgccccctgaaaaatgcgacaccctgctgtgtgatattggggagtcctctcccaatcctacagtggaggctggacgcaccctccgggttcttaacctggtggaaaattggctgaacaataacacacaattctgcatcaaggtcctcaatccgtacatgcccagcgtgattgagaagatggaagccctgcagagaaaatacggcggggctcttgttcgcaaccctctgtccagaaattctacccacgagatgtattgggtgagcaacgcctccggaaacatcgtctctagcgtgaatatgatttccagaatgctcatcaaccgctttacgatgcggcataagaaagcgacctacgaacccgacgtggatctgggcagcgggacaagaaatatcggaattgagtctgagacccctaacctggacatcattggcaagcgcatcgagaagattaagcaggagcacgaaacatcctggcattatgatcaggaccacccctacaagacctgggcctatcacggcagctacgagacaaaacaaaccgggtctgcttccagcatggtcaatggagttgtgcggctccttacgaagccgtgggacgtgatccctatggtcacacagatggccatgaccgataccacacccttcggccagcagagagtgtttaaagaaaaggttgacacgcgcacccaagagcctaaagaggggacaaagaagctgatgaaaatcaccgctgaatggctgtggaaggagctcggcaaaaagaaaacacccagaatgtgtacccgggaagagttcacacgcaaggtgagatctaacgccgctctgggcgccatttttaccgatgagaataaatggaagtccgcgcgggaagccgtcgaggacagcgggttctgggaacttgtggataaggagagaaacctgcatctcgaaggaaaatgcgagacgtgtgtttataatatgatgggcaagcgggagaaaaagctgggcgaatttgggaaagctaagggatcccgcgccatctggtacatgtggctgggcgctagattcctcgagtttgaagccctggggttccttaacgaggaccactggtttagccgggaaaattctctgagcggagtggagggcgaggggctccataagctgggctacattcttcgcgatgtctccaaaaaggaaggaggcgccatgtatgcggacgataccgctgggtgggacacaagaatcaccctggaggatctcaaaaacgaagagatggtgacaaatcacatggaaggagagcataagaaactggccgaggccattttcaagctgacctaccagaacaaggttgtgcgggtccagcgccctacgcccagaggcacagtgatggacatcatttctcggcgcgaccagagagggagcggacaagtcgtgacctatggcctcaatacattcaccaacatggaagctcagctgatccggcagatggagggggaaggcgtttttaaatccatccaacagcttacggccaccgaggagattgctgtgaagaactggctggtccgcgtgggaagagaacggctctctcgcatggccatcagcggcgatgactgcgtggttaaaccgctggatgacagattcgcgtccgcccttacagctctgaatgatatggggaaggtgcggaaagacattcagcagtgggagccttctagaggatggaacgattggacccaagtccccttttgcagccaccacttccatgaactcatcatgaaggacggccgcgtgctggttgtgccctgtcggaatcaggatgagctgattgggagagcccgcatctcccagggagctggctggagcctccgggaaacagcctgcctggggaagtcttacgcgcagatgtggtcccttatgtattttcacagacgcgacctgcggctcgccgctaacgccatctgtagcgctgtcccttctcattgggtgccgacctccagaacaacctggagcattcacgccacgcacgagtggatgacaaccgaggatatgctgaccgtctggaatcgcgtgtggatccaagaaaacccctggatggaggacaaaacacctgttgaatcctgggaggaaattccctaccttggcaagcgggaggatcagtggtgcggatctctgatcggcctcaccagcagagctacatgggccaaaaatattcagacggcgatcaaccaggtgcgctccctgatcgggaatgaggaatataccgactacatgcctagcatgaagcggttcagacgggaggaagaggaagccggagtcctgtggtga

SEQ ID NO: 20248 - RNA, 9876 nt, synthetic construct
  misc_feature 1..9876: note = derived and/or modified CDS sequence (opt5) from DENV-2__JN851123__SS-prME
  source 1..9876: mol_type = other RNA
accgccggaatcattatcatgatgattcccaccgtgatggctttccacctgacgaccagaaacggggaacctcatatgatcgtgagccggcaggaaaagggaaaaagcctcctgtttaagacggagaatggagttaacatgtgcacccttatggccatggacctgggggaactctgtgaggatacaattacctacaattgcccgctgcttaaacaaaacgaacccgaggacatcgattgttggtgcaattctacaagcacctgggtgacgtatggaacctgtacagcgaccggcgagcaccgccgggaaaagcggtccgtggctctggtccctcatgtggggatgggactcgagacacgcaccgaaacgtggatgtctagcgagggcgcctggaaacacgcccagagaatcgagacatgggttctgcggcatcccggcttcaccattatggctgccatcctggcttacacaattgggaccacctattttcagcgcgtgctcatcttcattctgcttacagccgtcgcgccttccatgacgatgagatgcatcggaatttctaaccgggactttgtggaaggcgttagcgggggatcctgggtggatatcgtcctggagcacggcagctgtgtgaccacaatggccaagaataagcccaccctcgacttcgaactgatcaaaacagaggctaagcaccctgccacccttcgcaaatactgcattgaagctaagctgacgaacacaaccaccgcctctagatgtccgacacagggggagccctccctcaatgaggaacaagataaacggtttgtgtgcaagcatagcatggtcgaccgcggatggggcaacggctgtgggctgttcggaaagggcgggatcgttacctgcgcgatgtttacatgcaaaaagaatatggagggaaaaattgtgcagcctgaaaacctggagtatacgatcgtgattacaccccactctggcgaagagaatgccgtcgggaacgatacaggaaagcatggcaaagagatcaaggtgacccctcagtccagcatcacagaagctgagctcaccggctacgggacggttaccatggaatgttctcccagaacaggactggacttcaatgagatggtgcttctgcagatggaaaacaaagcctggctcgtccaccggcaatggtttctggatcttccgctgccttggctccccggcgctgacacccaggggtccaactggattcagaaggagacactggtgaccttcaagaatcctcacgccaaaaagcaggatgttgtggtcctgggaagccaagagggcgccatgcatacggctctcacaggggcgaccgaaatccagatgtcctctggcaacctgctttttacaggacacctgaaatgccgcctcagaatggacaagctgcagcttaaaggcatgagctattccatgtgtaccgggaagttcaaggtggtcaaagagattgccgaaacccaacatggaacaatcgtgattcgggttcagtacgagggcgacgggagcccctgcaagatccccttcgagatcatggatctggagaagcggcacgtgctcggacgcctgattacggtcaatcctatcgtgaccgagaaggactctccggttaacattgaagctgagcccccttttggcgattcctacatcattatcggggtggaacccggccagctgaaactcagctggttcaagaagggatctagcattggccagatgtttgagacaaccatgagaggggccaaaagaatggccatcctgggagacacagcttgggatttcggctcccttgggggagtctttacctctatcggcaaggccctgcatcaagtgttcggggcgatttatggcgctgcctttagcggagtgtcctggacgatgaaaatcctcattggcgttgtcatcacatggattgggatgaatagccgctctacctccctgagcgtgtctctggtgcttgtcggagtggttaccctctacctgggcgtgatggtccaggccgactccgggtgtgtggttagctggaagaacaaagagctgaagtgcggatccggcatcttcatcacagataatgtgcacacctggacagaacagtataagtttcagcctgagtctcccagcaaactcgcttccgccattcaaaaggctcacgaagaggggatctgtggcattcggtctgtcacgagactggaaaaccttatgtggaaacagatcaccccggagctgaatcatattctcagcgagaacgaaatcaagctgacaatcatgaccggagacattaaaggcatcatgcaggccgggaagcgctccctgcggcctcagcccacagagcttaaatacagctggaaggcgtggggaaaggccaaaatgctctctaccgaactgcacaatcatacgttcctgattgatggccctgagaccgctgaatgccccaacacaaatagagcctggaactccctcgaggtggaggactatgggtttggagttttcaccacaaatatctggctgaaacttaaagaacgccaagatgtgttttgtgacagcaagctgatgtctgctgccattaaagacaaccgggcggtccacgccgatatgggctactggatcgagtccgctctcaacgacacctggaagatcgaaaaggccagcttcattgaggtgaaatcttgccactggcctaagagccatacactgtggtccaatggcgtgctggagagcgaaatgatcattcccaaaaacttcgctgggccggtctctcagcacaattatagacctggataccatacccagacggccggcccctggcaccttgggcgcctcgagatggattttgacttctgtgaaggaacaaccgttgtggtgaccgaggattgcggcaaccgggggccctccctgagaacaaccacggccagcggaaagctgatcacagaatggtgctgtcggtcctgcaccctccctccgctgcgctacagaggcgaggacggctgttggtatgggatggagattcggccccttaaagaaaaggaggaaaatctggtcaactctctcgtgacagctggacatggccagatcgataattttagcctgggggttctgggaatggcgcttttcctcgaggaaatgctgagaacccgcgtgggcacaaagcacgccattctgctcgtcgctgtgtcctttgttaccctgatcacggggaacatgtctttccgggaccttggaagagtgatggtcatggtgggcgccaccatgacagatgacatcggcatgggggttacctacctggccctcctggctgcctttaaagtgcgccctacattcgcggctggactgcttctgagaaagctcaccagcaaagagctgatgatgacgacaattggcatcgtcctcctgtcccaatctaccattcccgagacaatccttgaactgaccgatgccctcgccctggggatgatggtgctgaagattgtgcggaatatggagaaatatcagcttgctgtcaccatcatggccatcctgtgcgttcctaacgcggtgattctccagaatgcttggaaggtgagctgtacaacgctggccgtcgtgtccgttagccccctcctgcttacctcttcccaacagaaggccgactggatccctctggctctcacaattaaaggactgaaccccaccgccatctttctgacaacccttagccgcacgtctaagaaaagatcctggccgctgaatgaagctattatggccgtgggcatggtcagcatcctcgcgtcttccctgctcaagaacgatatccctatgacagggcccctggtggccggaggccttctgaccgtttgctacgtgctgaccggccggagcgctgacctcgagctggaacgcgccgctgacgtcagatgggaggagcaggccgaaatttccgggagctctcctatccttagcattacaatctccgaggatggatctatgagcattaaaaatgaagaggaggaacagaccctgacaatcctcattcggacgggcctgctcgtgatctccgggctgttccccgtctctatcccgattaccgccgctgcgtggtatctttgggaggtgaagaaacaacgcgccggagttctgtgggacgtgccttctccccctcccgtcggcaaggctgaactggaggatggggcctacagaatcaagcagaaaggcattctcggctattcccagatcggcgccggggtgtacaaggaaggaacatttcacaccatgtggcatgttacacggggcgctgtgctgatgcacaaagggaagcgcattgagccctcctgggccgacgtcaaaaaggatcttatcagctacggaggcgggtggaagctggagggagaatggaaagagggcgaagaggtccaggtgctcgcgctggaacctggcaagaacccgagagctgttcaaaccaaacccggactcttcaagacgaacaccggaacaatcggcgccgtctccctggactttagccctgggacctctggatcccccattgtggataaaaagggcaaggtggtcgggctttatggaaatggcgtggttacacggagcggcacctacgtgtctgccatcgctcagacagagaaatccattgaggacaaccctgaaatcgaggatgacattttcagaaagaaacgcctgacgatcatggatctgcatcccggggccggaaagaccaaacggtatctccctgcgatcgtcagagaagctattaagcgcggcctgcggacacttatcctggccccgaccagagtggttgccgctgagatggaagaggccctccgcgggctgcccattcggtaccagacccctgctatcagagccgagcacacaggacgcgaaattgtggacctcatgtgtcatgcgacgttcaccatgcggctgcttagccccatcagagtccctaattataacctgattatcatggatgaggcccactttacagaccccgcttccatcgccgctcggggctacatttctacccgcgtggaaatgggggaggccgccggcatcttcatgacagctaccccgcctggaagcagagacccctttccccagtccaatgcgcctattatggatgaggaacgggagatccccgaacgcagctggaactctggccacgagtgggttacggacttcaaggggaaaacagtgtggtttgtcccttccattaaggccggaaatgatatcgctgcctgcctgcgcaaaaacggcaagaaagtgatccaactcagccggaagaccttcgactctgaatatattaagaccagaacaaatgattgggactttgtggtcaccacagatatcagcgagatgggggccaacttcaaagctgagcgcgttattgacccgcggagatgtatgaagcccgtgatcctgaccgatggagaagaaagagtgattcttgccggccctatgcccgtcacgcattcctctgcggctcagcggagagggcgcgtgggccggaatcctaaaaacgaaaatgaccagtacatctacatgggagagcccctggaaaacgatgaggactgcgcccactggaaggaggccaaaatgctcctggacaatatcaacacaccggaaggcattatccctagcatgtttgagcccgaaagagagaaggttgatgctattgacggggaatatcgcctgagaggagaggcccggaaaaccttcgtggatctcatgcgcagaggcgaccttcctgtctggctggcgtaccgggtggccgctgaggggatcaactatgccgatcgcagatggtgttttgacggagttaagaataaccaaattctggaagagaatgtggaagtcgagatctggacaaaggagggcgaacggaaaaagctcaaacccagatggctggatgctcgcatttactccgaccctcttgccctgaaggagttcaaagagttcgctgccgggcggaagtctctcaccctgaacctgatcacggagatgggcagactccccacctttatgacacagaaggcgcgcaatgcccttgataacctggctgtgctgcataccgccgaagctggaggccgggcctataatcacgccctcagcgagctgccggagacacttgaaaccctgctcctgctgacactccttgctaccgtcacaggcgggatcttcctgtttctgatgtccgggaaagggattggaaagatgacactcggcatgtgctgcatcattaccgcgagcatcctgctttggtacgcccagattcagcctcactggatcgctgcctctatcattctggagttctttctcatcgtgctgctgattcccgaacccgagaaacaaagaacccctcaggacaaccagctcacatatgttgtgatcgccattcttaccgtggtcgctgccacaatggcgaatgaaatgggcttcctggagaagacgaaaaaggattttgggctgggatccatcaccacacagcaaccggagagcaacatcctcgacattgatctgcggcccgcctccgcttggaccctttacgccgttgctacaaccttcatcacgcctatgctgcgccattctattgaaaatagctccgtgaacgtgtctctcaccgccatcgcgaatcaggccacagtcctgatgggcctggggaagggatggcccctcagcaaaatggacattggcgtgcctcttctggctatcgggtgttactcccaggttaaccccattaccctgacagccgctctcctgcttctggtggcccactatgctatcatcggacctggcctccaggccaaggcgaccagagaggcccaaaaacgggctgccgctggcattatgaagaatccgacggtcgacgggatcacagtgattgatctggaccccatcccttacgatcccaaatttgaaaagcagctgggacaggtcatgctccttgtgctgtgcgttacccaggtgctgatgatgcgcacaacctgggccctctgtgaggccctgacccttgcgacaggccctattagcacgctgtgggaagggaaccccggaagattctggaataccacaatcgctgtctctatggccaacatctttcggggctcctatctcgctggggccggactgctgttcagcattatgaagaacaccgccaatacacgcagaggcaccggcaacacgggggagacactcggagagaaatggaagaatcggcttaacgctctgggcaaatctgaatttcaaatctacaagaaatccgggattcaggaggtggaccgcaccctggccaaggaaggaatcaaaagaggcgagaccgatcatcacgcggttagccgggggtctgccaagctcagatggttcattgagcgcaatctggtgacaccggaaggaaaggtcgtggaccttggctgcggcagaggcgggtggagctattactgtggagggctgaaaaacgtgaaggaggttaaagggctcaccaagggcgggcctggacatgaagaacccatccccatgtccacatatggctggaatctggtcagactgcagtctggcgtggatgtgttctttacgcctcccgaaaaatgcgacaccctcctttgtgatatcggggagagctcccctaacccgacagtcgaggctggacgcaccctgcgggttctgaatctcgtggaaaactggctgaataacaatacacaattctgcattaaggtgcttaacccctacatgcctagcgtcatcgagaagatggaagccctgcagagaaaatacggcggggctctcgtgcgcaatcccctgtcccggaactctacccacgagatgtattgggttagcaacgcctccggaaatattgtgtctagcgtcaacatgatctccagaatgctgattaatcgctttacgatgcggcacaagaaagcgacctacgaacctgacgtggatctcggctctgggacaagaaacatcggaatcgagagcgagacccccaatcttgacattatcggcaagcgcattgagaaaatcaagcaggagcatgaaacatcctggcactatgatcaggaccatccgtacaagacctgggcctatcacggcagctacgagacaaaacaaaccgggtctgcttccagcatggttaacggagtggtccggctgctgacgaagccttgggacgtgattcccatggtgacacagatggccatgaccgataccacacctttcggccagcagagagtctttaaagaaaaggttgacacgcgcacccaagagcccaaagaggggacaaagaagctcatgaaaatcaccgctgaatggctgtggaaggagcttggcaaaaagaaaacacctagaatgtgtacccgggaagagttcacacgcaaggtgagatctaatgccgctctgggcgccatttttaccgatgagaacaaatggaagtccgcgcgggaagccgtggaggacagcgggttctgggaactcgtcgataaggagagaaatctgcacctggaaggaaaatgcgagacgtgtgtgtataacatgatgggcaagcgggagaaaaagctcggcgaatttgggaaagctaagggatctcgcgccatctggtacatgtggctgggcgctagattccttgagtttgaagccctggggttcctcaatgaggaccattggttttcccgggaaaacagcctgtccggagttgagggcgaggggcttcacaagctgggctacatcctccgcgatgtgagcaaaaaggaaggaggcgccatgtatgcggacgataccgctgggtgggacacaagaattaccctggaggatctgaaaaatgaagagatggtcacaaaccatatggaaggagagcacaagaaactcgccgaggccatcttccggctgacctaccagaataaggtggttcgcgtgcagagacccacgccgcggggcacagtcatggacattatctctcgcagagaccagcgggggagcggacaagtggttacctatggccttaacacattcaccaacatggaagctcagctgattcgccagatggagggggaaggcgtgtttaagtccatccaacatctcacggtcaccgaggagatcgccgtgaaaaattggctggtcagagtgggacgggaacgcctttctagaatggctattagcggcgatgactgcgttgtgaagcctctggatgaccggttcgcctccgcgctcacagccctgaacgatatggggaaagtcagaaaggacatccagcagtgggagccctctcgcggatggaatgattggacccaggtgcccttttgcagccaccacttccatgaactgattatgaaagacggccgggtgctcgttgtgccttgtagaaaccaagatgagctgatcgggcgcgctcggatttcccagggagccggctggtctcttagagaaacagcttgcctgggaaagagctacgcccagatgtggtccctcatgtattttcaccgccgggacctgagacttgcggccaatgctatctgtagcgccgtcccgtctcattgggtgcccacctcccgcacaacctggagcatccacgctacgcacgagtggatgacaaccgaggatatgctgaccgtttggaaccgggtgtggattcaggaaaatccttggatggaggacaagacacccatcgaatcttgggaggaaattccttacctcggcaaaagagaggatcaatggtgcggatccctgatcggcctgaccagccgcgccacatgggctaagaacattcagacggccatcaatcaggtccggtccctcattgggaacgaggaatataccgactacatgccctctatgaaaagattccggagagaggaagaggaagcgggagtgctgtggtga

SEQ ID NO: 20249 - RNA, 9876 nt, synthetic construct
  misc_feature 1..9876: note = derived and/or modified CDS sequence (opt5) from DENV-2__JN851118__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaaagcctcctgtttaagacggagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggttagcatcctcgcgtcttccctgctcaaaaacgatattcctatgacagggcccctggtggccggaggccttctgaccgtctgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtttctattccgatcaccgccgctgcgtggtatctttgggaggtgaaaaagcaaagagccggagtcctgtgggacgtgccttctccccctcccgttggcaaagctgaactggaggatggggcctaccggatcaagcagaagggcattctcggctattcccagatcggcgccggggtgtacaaagaaggaacatttcacaccatgtggcatgtcacacgcggcgctgtgctgatgcacaaggggaaaagaattgagccctcctgggccgacgtgaagaaagatcttatcagctacggaggcgggtggaagctggagggagaatggaaggagggcgaagaggttcaggtcctcgcgctggaacctggcaaaaacccgcgggctgtgcaaaccaagcccggactcttcaaaacgaacaccggaacaattggcgccgtgtccctggactttagccctgggacctctggatcccccatcgtcgataagaaaggcaaggtggttgggctttatggaaatggcgtggtcacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggacctcatgtgtcatgcgacgttcaccatgagactgcttagccccatccgggttcctaattataacctgattatcatggatgaggcccactttacagaccccgcttccattgccgctcgcggctacatctctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggtcacggacttcaaggggaagacagtgtggtttgtgccttccattaaagccggaaatgatatcgctgcctgcctgcggaagaacggcaaaaaggtcattcaactcagcagaaaaaccttcgactctgaatatatcaagacccgcacaaatgattgggactttgttgtgaccacagatatcagcgagatgggggccaacttcaaggctgagcgggtgattgacccgagacgctgtatgaaacccgtcatcctgaccgatggagaagaacgggtgattcttgccggccctatgcccgttacgcattcctctgcggctcagagacgcgggcgggtgggcagaaatcctaagaacgaaaatgaccagtacatctacatgggagagcccctggaaaacgatgaggactgcgcccactggaaagaggccaagatgctcctggacaatattaacacaccggaaggcatcatccctagcatgtttgagcccgaacgcgagaaagtcgatgctattgacggggaatatagactgcggggagaggcccgcaagaccttcgtggatctcatgagacggggcgaccttcctgtttggctggcgtaccgcgtggccgctgaggggatcaactatgccgatagacggtggtgttttgacggagtcaaaaataaccaaattctggaagagaatgtggaagtcgagatctggacaaaggagggcgaaagaaagaaactcaagccccgctggctggatgctcggatttactccgaccctcttgccctgaaagagttcaaggagttcgctgccgggagaaaatctctcaccctgaacctgatcacggagatgggccgcctccccacctttatgacacagaaggcgaagaatgcccttgataacctggctgtgctgcataccgccgaagctggaggccgggcctataatcacgccctcagcgagctgccggagacacttgaaaccctgctcctgctgacactccttgctaccgttacaggcgggattttcctgtttctgatgtccgggaaagggatcggaaagatgacactcggcatgtgctgcatcattaccgcgagcatcctgctttggtacgcccagattcagcctcactggatcgctgcctctattatcctggagttctttctcatcgtgctgctgattcccgaacccgagaaacaaagaacccctcaggacaaccagctcacatatgtggtcatcgccattcttaccgttgtggctgccacaatggcgaatgaaatgggcttcctggagaagacgaaaaaggattttgggctgggatccatcaccacacagcaaccggagagcaacattctcgacatcgatctgcggcccgcctccgcttggaccctttacgccgtggctacaaccttcatcacgcctatgctgcgccattctattgaaaatagctccgtcaacgtgtctctcaccgccatcgcgaatcaggccacagttctgatgggcctggggaagggatggcccctcagcaaaatggacattggcgtgcctcttctggctatcgggtgttactcccaggtcaaccccattaccctgacagccgctctcctgcttctggtggcccactatgctatcattggacctggcctccaggccaaggcgaccagagaggcccaaaaacgggctgccgctggcatcatgaagaatccgacggtcgacgggatgacagtgatcgatctggaccccattccttacgatcccaaatttgaaaagcagctgggacaggttatgctccttgtgctgtgcgtcacccaggtgctgatgatgcgcacaacctgggccctctgtgaggccctgacccttgcgacaggccctatcagcacgctgtgggaagggaaccccggaagattctggaataccacaattgctgtttctatggccaacatctttcggggctcctatctcgctggggccggactgctgttcagcattatgaagaacaccgccaatacacgcagaggcaccggcaacacgggggagacactcggagagaaatggaagaatcggcttaacgctctgggcaaatctgaatttcaaatctacaagaaatccgggatccaggaggtggaccgcaccctggccaaggaaggaattaaaagaggcgagaccgatcatcacgcggtcagccgggggtctgccaagctcagatggttcgtggagcgcaatctggtgacaccggaaggaaaggttgtcgaccttggctgcggcagagggggatggagctattactgtggcgggctgaaaaacgtgaaggaggtgaaaggactcaccaagggcgggcctggacatgaagaacccatccccatgtccacatatggctggaatctggtcagactgcagtctggcgttgatgtgttctttacgcctcccgaaaaatgcgacaccctcctttgtgatattggggagagctcccctaacccgacagtggaggctggacgcaccctgcgggtcctgaatctcgtggaaaactggctgaataacaatacacaattctgcatcaaggttcttaacccctacatgcctagcgtgattgagaagatggaagccctgcagagaaaatacggcggggctctcgtccgcaatcccctgtcccggaactctacccacgagatgtattgggtgagcaacgcctccggaaatatcgtttctagcgtgaacatgatctccagaatgctgattaatcgctttacgatgcggcacaagaaagcgacctacgaacctgacgtcgatctcggctctgggacaagaaacatcggaattgagagcgagacccccaatcttgacatcattggcaagcgcatcgagaaaatcaagcaggagcatgaaacatcctggcactatgatcaggaccatccgtacaagacctgggcctatcacggcagctacgagacaaaacaaaccgggtctgcttccagcatggtgaacggagtggtccggctgctgacgaagccttgggacgttattcccatggtgacacagatggccatgaccgataccacacctttcggccagcagagagtgtttaaagaaaaggtcgacacgcgcacccaagagcccaaagaggggacaaagaagctcatgaaaatcaccgctgaatggctgtggaaggagcttggcaaaaagaaaacacctagaatgtgtacccgggaagagttcacacgcaaggtgagatctaatgccgctctgggcgccatttttaccgatgagaacaaatggaagtccgcgcgggaagccgttgaggacagcgggttctgggaactcgtggataaggagagaaatctgcacctggaaggaaaatgcgagacgtgtgtctataacatgatgggcaagcgggagaaaaagctcggcgaatttgggaaagctaagggatctcgcgccatctggtacatgtggctgggcgctagattccttgagtttgaagccctggggttcctcaatgaggaccattggttttcccgggaaaacagcctgtccggagtggagggcgaggggcttcacaagctgggctacattctccgcgatgttagcaaaaaggaaggaggcgccatgtatgcggacgataccgctgggtgggacacaagaatcaccctggaggatctgaaaaatgaagagatggtgacaaaccatatggaaggagagcacaagaaactcgccgaggccattttcaagctgacctaccagaataaggtcgtgcgggttcagcgccccacgccgagaggcacagtgatggacatcatctctcggcgcgaccagagagggagcggacaagtcgtgacctatggccttaacacattcaccaacatggaagctcagctgattcggcagatggagggggaaggcgtctttaaatccatccaacagctcacggtgaaggaggagattgccgttaaaaattggctgatccgcgtgggaagagaacggctttctcgcatggctattagcggcgatgactgcgtcgtgaagcctctggatgacagattcgcctccgcgctcaccgccctgaacgatatggggaaagtgcggaaggacatccagcagtgggagccctctagaggatggaatgattggacacaagttcccttttgcagccatcacttccacgaactgatcatgaaggacggccgcgtgctcgtcgtgccttgtcggaaccaggatgagctgattgggagagctcgcatctcccagggagccggctggtctcttcgggaaaccgcttgcctggggaaaagctacgcccagatgtggtccctcatgtattttcatagacgcgacctgcggcttgcggccaatgctatttgtagcgccgttccgtctcactggatccccacatccagaaccacatggagcattcatgctacccacgagtggatgacgacagaggatatgctgaccgtgtggaaccgcgtctggatccaagaaaatccttggatggaggacaagacccccgtggaatcttgggaggaaatcccttacctcggcaaacgggaggatcagtggtgcggatccctgattggcctgacaagcagagccacctgggctaagaacatccagacagccattaatcaggtccgctccctcatcgggaacgaggaatatacggactacatgccctctatgaaacggttcagacgggaggaagaggaagcgggagtgctgtggtga

SEQ ID NO: 20250 - RNA, 9876 nt, synthetic construct
  misc_feature 1..9876: note = derived and/or modified CDS sequence (opt5) from DENV-2__JN851124__SS-prME
  source 1..9876: mol_type = other RNA
accgccggaatcattatcatgatgattcccaccgtgatggctttccacctgacgaccagaaacggggaacctcatatgatcgtgtcccggcaggaaaagggaaagtccctcctgtttaagacggaaaatggcgttaacatgtgcacccttatggccatggacctgggggaactctgtgaagatacaattacctacaattgcccgctgcttaaacaaaacgaacccgaagacatcgattgttggtgcaattctacaagcacctgggtgacgtatggaacctgtacagcgaccggcgagcacagacgggaaaagcggtccgtggctctggtccctcatgtggggatgggactcgagacacgcaccgaaacgtggatgtctagcgagggcgcctggaaacacgcccagagaatcgagacatgggttatgcggcatcccggcttcaccgtgatggctgccattctggcttacacaatcgggaccacctattttcagcgcgtcctgattttcatcctcctgacagccgtggcgccttccatgacgatgagatgcattggaatctctaaccgggactttgttgaaggcgtgagcgggggatcctgggtcgatattgtgcttgagcacggcagctgtgtgaccacaatggccaagaataagcccaccctggacttcgaactcatcaaaacagaggctaagcaccctgccaccctgcgcaaatactgcatcgaagctaaacttacgaacacaaccaccgcctctagatgtccgacacagggggagccctccctgaatgaggaacaagataaacggtttgtctgcaagcatagcatggttgaccgcggatggggcaacggctgtgggctgttcggaaagggcgggattgtgacctgcgcgatgtttacatgcaaaaagaatatggagggaaaagtggtccagcctgaaaacctggagtatacgatcgtgattacaccccactctggcgaagagaatgccgttgggaacgatacaggaaagcatggcaaagagatcaaggtgacccctcagtccagcattacagaagctgagctgaccggctacgggacggtcaccatggaatgttctcccagaacaggactcgacttcaatgagatggtgctgcttcagatggaaaacaaagcctggctggttcaccggcaatggtttctcgatctgccgcttccttggctgcccggcgctgacacccaggggtccaactggatccagaaggagacactcgtgaccttcaagaatcctcacgccaaaaagcaggatgtcgtggtcctgggaagccaagagggcgccatgcatacggctctgacaggggcgaccgaaatccagatgtcctctggcaacctcctgtttacaggacaccttaaatgccgcctgagaatggacaagctccagctgaaaggcatgagctattccatgtgtaccgggaagttcaaggtggttaaagagattgccgaaacccaacatggaacaatcgtgattcgggtccagtacgagggcgacgggagcccctgcaagatccccttcgagattatggatcttgagaagcggcacgtgctgggacgcctcatcacggttaatcctatcgtgaccgagaaggactctccggtcaacattgaagctgagcccccttttggcgattcctacatcattatcggggtggaacccggccagctgaaactgagctggttcaagaagggatctagcattggccagatgtttgagacaaccatgagaggggccaaaagaatggccatcctcggagacacagcttgggatttcggctccctcgggggagtgtttacctctattggcaaggcccttcatcaagttttcggggcgatctatggcgctgcctttagcggagtctcctggacgatgaaaatcctgattggcgtggtgatcacatggattgggatgaatagccgctctacctccctcagcgtctctctggtgctggttggagtggtcaccctttacctcggcgtgatggttcaggccgactccgggtgtgtggtcagctggaagaacaaagagctgaagtgcggatccggcatcttcattacagataatgtgcacacctggacagaacagtataagtttcagcctgagtctcccagcaaactggcttccgccatccaaaaggctcacgaagaggggatctgtggcattcggtctgttacgagactcgaaaacctgatgtggaaacagatcaccccggagcttaatcatattctgagcgagaacgaagtgaagatgacaatcatgaccggagacattaaaggcatcatgcaggccgggaagcgctccctccggcctcagcccacagagctgaaatacagctggaaggcgtggggaaaggccaaaatgctgtctaccgaacttcacaatcatacgttcctcatcgatggccctgagaccgctgaatgccccaacacaaatagagcctggaactccctggaggtcgaggactatgggtttggagtgttcaccacaaatatttggctgaagctcaaagaacgccaagatgtgagctgtgactctaagctgatgtccgctgccatcaaagacaaccgggcggtccacgccgatatgggctactggattgagagcgctcttaacgacacctggaagatcgaaaaggcctcttttattgaggttaaaagctgccactggcctaagtcccatacactgtggagcaatggcgtgctcgagtctgaaatgatcatccccaaaaacttcgctgggccggtgtcccagcacaattatagacctggataccatacccagacggccggcccctggcacctggggcgcctggagatggatttcgacttttgtgaaggaacaaccgtcgtggttaccgaggattgcggcaaccgggggcccagccttagaacaaccacggcctccggaaagctcattacagaatggtgctgtcggtcttgcaccctgcctccgctgcgctacagaggcgaggacggctgttggtatgggatggagatccggcccctcaaagaaaaggaggaaaatctggtgaacagccttgtcacagctggacatggccagattgataatttctccctgggggtgctcggaatggcgctgtttctggaggaaatgcttagaacccgcgttggcacaaagcacgccatcctcctggtggctgtctctttcgtgaccctgattacggggaacatgagctttcgggacctcggaagagttatggtgatggtcggcgccaccatgacagatgacatcggcatgggggtgacctacctggcccttctggctgccttcaaagtgcgccctacatttgcggctggactcctgctgagaaaacttacctccaaagagctgatgatgacgacaattggcatcgtcctcctgtctcaaagcaccatccccgagacaattctcgaactgaccgatgcccttgccctggggatgatggttctcaaggtggtgcggaatatggagaaatatcagctggctgtcaccatcatggccattctgtgcgtgcctaacgcggttatccttcagaatgcttggaaggtgtcctgtacaacgctggccgtcgtgagcgtttctcccctcctgctcacctccagccaacagaaggccgactggattcctctggctcttacaatcaaaggactgaaccccaccgccatcttcctcacaaccctgtctcgcacgtccaagaaaagaagctggccgctgaatgaagctattatggccgtgggcatggtctctatccttgcgtccagcctgctcaagaacgatattcctatgacagggcccctggtggccggaggcctcctgaccgtctgctacgtgcttaccggccggtccgctgacctggagctggaacgcgccgctgacgttagatgggaggagcaggccgaaatcagcgggtctagccctattctctccatcacaatctctgaggatggaagcatgtccattaaaaatgaagaggaggaacagaccctgacaatccttattcggacgggcctgctcgtgatctctgggctgtttcccgtcagcattccgatcaccgccgctgcgtggtatctctgggaggtgaagaaacaacgcgccggagttctgtgggacgtgccttctccccctcccgtcggcaaggctgaacttgaggatggggcctacagaattaagcagaaaggaatcctgggctatagccagatcggcgccggggtgtacaaggaaggaacattccacaccatgtggcatgtgacacggggcgctgttctgatgcacaaagggaagcgcattgagcccagctgggccgacgtcaaaaaggatctcatctcctacggaggcgggtggaagctggagggagaatggaaagagggcgaagaggtccaggtgcttgcgctggaacctggcaagaacccgagagctgtccaaaccaaacccgggctctttaagacgaacaccggaacaattggcgccgtgagcctggacttctctcctgggacctccggaagccccatcgttgataaaaagggcaaggtggtcgggctctatggaaatggcgtggttacacggtctggcacctacgtgtccgccattgctcagacagagaaaagcatcgaggacaaccctgaaatcgaggatgacatttttagaaagaaacgcctgacgatcatggatcttcatcccggggccggaaagaccaaacggtatctgcctgcgattgtcagagaagctatcaagcgcggcctgcggacactcattctggccccgaccagagtggttgccgctgagatggaagaggcccttcgcgggctgcccatccggtaccagacccctgctatcagagccgagcacacaggacgcgaaattgtggacctcatgtgtcatgcgacgttcaccatgcggctgctctcccccatcagagtccctaattataacctgattatcatggatgaggcccacttcacagaccccgcttctattgccgctcggggctacatcagcacccgcgtggaaatgggggaggccgccggcatttttatgacagctaccccgcctggatccagagaccccttcccccagagcaatgcgcctatcatggatgaggaacgggagatccccgaacgctcttggaactccggccacgagtgggtgacggactttaaggggaaaacagtctggttcgttcctagcattaaggccggaaatgatatcgctgcctgccttcgcaaaaacggcaagaaagtgattcaactgtctcggaagacctttgacagcgaatatatcaagaccagaacaaatgattgggacttcgtggtcaccacagatatttccgagatgggggccaactttaaagctgagcgcgtgatcgacccgcggagatgtatgaagcccgttatcctgaccgatggagaggaacgcgtgattctcgccggccctatgcccgtcacgcattctagcgcggctcagcggagagggcgcgtgggccggaatcctaaaaacgaatccgaccagtacatctacatgggagagcccctggaaaatgatgaggactgcgcccactggaaggaggccaaaatgcttctggacaacattaatacaccggaaggcatcattccttctatgttcgagcccgaaagagagaaggttgatgctatcgacggggaatatcgcctcagaggagaggcccggaaaacctttgtggatctgatgcgcagaggcgacctgcctgtctggctcgcgtaccgggtggccgctgaggggatcaactatgccgatcgcagatggtgtttcgacggagtcaagaacaatcaaattcttgaagagaacgtggaagttgagatctggacaaaggagggcgaacggaaaaagctgaaacccagatggctggatgctcgcatttacagcgaccctctcgccctgaaggagtttaaagagttcgctgccgggcggaagtcccttaccctgaatctcatcacggagatgggcagactgcccaccttcatgacacagaaggcgcgcaacgccctggataatctcgctgtgcttcataccgccgaagctggaggccgggcctataaccacgccctgagcgagctgccggagacactcgaaaccctgcttctgctcacactgctggctaccgtgacagggggaatttttctcttccttatgtctggcaaagggatcggaaagatgacactgggcatgtgctgcattatcaccgcgtccatcctgctctggtacgcccagattcagcctcactggatcgctgccagcattatcctggagtttttccttattgtcctgctcatccccgaacccgagaaacaaagaacccctcaggacaatcagctgacatatgttgtgatcgccattctgaccgtggtcgctgccacaatggcgaacgaaatgggctttctcgagaagacgaaaaaggatttcgggcttggatcctctaccacacagcaacatgagagcaatatcctggacattgatctgcggccggcctccgcttggaccctctacgccgtggctacaacctttatcacgcccatgctgcgccactctattgaaaacagctccgttaatgtgagccttaccgccatcgcgaaccaggccacagtcctgatgggcctcgggaagggatggcctctgtctaaaatggacatcggcgtgcccctgctcgctattgggtgttactcccaggtcaatcctatcacccttacagccgctctgctgagcctcgtggcccattatgctattatcggacccggcctgcaggccaaggcgaccagagaggcccaaaaacgggctgccgctggcattatgaagaaccctacggttgacgggatcacagtgattgatcttgacccgatcccctacgatcctaaattcgaaaagcagctgggacaggtcatgctcctggtgctgtgcgttacccaggtgctcatgatgcgcacaacctgggccctttgtgaggccctgaccctggcgacaggccccatctctacgctctgggaagggaatcctggaagattttggaacaccacaattgctgtctccatggccaatatcttccggggcagctatctggctggggccggacttctgttttctattatgaagaacaccgccaacacacgcagaggcaccggcaatacgggggagacactcggagagaaatggaagaaccggctgaatgctctgggcaaaagcgagttccaaatctacaagaaatccgggattcaggaggtggaccgcaccctcgccaaggaaggaatcaaaagaggcgagaccgatcaccatgcggtgtctcgggggagcgccaaacttagatggtttgttgagcgcaacctggtcacacccgaaggaaaggtggtggacctgggctgcggcagagggggatggtcctattactgtggcgggctcaaaaatgtcaaggaggttaaaggactgaccaagggcgggccgggacacgaagaacctatccccatgagcacatatggctggaaccttgtgagactgcagtccggcgtggatgtcttcttcacgccccctgaaaaatgcgacaccctcctgtgtgatattggggagtctagccccaatcctacagtggaggctggacgcaccctgcgggttctcaaccttgtggaaaattggctgaacaataacacacaattttgcatcaaggtcctgaatccgtacatgccctccgtgattgagaagatggaagccctccagagaaaatacggcggggctctggttcgcaaccctctttctcggaatagcacccacgagatgtattgggtgtccaacgcctctggaaacatcgtcagctccgtgaatatgattagcagaatgctgatcaaccgcttcacgatgcggcataagaaagtgacctacgaacccgacgtcgatctcggctctgggacaagaaatatcggaattgagtccgagacccctaacctggacatcattggcaagcgcatcgagaagattaagcaggagcacgaaacaagctggcattatgatcaggaccacccctacaagacctgggcgtatcacggctcttacgagacaaaacaaaccgggtccgccagctctatggttaatggagtggtgcggctgctcacgaagccgtgggacgtcatccctatggtgacacagatggctatgaccgataccacaccctttggccagcagagagttttcaaagaaaaggtggacacgcgcacccaagagcctaaagaggggacaaagaaacttatgaaaatcaccgccgaatggctgtggaaggagctgggcaagaagaaaacacccagaatgtgtacccgggaagagtttacacgcaaggtcagatccaacgctgccctcggcgctattttcaccgatgagaataaatggaaaagcgcccgggaagcggtggaggactccgggttttgggaactggttgataaggagagaaaccttcatctggaaggaaagtgcgagacgtgtgtgtataatatgatgggcaagcgggagaaaaagctcggcgagttcgggaaagccaagggaagccgcgctatctggtacatgtggctgggcgccagatttctggagttcgaagctctcgggtttctgaacgaggaccactggttctctcgggaaaatagcctttccggagtcgagggcgaggggctgcataagctcggctacattctgcgcgatgtgtctaaaaaggaaggaggcgccatgtatgccgacgataccgcggggtgggacacaagaatcacccttgaggatctgaaaaacgaagagatggttacaaatcacatggaaggagagcataagaaactcgctgaggccatttttaagctgacctaccagaacaaggtggtccgggtgcagcgccctacgcccagaggcacagtcatggacatcattagccggcgcgaccagagagggtccggacaagtggttacctatggcctgaatacattcaccaacatggaagcccagctcatccggcagatggagggggaaggcgtgttcaaatctatccaacagctgacggctaccgaggagattgccgtcaagaactggcttgtgcgcgtgggaagagaacggctgagccgcatggctatctccggcgatgactgcgttgtgaaaccgctcgatgacagatttgcctctgcgctgacagcccttaatgatatggggaaggtccggaaagacattcagcagtgggagcctagcagaggatggaacgattggacccaagtgcccttctgctcccaccactttcatgaactgatcatgaaggacggccgcgttctcgtggtcccctgtcggaatcaggatgagctgattgggagagctcgcatcagccagggagccggctggtctctgcgggaaacagcttgcctcgggaagtcctacgcccagatgtggagcctgatgtatttccacagacgcgaccttcggctggcggccaacgctatctgttctgccgtgccttcccattgggtcccgaccagcagaacaacctggtccattcacgctacgcacgagtggatgacaaccgaggatatgctcaccgtgtggaatcgcgtttggatccaagaaaacccctggatggaggacaaaacacctgtggaatcttgggaggaaattccctacctgggcaagcgggaggatcagtggtgcggaagccttatcggcctgacctccagagccacatgggctaaaaatattcagacggccatcaaccaggtccgcagcctcatcgggaatgaggaatataccgactacatgccttctatgaagcggtttagacgggaggaagaggaagcgggagtgctgtggtga

SEQ ID NO: 20251 - RNA, 9876 nt, synthetic construct
  misc_feature 1..9876: note = derived and/or modified CDS sequence (opt5) from DENV-2__JN851114__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggttagcatcctcgcgtcttccctgctcaaaaacgatattcctatgacagggcccctggtggccggaggccttctgaccgtctgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtttctattccgatcaccgccgctgcgtggtatctttgggaggtgaaaaagcaaagagccggagtcctgtgggacgtgccttctccccctcccgttgaaaaagctgagctggaagatggcgcctaccggatcaagcagaaggggattctcggatattcccagatcggcgccggcgtgtacaaagaggggacatttcacaccatgtggcatgtcacacgcggagctgtgctgatgcacaagggcaaaagaattgagccctcctgggccgacgtgaagaaagatcttatcagctacgggggaggctggaagctggaaggggagtggaaggaaggagaggaagttcaggtcctcgcgctggagcctggcaaaaacccgcgggctgtgcaaaccaagcccggcctcttcaaaacgaacaccgggacaattggagccgtgtccctggactttagccctggcacctctgggtcccccatcgtcgataagaaaggaaaggtggttggcctttatgggaatggagtggtcacaagaagcggcacctacgtgtctgccatcgctcagacagagaagtccattgaagacaaccctgagatcgaagatgacattttccgcaaaaagcggctgacgatcatggatctgcatcccggcgccgggaaaaccaagagatatctccctgcgattgttcgcgaggctatcaaacggggactgagaacacttatcctggccccgacccgcgtggtcgccgctgaaatggaggaggccctccggggcctgcccattagataccagacccctgctatccgcgccgaacacacagggcgggagattgtggacctcatgtgtcatgcgacgttcaccatgagactgcttagccccatccgggttcctaattataacctgattatcatggatgaagcccactttacagaccccgcttccattgccgctcgcggatacatctctaccagagtggagatgggcgaggccgccgggatcttcatgacagctaccccgcctggcagccgggacccctttccccagtccaatgcgcctattatggatgaagaacgcgaaatccccgagagaagctggaactctggacacgaatgggtcacggacttcaagggcaagacagtgtggtttgtgccttccattaaagccgggaatgatatcgctgcctgcctgcggaagaacggcaaaaaggtcattcaactcagcagaaaaaccttcgactctgagtatatcaagacccgcacaaatgattgggactttgttgtgaccacagatatcagcgagatgggcgccaacttcaaggctgaacgggtgattgacccgagacgctgtatgaaacccgtcatcctgaccgatggggaggaacgggtgattcttgccggacctatgcccgttacgcattcctctgcggctcagagacgcggccgggtggggagaaatcctaagaacgagaatgaccagtacatctacatgggcgaacccctggagaacgatgaggactgcgcccactggaaagaagccaagatgctcctggacaatattaacacaccggagggaatcatccctagcatgtttgaacccgagcgcgaaaaagtcgatgctattgacggcgagtatagactgcgcggggaagcccggaagaccttcgtggatctcatgagacggggagaccttcctgtttggctggcgtaccgcgtggccgctgaaggcatcaactatgccgatagacggtggtgttttgacggggtcaaaaataaccaaattctggaggaaaatgtggaggtcgagatctggacaaaggaaggagagagaaagaaactcaagccccgctggctggatgctcggatttactccgaccctcttgccctgaaagagttcaaggagttcgctgccggcagaaaatctctcaccctgaacctgatcacggaaatggggcgcctccccacctttatgacacagaaggcgaagaatgcccttgataacctggctgtgctgcataccgccgaggctggcggacgggcctataatcacgccctcagcgagctgccggaaacacttgagaccctgctcctgctgacactccttgctaccgttacgggcgggattttcctgtttctgatgtccggaaaaggcatcgggaagatgacactcggaatgtgctgcatcattaccgcgagcatcctgctttggtacgcccagattcagcctcactggatcgctgcctctattatcctggagttctttctcatcgtgctgctgattcccgagcccgaaaaacaaagaacccctcaggacaaccagctcacatatgtggtcatcgccattcttaccgttgtggctgccacaatggcgaatgagatgggcttcctggagaagacgaaaaaggattttggcctggggtccatcaccacacagcaaccggaaagcaacattctcgacatcgatctgcggcccgcctccgcttggaccctttacgccgtggctacaaccttcatcacgcctatgctgcgccattctattgagaatagctccgtcaacgtgtctctcaccgccatcgcgaatcaggccacagttctgatgggactgggcaaggggtggcccctcagcaaaatggacattggagtgcctcttctggctatcggctgttactcccaggtcaaccccattaccctgacagccgctctcctgcttctggtggcccactatgctatcattgggcctggactccaggccaaggcgaccagagaagcccaaaaacgggctgccgctggcatcatgaagaatccgacggtcgacggcatgacagtgatcgatctggaccccattccttacgatcccaaatttgagaagcagctggggcaggttatgctccttgtgctgtgcgtcacccaggtgctgatgatgcgcacaacctgggccctctgtgaagccctgacccttgcgacaggacctatcagcacgctgtgggagggcaaccccgggagattctggaataccacaattgctgtttctatggccaacatctttcggggatcctatctcgctggcgccgggctgctgttcagcattatgaagaacaccgccaatacacgcagaggaaccggcaacacgggcgagacactcggggaaaaatggaagaatcggcttaacgctctgggaaaatctgagtttcaaatctacaagaaatccggcatccaggaagtggaccgcaccctggccaaggaggggattaaaagaggagagaccgatcatcacgcggtcagccggggctctgccaagctcagatggttcgtggaacgcaatctggtgacaccggaggggaaggttgtcgaccttggatgcggccggggcgggtggagctattactgtggaggcctgaaaaacgtgaaggaagtgaaagggctcaccaagggaggccctgggcatgaggaacccatccccatgtccacatatggatggaatctggtcagactgcagtctggcgttgatgtgttctttacgcctcccgagaaatgcgacaccctcctttgtgatattggcgagagctcccctaacccgacagtggaagctgggcgcaccctgcgggtcctgaatctcgtggagaactggctgaataacaatacacaattctgcatcaaggttcttaacccctacatgcctagcgtgattgaaaagatggaggccctgcagagaaaatacggaggcgctctcgtccgcaatcccctgtcccggaactctacccacgaaatgtattgggtgagcaacgcctccgggaatatcgtttctagcgtgaacatgatctccagaatgctgattaatcgctttacgatgcggcacaagaaagcgacctacgagcctgacgtcgatctcggatctggcacaagaaacatcgggattgagagcgaaacccccaatcttgacatcattggaaagcgcatcgagaaaatcaagcaggaacatgagacatcctggcactatgatcaggaccatccgtacaagacctgggcctatcacggcagctacgaaacaaaacaaaccggctctgcttccagcatggtgaacggggtggtccggctgctgacgaagccttgggacgttattcccatggtgacacagatggccatgaccgataccacacctttcggacagcagagagtgtttaaagagaaggtcgacacgcgcacccaagagcccaaagaaggcacaaagaagctcatgaaaatcaccgctgagtggctgtggaaggaacttgggaaaaagaaaacacctagaatgtgtacccgggaggagttcacacgcaaggtgagatctaatgccgctctgggagccatttttaccgatgaaaacaaatggaagtccgcgcgggaggccgttgaagacagcggcttctgggagctcgtggataaggaaagaaatctgcacctggaggggaaatgcgagacgtgtgtctataacatgatgggaaagcgggagaaaaagctcggcgagtttggcaaagctaaggggtctcgcgccatctggtacatgtggctgggagctagattccttgaatttgaggccctgggcttcctcaatgaagaccattggttttcccgggagaacagcctgtccggggtggagggagaaggccttcacaagctggggtacattctccgcgatgttagcaaaaaggagggcggagccatgtatgcggacgataccgctggctgggacacaagaatcaccctggaagatctgaaaaatgaggaaatggtgacaaaccatatggagggggagcacaagaaactcgccgaagccattttcaagctgacctaccagaataaggtcgtgcgggttcagcgccccacgccgagaggaacagtgatggacatcatctctcggcgcgaccagagaggcagcgggcaagtcgtgacctatggacttaacacattcaccaacatggaggctcagctgattcggcagatggaaggcgagggggtctttaaatccatccaacagctcacggtgaaggaggaaattgccgttaaaaattggctgatccgcgtgggcagagagcggctttctcgcatggctattagcggagatgactgcgtcgtgaagcctctggatgacagattcgcctccgcgctcaccgccctgaacgatatgggcaaagtgcggaaggacatccagcagtgggaaccctctagagggtggaatgattggacacaagttcccttttgcagccatcacttccacgagctgatcatgaaggacggacgcgtgctcgtcgtgccttgtcggaaccaggatgaactgattggcagagctcgcatctcccagggggccggatggtctcttcgggagaccgcttgcctgggcaaaagctacgcccagatgtggtccctcatgtattttcatagacgcgacctgcggcttgcggccaatgctatttgtagcgccgttccgtctcactgggtgcccacatccagaaccacatggagcatccatgctacccacgagtggatgacgacagaagatatgctgaccgtctggaaccgcgtgtggattcaagagaatccttggatggaagacaagacccccgtcgagtcttgggaagagatcccttacctcgggaaacgggaggatcagtggtgcggctccctgatcggactgacaagcagagccacctgggctaagaacattcagacagccatcaatcaggtgcgctccctcattggcaacgaagagtatacggactacatgccctctatgaaacggttcagacgggaagaggaagaggcgggggttctgtggtga

SEQ ID NO: 20252 - RNA, 9876 nt, synthetic construct
  misc_feature 1..9876: note = derived and/or modified CDS sequence (opt5) from DENV-2__JN851126__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaaagcctcctgtttaagacggagaatggcgttaacatgtgcacccttatggccatggacctgggggaactctgtgaggatacaattacctacaattgcccgctgcttaaacaaaacgaacccgaggacatcgattgttggtgcaattctacaagcacctgggtgacgtatggaacctgtacagcgaccggcgagcaccgcagagaaaagcggtccgtggctctggtccctcatgtggggatgggactcgagacacgcaccgaaacgtggatgtctagcgagggcgcctggaaacacgcccagagaatcgagacatgggttctgcggcatcccggcttcaccattatggctgccatcctggcttacacaattgggaccacctattttcagcgcgtgctcatcttcattctgcttacagccgtcgcgccttccatgacgatgagatgcatcggaatttctaaccgggactttgtggaaggcgttagcgggggatcctgggtggatatcgtcctggagcacggcagctgtgtgaccacaatggccaagaataagcccaccctcgacttcgaactgatcaaaacagaggctaagcaccctgccacccttcgcaaatactgcattgaagctaagctgacgaacacaaccaccgcctctagatgtccgacacagggggagccctccctcaatgaggaacaagataaacggtttgtgtgcaagcatagcatggtcgaccgcggatggggcaacggctgtgggctgttcggaaagggcgggatcgttacctgcgcgatgtttacatgcaaaaagaatatggagggaaaaattgtgcagcctgaaaacctggagtatacgatcgtgattacaccccactctggcgaagagaatgccgtcgggaacgatacaggaaagcatggcaaagagatcaaggtgacccctcagtccagcatcacagaagctgagctcaccggctacgggacggttaccatggaatgttctcccagaacaggactggacttcaatgagatggtgcttctgcagatggaaaacaaagcctggctcgtccaccggcaatggtttctggatcttccgctgccttggctccccggcgctgacacccaggggtccaactggattcagaaggagacactggtgaccttcaagaatcctcacgccaaaaagcaggatgttgtggtcctgggaagccaagagggcgccatgcatacggctctcacaggggcgaccgaaatccagatgtcctctggcaacctgctttttacaggacacctgaaatgccgcctcagaatggacaagctgcagcttaaaggcatgagctattccatgtgtaccgggaagttcaaggtggtcaaagagattgccgaaacccaacatggaacaatcgtgattcgggttcagtacgagggcgacgggagcccctgcaagatccccttcgagatcatggatctggagaagcggcacgtgctcggacgcctgattacggtcaatcctatcgtgaccgagaaggactctccggttaacattgaagctgagcccccttttggcgattcctacatcattatcggggtggaacccggccagctgaaactcagctggttcaagaagggatctagcattggccagatgtttgagacaaccatgagaggggccaaaagaatggccatcctgggagacacagcttgggatttcggctcccttgggggagtctttacctctatcggcaaggccctgcatcaagtgttcggggcgatttatggcgctgcctttagcggagtgtcctggacgatgaaaatcctcattggcgttgtcatcacatggattgggatgaatagccgctctacctccctgagcgtgtctctggtgcttgtcggagtggttaccctctacctgggcgtgatggtccaggccgactccgggtgtgtggttagctggaagaacaaagagctgaagtgcggatccggcatcttcatcacagataatgtgcacacctggacagaacagtataagtttcagcctgagtctcccagcaaactcgcttccgccattcaaaaggctcacgaagaggggatctgtggcattcggtctgtcacgagactggaaaaccttatgtggaaacagatcaccccggagctgaatcatattctcagcgagaacgaaatcaagctgacaatcatgaccggagacattaaaggcatcatgcaggccgggaagcgctccctgcggcctcagcccacagagcttaaatacagctggaaggcgtggggaaaggccaaaatgctctctaccgaactgcacaatcatacgttcctgattgatggccctgagaccgctgaatgccccaacacaaatagagcctggaactccctcgaggtggaggactatgggtttggagttttcaccacaaatatctggctgaaacttaaagaacgccaagatgtgttttgtgacagcaagctgatgtctgctgccattaaagacaaccgggcggtccacgccgatatgggctactggatcgagtccgctctcaacgacacctggaagatcgaaaaggccagcttcattgaggtgaaatcttgccactggcctaagagccatacactgtggtccaatggcgtgctggagagcgaaatgatcattcccaaaaacttcgctgggccggtctctcagcacaattatagacctggataccatacccagacggccggcccctggcaccttgggcgcctcgagatggattttgacttctgtgaaggaacaaccgttgtggtgaccgaggattgcggcaaccgggggccctccctgagaacaaccacggccagcggaaagctgatcacagaatggtgctgtcggtcctgcaccctccctccgctgcgctacagaggcgaggacggctgttggtatgggatggagattcggccccttaaagaaaaggaggaaaatctggtcaactctctcgtgacagctggacatggccagatcgataattttagcctgggggttctgggaatggcgcttttcctcgaggaaatgctgagaacccgcgtgggcacaaagcacaccattctgctcgtcgccgtgtcctttgttacgctgatcaccgggaacatgtctttccgggaccttggaagagtggtcgtgatggttggcgctacaatgaccgatgacatcggcatgggggtgacatacctggccctcctggccgcttttaaagtccgccctaccttcgccgcgggactgcttctgagaaagctcacgagcaaagagctgatgatgacaaccattggcatcgtgctcctgtcccaatctacaattcccgagaccatccttgaactgaccgatgctctcgccctggggatgatggtgctgaagattgtccggaatatggagaaatatcagcttgccgttacaatcatggctatcctgtgcgtgcctaacgccgtgattctccagaatgcgtggaaggtcagctgtacggctctggccgtggtttccgtgagccccctcctgcttacctcttcccaacagaaggccgactggatccctctggctctcacaattaaaggactgaaccccaccgccatctttctgacaacccttagccgcacgtctaagaaaagatcctggccgctgaatgaagctattatggccgtcggcatggtgagcatcctcgcgtcttccctgctcaagaacgatatccctatgacagggcccctggttgccggaggccttctgaccgtgtgctacgtcctgaccggccggagcgctgacctcgagctggaacgcgccgctgacgtgagatgggaggagcaggccgaaatttccgggagctctcctatccttagcattacaatctccgaggatggatctatgagcattaaaaatgaagaggaggaacagaccctgacaatcctcattcggacgggcctgctcgtcatctccgggctgttccccgtgtctatcccgattaccgccgctgcgtggtatctttgggaggttaagaaacaacgcgccggagtgctgtgggacgtcccttctccccctcccgtgggcaaggctgaactggaggatggggcctacagaatcaagcagaaaggcattctcggctattcccagatcggcgccggggtttacaaggaaggaacatttcacaccatgtggcatgtgacacggggcgctgtcctgatgcacaaagggaagcgcattgagccctcctgggccgacgtgaaaaaggatcttatcagctacggaggcgggtggaagctggagggagaatggaaagagggcgaagaggtgcaggttctcgcgctggaacctggcaagaacccgagagctgtccaaaccaaacccggactcttcaagacgaacaccggaacaatcggcgccgtgtccctggactttagccctgggacctctggatcccccattgtggataaaaagggcaaggtcgtggggctttatggaaatggcgttgtgacacggagcggcacctacgtctctgccatcgctcagacagagaaatccattgaggacaaccctgaaatcgaggatgacattttcagaaagaaacgcctgacgatcatggatctgcatcccggggccggaaagaccaaacggtatctccctgcgatcgtgagagaagctattaagcgcggcctgcggacacttatcctggccccgaccagagttgtggccgctgagatggaagaggccctccgcgggctgcccattcggtaccagacccctgctatcagagccgagcacacaggacgcgaaattgtcgacctcatgtgtcatgcgacgttcaccatgcggctgcttagccccatcagagtgcctaattataacctgattatcatggatgaggcccactttacagaccccgcttccatcgccgctcggggctacatttctacccgcgttgaaatgggggaggccgccggcatcttcatgacagctaccccgcctggaagcagagacccctttccccagtccaatgcgcctattatggatgaggaaaaggagatccccgaacggagctggaactctggccacgagtgggtgacggacttcaaagggaagacagtctggtttgtgccttccattaaagccggaaatgatatcgctgcctgcctgcgcaagaacggcaaaaaggtgatccaactcagcagaaagaccttcgactctgaatatattaaaacccggacaaatgattgggactttgtcgttaccacagatatcagcgagatgggggccaacttcaaggctgagagagtgattgacccgcgccggtgtgtgaaacccgtcatcctgaccgatggagaagagagagtgattcttgccggccctatgcccgttacgcattcctctgcggctcagcgccgggggagagtgggccgcaatcctaagaacgaaaatgaccagtacatctacatgggagagcccctggaaaacgatgaggactgcgcccactggaaagaggccaagatgctcctggacaatatcaacacaccggaaggcattatccctagcatgtttgagcccgaacgggagaaagtcgatgctattgacggggaatatagactgcgcggagaggccagaaagaccttcgtggatctcatgcggcgcggcgaccttcctgtttggctggcgtacagagtggccgctgaggggatcaactatgccgatcggcgctggtgttttgacggagtcaagaataaccaaattctggaagagaatgtggaagtcgagatctggacaaaagagggcgaaagaaagaaactcaagccccggtggctggatgctagaatttactccgaccctcttgccctgaaagagttcaaggagttcgctgccgggcgcaagtctctcaccctgaacctgatcacggagatgggccggctccccacctttatgacacagaaagcgagaaatgcccttgataacctggctgtgctgcataccgccgaagctggaggccgcgcctataatcacgccctcagcgagctgccggagacacttgaaaccctgctcctgctgacactccttgctaccgttacaggcgggatcttcctgtttctgatgtccgggaaggggattggaaaaatgacactcggcatgtgctgcatcattaccgcgagcatcctgctttggtacgcccagattcagcctcactggatcgctgcctctatcattctggagttctttctcatcgtgctgctgattcccgaacccgagaagcaacggacccctcaggacaaccagctcacatatgtggtcatcgccattcttaccgttgtggctgccacaatggcgaatgaaatgggcttcctggagaaaacgaagaaggattttgggctgggatccatcaccacacagcaaccggagagcaacatcctcgacattgatctgagacccgcctccgcttggaccctttacgccgtggctacaaccttcatcacgcctatgctgcggcattctattgaaaatagctccgtcaacgtgtctctcaccgccatcgcgaatcaggccacagttctgatgggcctggggaaaggatggcccctcagcaagatggacattggcgtgcctcttctggctatcgggtgttactcccaggtcaaccccattaccctgacagccgctctcctgcttctggtggcccactatgctatcatcggacctggcctccaggccaaagcgacccgcgaggcccaaaagagagctgccgctggcattatgaaaaatccgacggtcgacgggatcacagtgattgatctggaccccatcccttacgatcccaagtttgaaaagcagctgggacaggttatgctccttgtgctgtgcgtcacccaggtgctgatgatgcggacaacctgggccctctgtgaggccctgacccttgcgacaggccctattagcacgctgtgggaagggaaccccggacgcttctggaataccacaatcgctgtttctatggccaacatctttagaggctcctatctcgctggggccggactgctgttcagcattatgaaaaacaccgccaatacacggcgcggcaccggcaacacgggggagacactcggagagaagtggaaaaatagacttaacgctctgggcaagtctgaatttcaaacctacaaaaagtccgggatccaggaggtggaccggaccctggccaaagaaggaattaagcgcggcgagacagatcatcacgcggtcagcagagggtctgccaagctccggtggttcgtggagagaaatctggtgaccccggaaggaaaagttgtcgaccttggctgcggccgcgggggatggagctattactgtggcgggctgaagaacgtgaaagaggtgaagggactcacaaaaggcgggcctggacatgaagaacccatccccatgtccacgtatggctggaatctggtccggctgcagtctggcgttgatgtgttctttacccctcccgaaaagtgcgacacactcctttgtgatattggggagagctcccctaacccgaccgtggaggctggaagaacactgcgcgtcctgaatctcgtggaaaactggctgaataacaatacccaattctgcatcaaggttcttaacccctacatgcctagcgtgatcgagaaaatggaaacgctgcagcggaagcacggcggggccctcgtcagaaatcccctgtcccgcaactctacccacgagatgtactgggtgagcaacgcttccggaaatattgtttctagcgtgaacatgatctcccggatgctgattaatagatttacaatgcgccataaaaaggccacctatgaacctgacgtcgatctcggctctgggacacggaacatcggaattgagagcgagacccccaatcttgacatcatcggcaaaagaattgaaaagatcaagcaggagcacgaaacatcctggcattacgatcaggaccacccgtataaaacctgggcgtaccacggcagctatgagacgaagcaaacagggtctgcctccagcatggtgaacggagtggtccgcctgctgaccaaaccttgggacgttattcccatggtgacccagatggctatgacagatacgacccctttcggccagcagcgggtgtttaaggaaaaagtcgacacaagaacccaagagcccaaggaggggacaaagaaactcatgaagatcaccgccgaatggctgtggaaagagcttggaaagaaaaagacacctcgcatgtgtaccagagaagagttcacgcggaaagtgcgctctaatgctgccctgggcgctatttttaccgatgagaacaagtggaagtccgccagagaagcggttgaggacagccggttctgggaactcgtggataaagagagaaatctgcatctggaagggaagtgcgagacatgtgtctacaacatgatgggaaaacgggagaagaaactcggcgaatttggcaaggccaaggggtctcgcgctatctggtatatgtggctgggagccagattccttgagtttgaagctctgggcttcctcaatgaggaccactggttttcccgggaaaacagcctgtccggggtggagggagagggccttcataaactggggtacattctccgcgatgttagcaagaaagaaggcggagccatgtacgccgacgataccgcgggctgggacacaagaatcaccctggaggatctgaagaatgaagagatggtgacgaaccacatggaaggggagcataaaaagctcgctgaggccatcttccggctgacatatcagaataaggtcgtgcgcgttcagagacccaccccgcggggaacagtgatggacattatctctcgcagagaccagcggggcagcgggcaagtcgtgacctacggacttaacacgttcaccaacatggaagcccagctgattcgccagatggagggcgaaggggtctttaaatccatccaacacctcacagtgaccgaggagattgctgttaagaattggctggtgagagtcggccgggaacgcctttctagaatggccatcagcggagatgactgcgtggtgaaacctctggatgaccggttcgcttccgccctcacagcgctgaacgatatgggcaaggttagaaaagacatccagcagtgggagccctctcgcgggtggaatgattggacccaggtgcccttttgcagccaccatttccacgaactgattatgaaggacggacgggtcctcgtggttccttgtagaaaccaagatgagctgatcggccgcgcccggatttcccagggggctggatggtctcttagagaaacagcctgcctgggcaagagctatgctcagatgtggtccctcatgtactttcatcgccgggacctgagacttgccgcgaatgccatctgtagcgctgtgccgtctcactgggtccccacctcccgcacgacatggagcattcacgccacccatgagtggatgaccacagaggatatgctgaccgtgtggaaccgggtctggatccaggaaaatccttggatggaggacaaaacacccgtggaatcttgggaggaaatcccttatctcgggaagagagaggatcaatggtgcggctccctgattggactgacgagccgcgctacctgggccaaaaacatccagacagctattaatcaggttcggtccctcatcggcaacgaggaatacaccgactatatgccctctatgaagagattccggagagaggaagaggaagccggggtgctgtggtga

SEQ ID NO: 20253 - RNA, 9876 nt, synthetic construct
  misc_feature 1..9876: note = derived and/or modified CDS sequence (opt5) from DENV-2__JN851121__SS-prME
  source 1..9876: mol_type = other RNA
accgccggaatcattatcatgatgattcccaccgtgatggctttccacctgacgaccagaaacggggagcctcatatgatcgtgagccggcaggaaaagggaaaaagcctcctgtttaagacggagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgccatggtccaggctgactccgggtgtgtggttagctggaaaaacaaggagctgaaatgcggatccggcattttcatcacagataatgtgcacacctggacagaacagtataagtttcagcctgagtctcccagcaagctcgcctccgctatccaaaaagcccacgaagaggggatttgtggcatcagatctgtcacgcgcctggaaaaccttatgtggaagcagattaccccggagctgaatcatatcctcacagagaacgaagtgaaactgaccattatgacaggagacatcaagggcatcatgcaggcggggaaacggagcctgagacctcagcccaccgagcttaagtactcctggaaagcctggggaaaggctaagatgctcagcacggaactgcacaatcataccttcctgattgatggccctgagacagccgaatgccccaacaccaatcgcgcttggaactctctcgaggttgaggactatgggtttggagtgttcacaaccaatatctggctgaaacttaaggaacggcaagatgtcttttgtgactccaaactgatgagcgccgcgattaaggacaacagagccgtgcacgctgatatgggctactggatcgagtctgccctcaacgacacatggaaaattgaaaaggcttccttcatcgaggtcaagagctgccactggcctaaatctcataccctgtggagcaatggcgtcctggagtccgaaatgatcattcccaagaacttcgccgggccggttagccagcacaattatcgccctggataccatacgcagacagccggcccctggcaccttgggcggctcgagatggattttgacttctgtgaaggaaccaccgtggtggtcacagaggattgcggcaacagagggccctctctgcggaccacgacagcttccggaaaactgatcaccgaatggtgctgtcgcagctgcacactccctccgctgagataccggggcgaggacggctgttggtatgggatggagattagaccccttaaggaaaaagaggaaaatctggtgaactccctcgttaccgcgggacatggccagatcgataatttttctctgggggtgctgggaatggcccttttcctcgaggaaatgctgcgcacacgggtcggcaccaagcacgctattctgctcgtggccgttagctttgtgacgctgatcaccgggaacatgtccttcagagaccttggacgcgtcatggtgatggttggcgccacaatgaccgatgacattggcatgggggtgacatacctggctctcctggccgcgtttaaggtcagacctaccttcgctgccggactgcttctgcggaaactcacgtctaaggagctgatgatgacaaccatcggcatcgtgctcctgagccaatccacaattcccgagtctatccttgaactgaccgatgccctcgctctggggatgatggtgctgaaaattgtccgcaatatggagaagtatcagcttgccgttaccatcatggcgattctgtgcgtgcctaacgctgtgatcctccagaatgcctggaaagtcagctgtacaacgctggccgtggtttccgtgagccccctcctgcttacctcttcccaacagaaggctgactggatccctctggccctcacaattaagggactgaaccccaccgctatctttctgacaacccttagcagaacgtctaaaaagcggtcctggccgctgaatgaagccattatggcggtcggcatggtgagcatcctcgcctcttccctgctcaaaaacgatattcctatgacagggcccctggttgctggaggccttctgaccgtgtgctacgtcctgaccggccgcagcgccgacctcgagctggaaagagctgccgacgtgcggtgggaggagcaggccgaaatctccgggagctctcctatccttagcattacaatctccgaggatggatctatgagcattaagaatgaagaggaggaacagaccctgacaatcctcattcgcacgggcctgctcgtcatctccgggctgttccccgtgtctattccgatcaccgctgcggcctggtatctttgggaggttaaaaagcaaagagctggagtgctgtgggacgtcccttctccccctcccgtgggcaaagccgaactggaggatggggcctaccggatcaagcagaagggcattctcggctattcccagatcggcgctggggtttacaaagaaggaacatttcacaccatgtggcatgtgacacgcggcgccgtcctgatgcacaaggggaaaagaattgagccctcctgggcggacgtgaagaaagatcttatcagctacggaggcgggtggaagctggagggagaatggaaggagggcgaagaggtgcaggttctcgctctggaacctggcaaaaacccgcgggccgtccaaaccaagcccggactcttcaaaacgaacaccggaacaattggcgccgtgtccctggactttagccctgggacctctggatcccccatcgtggataagaaaggcaaggtcgtggggctttatggaaatggcgttgtgacaagaagcggcacctacgtctctgctatcgcccagacagagaagtccattgaggacaaccctgaaatcgaggatgacattttccgcaaaaagcggctgacgatcatggatctgcatcccggggcgggaaaaaccaagagatatctccctgctattgtgcgcgaagccatcaaacggggcctgagaacacttatcctggccccgacccgcgttgtggctgccgagatggaagaggctctccgggggctgcccattagataccagacccctgccatccgcgcggagcacacaggacgggaaattgtcgacctcatgtgtcatgccacgttcaccatgagactgcttagccccatccgggtgcctaattataacctgattatcatggatgaggctcactttacagaccccgcctccattgctgcccgcggctacatctctaccagagttgaaatgggggaggccgctggcatcttcatgacagcgaccccgcctggaagccgggacccctttccccagtccaatgcccctattatggatgaggaacgcgagatccccgaaagaagctggaactctggccacgagtgggtgacggacttcaaggggaagacagtctggtttgtgccttccattaaagctggaaatgatatcgccgcctgcctgcggaagaacggcaaaaaggtgattcaactcagcagaaaaaccttcgactctgaatatatcaagacccgcacaaatgattgggactttgtcgttaccacagatatcagcgagatgggggctaacttcaaggccgagcgggtgattgacccgagacgctgtatgaaacccgtgatcctgaccgatggagaagaacgggtcattcttgcgggccctatgcccgtgacgcattcctctgctgcccagagacgcgggcgggttggcagaaatcctaagaacgaaaatgaccagtacatctacatgggagagcccctggaaaacgatgaggactgcgcccactggaaagaggctaagatgctcctggacaatattaacacaccggaaggcatcatccctagcatgtttgagcccgaacgcgagaaagtggatgccattgacggggaatatagactgcggggagaggcgcgcaagaccttcgtcgatctcatgagacggggcgaccttcctgtgtggctggcctaccgcgttgctgccgaggggatcaactatgctgatagacggtggtgttttgacggagtgaaaaataaccaaattctggaagagaatgtcgaagtggagatctggacaaaggagggcgaaagaaagaaactcaagccccgctggctggatgcccggatttactccgaccctcttgctctgaaagagttcaaggagttcgccgcggggagaaaatctctcaccctgaacctgatcacggagatgggccgcctccccacctttatgacacagaaggccaagaatgctcttgataacctggccgtcctgcataccgctgaagccggaggccgggcctataatcacgctctcagcgagctgccggagacacttgaaaccctgctcctgctgacactccttgcgaccgtgacaggcgggattttcctgtttctgatgtccgggaaagggatcggaaagatgacactcggcatgtgctgcatcattaccgccagcatcctgctttggtacgctcagattcagcctcactggatcgccgcctctattatcctggagttctttctcatcgttctgctgattcccgaacccgagaaacaaagaacccctcaggacaaccagctcacatatgtggtgatcgctattcttaccgtcgttgccgcgacaatggccaatgaaatgggcttcctggagaagacgaaaaaggattttgggctgggatccatcaccaaccagcaaccggagagcaatattctcgacatcgatctgcggcccgcttccgcctggacactttacgctgtggccaccacattcatcacccctatgctgcgccattctattgaaaacagctccgtgaatgtctctctcacggcgatcgccaaccaggctaccgtgctgatgggcctggggaagggatggcccctcagcaaaatggacattggcgttcctcttctggccatcgggtgttactcccaggtgaatcccattacactgaccgctgccctcctgcttctggtcgctcactatgccatcattggacctggcctccaggcgaaggccacaagagaggctcaaaaacgggccgctgccggcatcatgaagaacccgaccgtggacgggatgacggtcatcgatctggaccccattccttacgatcccaaatttgaaaagcagctgggacaggtgatgctccttgttctgtgcgtgacacaggtcctgatgatgcgcaccacatgggccctctgtgaggcgctgacccttgctaccggccctatcagcacactgtgggaagggaatcccggaagattctggaacacgaccattgccgtgtctatggctaacatctttcggggctcctatctcgccggggccggactgctgttcagcattatgaagaatacagctaacacccgcagaggcacaggcaataccggggagacgctcggagagaaatggaagaaccggcttaatgccctgggcaaatctgaatttcaaatctacaagaaatccgggatccaggaggttgaccgcacactggcgaaggaaggaattaaaagaggcgagaccgatcatcacgccgtgagccgggggtctgctaagctcagatggttcgtcgagcgcaacctggtgaccccggaaggaaaggtggttgaccttggctgcggcagagggggatggagctattactgtggcgggctgaaaaatgtcaaggaggtgaaaggactcacaaagggcgggcctggacatgaagaacccatccccatgtccacctatggctggaacctggtgagactgcagtctggcgtcgatgttttctttacacctcccgaaaaatgcgacacgctcctttgtgatattggggagagctcccctaatccgaccgtggaggccggacgcacactgcgggtgctgaacctcgtcgaaaattggctgaacaataacacccaattctgcatcaaggtgcttaatccctacatgcctagcgttattgagaagatggaagctctgcagagaaaatacggcggggccctcgtgcgcaaccccctgtcccggaactctacacacgagatgtattgggtcagcaatgcgtccggaaacatcgtgtctagcgttaatatgatctccagaatgctgattaaccgctttaccatgcggcacaagaaagccacgtacgaacctgacgtggatctcggctctgggaccagaaatatcggaattgagagcgagacacccaaccttgacatcattggcaagcgcatcgagaaaatcaagcaggagcatgaaacctcctggcactatgatcaggaccatccgtacaagacatgggcttatcacggcagctacgagaccaaacaaacagggtctgcctccagcatggtcaatggagtggtgcggctgctgaccaagccttgggacgtcattcccatggttacgcagatggctatgacagataccacccctttcggccagcagagagtgtttaaagaaaaggtggacacacgcacgcaagagcccaaagaggggaccaagaagctcatgaaaatcacagccgaatggctgtggaaggagcttggcaaaaagaaaacccctagaatgtgtacacgggaagagttcacccgcaaggtcagatctaacgctgccctgggcgcgatttttacagatgagaataaatggaagtccgcccgggaagctgtggaggacagcgggttctgggaactcgttgataaggagagaaacctgcacctggaaggaaaatgcgagacctgtgtgtataatatgatgggcaagcgggagaaaaagctcggcgaatttgggaaagccaagggatctcgcgctatctggtacatgtggctgggcgccagattccttgagtttgaagccctggggttcctcaacgaggaccattggttttcccgggaaaatagcctgtccggagtcgagggcgaggggcttcacaagctgggctacattctccgcgatgtgagcaaaaaggaaggaggcgcgatgtatgctgacgatacggccgggtgggacaccagaatcacactggaggatctgaaaaacgaagagatggttaccaatcatatggaaggagagcacaagaaactcgccgaggctattttcaagctgacataccagaacaaggtggtccgggtgcagcgccccaccccgagaggcacggttatggacatcatctctcggcgcgaccagagagggagcggacaagtggtcacatatggccttaacaccttcacaaatatggaagcccagctgattcggcagatggagggggaaggcgtgtttaaatccatccaacagctcaccgtcaaggaggagattgctgtgaaaaactggctgatccgcgttggaagagaacggctttctcgcatggccattagcggcgatgactgcgtggtcaagcctctggatgacagattcgcgtccgccctcacggctctgaatgatatggggaaagtgcggaaggacatccagcagtgggagccctctagaggatggaacgattggacccaagtgcccttttgcagccatcacttccacgaactgatcatgaaggacggccgcgttctcgtggtcccttgtcggaatcaggatgagctgattgggagagcccgcatctcccagggagctggctggtctcttcgggaaacagcctgcctggggaaaagctacgcgcagatgtggtccctcatgtattttcatagacgcgacctgcggcttgccgctaacgccatttgtagcgctgtgccgtctcactgggttcccacctccagaacaacctggagcatccatgccacacacgagtggatgaccacggaggatatgctgacagtgtggaatcgcgtctggattcaagaaaacccttggatggaggacaagacccccgtggaatcttgggaggaaatcccttacctcggcaaacgggaggatcagtggtgcggatccctgatcggcctgaccagcagagctacatgggccaagaatattcagaccgcgatcaaccaggtccgctccctcattgggaatgaggaatatacagactacatgccctctatgaaacggttcagacgggaggaagaggaagccggagtgctgtggtga

SEQ ID NO: 20254 - RNA, 9876 nt, synthetic construct
  misc_feature 1..9876: note = derived and/or modified CDS sequence (opt5) from DENV-2__JN851115__SS-prME
  source 1..9876: mol_type = other RNA
accgccggaatcattatcatgatgattcccaccgtgatggctttccacctgacgaccagaaatggggaacctcatatgatcgtcagccggcaggaaaagggaaaatccctgctgtttaagacggaaaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggctgcttgatctgccgctcccttggctgcccggcgctgacacccaggggtccaactggatccagaaagagacactggttacctttaagaatcctcacgccaagaaacaggatgtggtcgtgctcggaagccaagagggcgccatgcatacggctctgacaggggcgaccgaaattcagatgtcctctggcaaccttctgttcacaggacacctcaagtgcagactgcggatggacaaacttcagctgaagggcatgagctattccatgtgtaccgggaaatttaaggtcgtgaaggagatcgccgaaacccaacatggaacaattgttatcagagtgcagtacgagggcgacgggagcccctgcaaaattcccttcgagatcatggatctcgaaaagcgccacgtcctgggacggctgatcacggtgaatcctattgttaccgagaaagactctccggtgaacatcgaagctgagccccctttcggcgattcctacattatcattggggtcgaacccggccagctcaagctgagctggtttaaaaagggatctagcatcggccagatgttcgagacaaccatgagaggggccaagcgcatggccattcttggagacacagcttgggattttggctccctcgggggagtgttcacctctatcggcaaagccctccatcaagtgtttggggcgatctatggcgctgccttcagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcatttttatcacagataatgtccacacctggacagaacagtataagttccagcctgagtctcccagcaagctggcttccgccatccaaaaagctcacgaagaggggatttgtggcatcagatctgtgacgcgccttgaaaacctgatgtggaagcagattaccccggagctcaatcatatcctgacagagaacgaagttaaactgaccattatgacaggagacatcaagggcatcatgcaggccgggaaacggagccttagacctcagcccaccgagctcaagtactcctggaaagcgtggggaaaggccaagatgctgagcacggaactgcacaatcatacctttctcattgatggccctgagacagctgaatgccccaacaccaatcgcgcctggaactctctggaggtggaggactatgggttcggagtctttacaaccaatatctggcttaaactgaaggaacggcaagatgtgttctgtgactccaaactcatgagcgctgccattaaggacaacagagcggtgcacgccgatatgggctactggatcgagtctgctctgaacgacacatggaaaattgaaaaggcctcctttatcgaggtcaagagctgccactggcctaaatctcataccctgtggagcaatggcgttcttgagtccgaaatgatcattcccaagaacttcgctgggccggtgagccagcacaattatcgccctggataccatacgcagacagccggcccctggcacctcgggcggctggagatggatttcgacttttgtgaaggaaccaccgtggtcgtgacagaggattgcggcaacagagggccctctctgcggaccacgacagcctccggaaaactcatcaccgaatggtgctgtcgcagctgcacactgcctccgcttagataccggggcgaggacggctgttggtatgggatggagattagacccctgaaggaaaaagaggaaaatctcgttaactccctggtgaccgctggacatggccagatcgataatttctctctgggggtccttggaatggcgctctttctggaggaaatgctgcgcacacgggtgggcaccaagcacgccattctcctggttgctgtgagcttcgtcacgcttatcaccgggaacatgtcctttagagacctgggacgcgtgatggttatggtgggcgccacaatgaccgatgacattggcatgggggtcacatacctcgccctgctggctgccttcaaggtgagacctacctttgcggctggacttctgctccggaaactgacgtctaaggagctcatgatgacaaccatcggcatcgtgctgcttagccaatccacaattcccgagtctatcctggaactcaccgatgccctggccctggggatgatggtccttaaaattgttcgcaatatggagaagtatcagctggctgtgaccatcatggccattctctgcgtgcctaacgcggtcatcctgcagagcgcttggaaagtgtcctgtacaacgctcgccgttgtgagcgtctctcccctgcttctgacctccagccaacagaaggccgactggatccctctcgctctgacaattaagggactgaatcccaccgccatcttccttacaaccctgtctagaacgtccaaaaagcggagctggccgctcaacgaagctattatggccgtgggcatggtttctatcctggcgtccagcctcctgaaaaatgatattcctatgacagggccccttgtggccggaggcctgctgaccgtctgctacgtgctcaccggccgctccgctgacctggagcttgaaagagccgctgacgtccggtgggaggagcaggccgaaatcagcgggtctagccctatcctgtccattacaatctctgaggatggaagcatgtccattaagaacgaagaggaggaacagaccctcacaatcctgattcgcacgggcctcctggtgatctctgggctttttcccgttagcattccgatcaccgccgctgcgtggtatctgtgggaggtgaaaaagcaaagagccggagtcctgtgggacgtgccttctccccctcccgttggcaaagctgaactcgaggatggggcctaccggatcaagcagaagggcattctgggctatagccagatcggcgccggggtgtacaaagaaggaacattccacaccatgtggcatgtcacacgcggcgctgtgcttatgcacaaggggaaaagaattgagcccagctgggccgacgtgaagaaagatctgatctcctacggaggcgggtggaagctcgagggagaatggaaggagggcgaagaggttcaggtcctggcgctcgaacctggcaaaaatccgcgggctgtgcaaaccaagcccgggctgtttaaaacgaacaccggaacaattggcgccgtgagccttgacttctctcctgggacctccggaagccccatcgtcgataagaaaggcaaggtggttgggctgtatggaaacggcgtggtcacaagatctggcacctacgtgtccgccatcgctcagacagaaaagagcattgaggacaatcctgaaatcgaggatgacatttttcgcaaaaagcggctgacgatcatggatctccatcccggggccggaaaaaccaagagatatctgcctgcgattgttcgcgaagctatcaaacggggccttagaacactgatcctcgccccgacccgcgtggtcgccgctgagatggaagaggccctgcgggggctccccattagataccagacccctgctatccgcgccgagcacacaggacgggaaattgtggacctgatgtgtcatgcgacgttcaccatgagacttctgtcccccatccgggttcctaactataatctgattatcatggatgaggcccacttcacagaccccgcttctattgccgctcgcggctacatcagcaccagagtggaaatgggggaggccgccggcatctttatgacagctaccccgcctggatcccgggaccccttcccccagagcaacgcgcctattatggatgaggaacgcgagatccccgaaagatcttggaactccggccacgagtgggtcacggactttaaggggaagacagtgtggttcgtgcctagcattaaagccggaaacgatatcgctgcctgcctccggaagaatggcaaaaaggtcattcaactgtctagaaaaacctttgacagcgaatatatcaagacccgcacaaacgattgggacttcgttgtgaccacagatatctccgagatgggggccaattttaaggctgagcgggtgattgacccgagacgctgtatgaaacccgtcatccttaccgatggagaggaacgggtgattctggccggccctatgcccgttacgcattctagcgcggctcagagacgcgggcgggtgggcagaaaccctaagaatgaaaacgaccagtacatctacatgggagagcccctcgaaaatgatgaggactgcgcccactggaaagaggccaagatgctgctggacaacattaatacaccggaaggcatcatcccttccatgttcgagcccgaacgcgagaaagtcgatgctattgacggggaatatagactccggggagaggcccgcaagacctttgtggatcttatgagacggggcgacctgcctgtttggctggcgtaccgcgtggccgctgaggggatcaactatgccgatagacggtggtgtttcgacggagtcaaaaacaatcaaattctcgaagagaacgtggaagtcgagatctggacaaaggagggcgaaagaaagaaactgaagccccgctggcttgatgctcggatttactctgaccctctggccctcaaagagtttaaggagttcgctgccgggagaaaaagcctgaccctgaatctcatcacggagatgggccgccttcccaccttcatgacacagaaggcgaagaacgccctggataatctggctgtgctccataccgccgaagctggaggccgggcctataaccacgccctgtccgagcttccggagacactggaaaccctcctgctgctcacacttctggctaccgttacagggggaatttttctgttcctcatgagcggcaaagggatcggaaagatgacactgggcatgtgctgcatcattaccgcgtctatccttctgtggtacgcccagattcagcctcactggatcgctgcctccattatcctcgagtttttcctgatcgtgctgctcattcccgaacccgagaaacaaagaacccctcaggacaatcagcttacatatgtggtcatcgccattctgaccgttgtggctgccacaatggcgaacgaaatgggctttctggagaagacgaaaaaggatttcgggctcggaagcatcaccacacagcaaccggagtccaatattctggacatcgatcttcggcccgcctctgcttggaccctgtacgccgtggctacaacctttatcacgcctatgctccgccatagcattgaaaactcctctgtcaatgtgagcctgaccgccatcgcgaaccaggccacagttctgatgggcctcgggaagggatggcccctttccaaaatggacattggcgtgcctctgctggctatcgggtgttacagccaggtcaatcccattaccctcacagccgctctgcttctgctcgtggcccactatgctatcattggacctggcctgcaggccaaggcgaccagagaggcccaaaaacgggctgccgctggcatcatgaagaacccgacggtcgacgggatgacagtgatcgatctggaccccattccttacgatcccaaattcgaaaagcagctcggacaggttatgcttctggtgctgtgcgtcacccaggtgctcatgatgcgcacaacctgggccctgtgtgaggcccttaccctggcgacaggccctatctctacgctctgggaagggaatcccggaagattttggaacaccacaattgctgtttccatggccaatatcttccggggcagctatctggctggggccggactgctcttttctattatgaagaacaccgccaacacacgcagaggcaccggcaatacgggggagacacttggagagaaatggaagaaccggctgaatgctctgggcaaatccgagttccaaatctacaagaaaagcgggatccaggaggtggaccgcaccctcgccaaggaaggaattaaaagaggcgagaccgatcatcacgcggtctctcgggggagcgccaagctgagatggtttgtggagcgcaaccttgtgacaccggaaggaaaggttgtcgacctgggctgcggcagagggggatggtcctattactgtggcgggctcaaaaatgtgaaggaggtgaaaggactgaccaagggcgggcctggacatgaagaacccatccccatgtctacatatggctggaacctggtcagactccagagcggcgttgatgtgttcttcacgcctcccgaaaaatgcgacacccttctgtgtgatattggggagtccagccctaatccgacagtggaggctggacgcaccctgcgggtcctcaacctggtggaaaattggcttaacaataacacacaattttgcatcaaggttctgaatccctacatgccttccgtgattgagaagatggaagccctccagagaaaatacggcggggctctggtccgcaaccccctgtctcggaatagcacccacgagatgtattgggtgtccaacgcctctggaaacatcgttagctccgtgaatatgatctctagaatgctcattaaccgcttcacgatgcggcacaagaaagcgacctacgaacctgacgtcgatcttggcagcgggacaagaaatatcggaattgagtccgagacccccaacctggacatcattggcaagcgcatcgagaagatcaagcaggagcatgaaacaagctggcactatgatcaggaccatccgtacaagacctgggcctatcacggctcttacgagacaaaacaaaccgggtccgctagctctatggtgaatggagtggtccggctgctcacgaagccttgggacgttattcccatggtgacacagatggccatgaccgataccacaccttttggccagcagagagtgttcaaagaaaaggtcgacacgcgcacccaagagcccaaagaggggacaaagaagctgatgaaaatcaccgctgaatggctttggaaggagctgggcaaaaagaaaacacctagaatgtgtacccgggaagagtttacacgcaaggtgagatccaacgccgctctcggcgccattttcaccgatgagaataaatggaagtccgcgcgggaagccgttgaggactctgggttttgggaactggtggataaggagagaaacctgcacctcgaaggaaaatgcgagacgtgtgtctataatatgatgggcaagcgggagaaaaagctgggcgagttcgggaaagctaagggatcccgcgccatctggtacatgtggcttggcgctagatttctggagttcgaagccctcgggtttctgaacgaggaccattggttcagccgggaaaattcccttagcggagtggagggcgaggggctgcacaagctcggctacattctgcgcgatgtttctaaaaaggaaggaggcgccatgtatgcggacgataccgctgggtgggacacaagaatcaccctggaggatctcaaaaacgaagagatggtgacaaatcatatggaaggagagcacaagaaactggccgaggccatttttaaacttacctaccagaacaaggtcgtgcgggttcagcgccccacgccgagaggcacagtgatggacatcatcagccggcgcgaccagagagggtccggacaagtcgtgacctatggcctgaatacattcaccaacatggaagctcagctcattcggcagatggagggggaaggcgtcttcaaatctatccaacagctgacggtgaaggaggagattgccgttaaaaactggcttatccgcgtgggaagagaacggctgagccgcatggctatttccggcgatgactgcgtcgtgaagcctctcgatgacagatttgcctctgcgctgaccgccctgaatgatatggggaaagtgcggaaggacatccagcagtgggagcccagcagaggatggaacgattggacacaagttcccttctgctcccatcactttcacgaactcatcatgaaggacggccgcgtgctggtcgtgccttgtcggaatcaggatgagcttattgggagagctcgcatctctcagggagccggctggagcctgcgggaaaccgcttgcctcgggaaatcctacgcccagatgtggagcctgatgtatttccatagacgcgaccttcggctggcggccaacgctatttgttctgccgttccgtcccactgggtgcccacaagcagaaccacatggtctatccatgctacccacgagtggatgacgacagaggatatgctcaccgtctggaatcgcgtgtggattcaagaaaacccttggatggaggacaagacccccgtcgaatcctgggaggaaatcccttacctgggcaaacgggaggatcagtggtgcggaagcctgatcggcctcacatccagagccacctgggctaagaatattcagacagccatcaaccaggtgcgctctctgattgggtatgaggaatacacggactacatgcccagcatgaaacggtttagacgggaggaagaggaagcgggagttctttggtga

SEQ ID NO: 20255 - RNA, 9876 nt, synthetic construct
  misc_feature 1..9876: note = derived and/or modified CDS sequence (opt5) from DENV-2__JN851127__SS-prME
  source 1..9876: mol_type = other RNA
accgccggcatcattatcatgatgattcccacagtgatggctttccacctgacgaccagaaatggggaacctcatatgatcgtcagccggcaggaaaaggggaaatccctcctgtttaagacagagaatggcgttaacatgtgcacccttatggccatggacctgggggaactctgtgaggatacaattacctacaattgcccgctgcttaaacaaaacgaacccgaggacatcgattgttggtgcaattctacatccacctgggtgacgtatggaacctgtacagcgaccggcgagcacagaagagaaaagcggtccgtggctctggtccctcatgtggggatgggactcgagacacgcaccgaaacgtggatgtctagcgagggcgcctggaaacacgcccagagaatcgagacatgggttctgcggcatcccggcttcaccattatggctgccatcctggcttacacaattgggaccacctattttcagcgcgtgctcatcttcattctgcttacagccgtcgcgccttccatgacgatgagatgcatcggaatttctaaccgggactttgtggaaggcgttagcgggggatcctgggtggatatcgtcctggagcacggcagctgtgtgaccacaatggccaagaataagcccaccctcgacttcgaactgatcaaaacagaggctaagcaccctgccacccttcgcaaatactgcattgaagctaagctgacgaacacaaccaccgcctctagatgtccgacacagggggagccctccctcagcgaggaacaagataaacggtttgtgtgcaagcattctatggtcgaccgcggatggggcaatggctgtgggctgttcggaaagggcgggatcgttacctgcgcgatgtttacatgcaaaaagaacatggagggaaaaattgtgcagcctgaaaatctggagtatacgatcgtgattacaccccactccggcgaagagaacgccgtcgggaatgatacaggaaagcatggcaaagagatcaaggtgacccctcagagctctatcacagaagctgagctcaccggctacgggacggttaccatggaatgttcccccagaacaggactggacttcaacgagatggtgcttctgcagatggaaaataaagcctggctcgtccaccggcaatggtttctggatcttccgctgccttggctccccggcgctgacacccaggggagcaactggattcagaaggagacactggtgaccttcaagaaccctcacgccaaaaagcaggatgttgtggtcctgggatcccaagagggcgccatgcatacggctctcacaggggcgaccgaaatccagatgtctagcggcaatctgctttttacaggacacctgaaatgccgcctcagaatggacaagctgcagcttaaaggcatgtcctatagcatgtgtaccgggaagttcaaggtggtcaaagagattgccgaaacccaacatggaacaatcgtgattcgggttcagtacgagggcgacgggtctccctgcaagatccccttcgagatcatggatctggagaagcggcacgtgctcggacgcctgattacggtcaaccctatcgtgaccgagaaggactccccggttaatattgaagctgagcccccttttggcgatagctacatcattatcggggtggaacccggccagctgaaactctcttggttcaagaagggaagctccattggccagatgtttgagacaaccatgagaggggccaaaagaatggccatcctgggagacacagcttgggatttcggctctcttgggggagtctttaccagcatcggcaaggccctgcatcaagtgttcggggcgatttatggcgctgccttttccggagtgagctggacgatgaaaatcctcattggcgttgtcatcacatggattgggatgaactctcgctccaccagcctgtctgtgtccctggtgcttgtcggagtggttaccctctacctgggcgtgatggtccaggccgacagcgggtgtgtggtttcctggaagaataaagagctgaagtgcggatctggcatcttcatcacagataacgtgcacacctggacagaacagtataagtttcagcctgagagcccctccaaactcgcttctgccattcaaaaggctcacgaagaggggatctgtggcattcggagcgtcacgagactggaaaatcttatgtggaaacagatcaccccggagctgaaccatattctctccgagaatgaaatcaagctgacaatcatgaccggagacattaaaggcatcatgcaggccgggaagcgcagcctgcggcctcagcccattgagcttaaatactcttggaaggcgtggggaaaggccaaaatgctctccacagaactgcacaaccataccttcctgatcgatggccctgagacggctgaatgccccaataccaacagagcctggaatagcctcgaggtggaggactatgggtttggagttttcacaaccaacatttggctgaaacttaaagaacgccaagatgtgttttgtgactctaagctgatgtccgctgtcatcaaagacaatcgggccgtgcacgcggatatgggctactggatcgagagcgccctcaacgacacatggaagattgaaaaggcttctttcatcgaggtgaaaagctgccactggcctaagtcccataccctgtggagcaacggcgtcctggagtctgaaatgattatccccaaaaatttcgccgggccggtttcccagcacaactatagacctggataccatacacagaccgctggcccctggcaccttgggcgcctcgagatggattttgacttctgtgaaggaacgacagtggtggtcaccgaggattgcggcaatcgggggcccagcctgagaaccacaaccgcctccggaaagctgattacggaatggtgctgtcggtcttgcacactccctccgctgcgctacagaggcgaggacggctgttggtatgggatggagatccggccccttaaagaaaaggaggaaaacctggtgaatagcctcgttaccgccggacatggccagattgataacttttccctgggggtgctgggaatggctcttttcctcgaggaaatgctgagaacacgcgtcggcaccaagcacgcgatcctgctcgtggccgtttcttttgtgacactgatcaccgggaatatgagcttccgggaccttggaagagtcatggtgatggttggcgctacgatgaccgatgacattggcatgggggtgacatacctggccctcctggccgcttttaaagtccgccctaccttcgccgcgggactgcttctgagaaagctcacatccaaagagctgatgatgaccacgatcggcattgtgctcctgtctcaaagcacaatccccgagaccattcttgaactgacagatgctctcgccctggggatgatggtgctgaagatcgtccggaacatggagaaatatcagcttgccgttaccatcatggctattctgtgcgtgcctaatgccgtgatcctccagaacgcgtggaaggtctcctgtaccacactggctgtggttagcgtgtctcccctcctgcttacgtccagccgccaaaaggccgactggattcctctggccctcaccatcaaaggactgaatcccacagctatttttctgaccacactttctagaacctccaagaaacggagctggccgctgaacgaagccatcatggctgtcggcatggtgtctatcctcgcctccagcctgctcaagaatgatattcctatgacggggcccctggttgcgggaggccttctgacagtgtgctacgtcctgaccggccgctccgccgacctcgagctggaaagagctgccgacgtgcggtgggaggagcaggctgaaatcagcgggtctagccctattctttccatcaccatttctgaggatggaagcatgtccatcaaaaacgaagaggaggaacagacactgaccattctcatccgcacaggcctgctcgtcatctctgggctgttccccgtgagcattccgatcacggccgccgcttggtatctttgggaggttaagaaacagagagcgggagtgctgtgggacgtcccttctccccctcccgtgggcaaggccgaactggaggatggggcttaccggattaagcaaaaaggaatcctcggctatagccagattggcgccggggtttacaaggaaggaacctttcacacaatgtggcatgtgacccgcggcgccgtcctgatgcacaaagggaagagaatcgagcccagctgggctgacgtgaaaaaggatcttatctcctacggaggcgggtggaagctggagggagaatggaaagagggcgaagaggtgcaggttctcgccctggaacctggcaagaatccgcgggcggtccagacaaaacccggactcttcaagaccaacacgggaaccattggcgctgtgagcctggacttttctcctgggacatccggaagccccatcgtggataaaaagggcaaggtcgtggggctttatggaaacggcgttgtgaccagatctggcacatacgtctccgccattgcccaaaccgagaaaagcatcgaggacaatcctgaaattgaggatgacatcttccgcaagaaacggctgacaatcatggatctgcatcccggggctggaaagacgaaaagatatctccctgccattgtgcgcgaagcgatcaagcggggcctgagaacccttattctggctccgacacgcgttgtggccgccgagatggaagaggctctccgggggctgcccatcagataccagacccctgccattcgcgctgagcacaccggacgggaaatcgtcgacctcatgtgtcatgccacattcacgatgagactgctttcccccattcgggtgcctaactataatctgatcatcatggatgaggcgcactttaccgaccccgcctctattgctgcccgcggctacatcagcacaagagttgaaatgggggaggctgccggcattttcatgaccgccacaccgcctggatcccgggacccctttccccagagcaacgctcctatcatggatgaggaacgcgagattcccgaaagatcttggaactccggccacgagtgggtgaccgacttcaaggggaaaacggtctggtttgtgcctagcatcaaggcgggaaacgatatcgccgcttgcctgcggaaaaatggcaagaaagtgattcagctctctagaaagacattcgacagcgaatatatcaagacccgcaccaacgattgggactttgtcgttacaaccgatatttccgagatgggggccaatttcaaagccgagcgggtgatcgacccgagacgctgtatgaagcccgtgattctgacagatggagaagaacgggtcatccttgctggccctatgcccgtgacccattctagcgccgcgcaaagacgcgggcgggttggcagaaaccctaaaaatgaaaacgaccagtacatctacatgggagagcccctggaaaatgatgaggactgcgctcactggaaggaggccaaaatgctcctggacaacattaatacgccggaaggcatcattccttccatgtttgagcccgaacgcgagaaggtggatgccatcgacggggaatatagactgcggggagaggctcgcaaaacattcgtcgatctcatgagacggggcgaccttcctgtgtggctggcctaccgcgttgcggccgaggggattaactatgctgatagacggtggtgttttgacggagtgaagaacaatcagatcctggaagagaacgtcgaagtggagatttggaccaaggagggcgaacgcaaaaagctcaaaccccgctggctggatgcccggatctactctgaccctcttgctctgaaggagttcaaagagttcgccgctgggagaaagagcctcacactgaatctgatcaccgagatgggccgcctccccacgtttatgacccaaaaggcccggaacgcgcttgataatctggccgtcctgcatacagctgaagccggaggcagagcttataaccacgccctctccgagctgccggagacccttgaaacactgctcctgctgaccctccttgccacagtgaccgggggaattttcctgtttctgatgagcggcaaagggatcggaaagatgacgctcggcatgtgctgcattatcacagcttctattctgctttggtacgcgcagatccagcctcactggatcgccgcttccattatcctggagttctttctcattgttctgctgatccccgaacccgagaaacagcggacccctcaagacaatcagctcacctatgtggtgattgccatccttacagtcgttgccgctaccatggccaacgaaatgggcttcctggagaagaccaaaaaggattttgggctgggaagcatcacgacccagcagccggagtccaatattctcgacatcgatctgcgccccgcgtctgcctggacactttacgctgtggccaccacattcattacccctatgctgagacatagcatcgaaaactcctctgtgaatgtcagcctcacggctattgccaaccaagcgaccgtgctgatgggcctggggaagggatggcccctctccaaaatggacatcggcgttcctcttctggccattgggtgttacagccaggtgaatcccatcacactgaccgctgccctcctgcttctggtcgctcactatgccatcattggacctggcctccaggctaaggccacacgggaggcgcagaaacgcgccgctgccggcatcatgaagaacccgaccgtggacgggattacggtcatcgatctggaccccattccttacgatcccaaatttgaaaagcaactgggacaggtgatgctccttgttctgtgcgtgacacaggtcctgatgatgagaaccacatgggctctctgtgaggccctgacccttgccaccggccctatctctacactgtgggaagggaatcccggacggttctggaacacgaccatcgcggtgtccatggctaatatttttcgcggcagctatctcgccggggctggactgctgttctctatcatgaagaacacagccaacaccagacggggcacaggcaataccggggagacgctcggagagaaatggaagaaccgccttaatgccctgggcaaatccgaatttcagatttacaagaaaagcgggatccaagaggttgacagaacactggctaaggaaggaattaaacggggcgagaccgatcatcacgccgtgtctagagggagcgcgaagctccgctggttcatcgagcggaacctggtcaccccggaaggaaaggtggtggaccttggctgcggcagagggggatggtcctattactgtggcgggctgaaaaatgttaaggaggtcaaaggactcacaaagggcgggcctggacatgaagaacccatccccatgtctacctatggctggaacctggtgcgcctgcagagcggcgtggatgtcttctttacacctcccgaaaaatgcgacacgctcctttgtgatattggggagtccagccctaatccgaccgttgaggccggacggacactgagagtgctgaacctcgtggaaaattggctgaacaataacacccagttctgcatcaaggtccttaatccctacatgccttccgtgattgagaagatggaagctctgcaacgcaaatacggcggggccctcgttcggaaccccctgtctagaaatagcacacacgagatgtattgggtgtccaacgcttctggaaacatcgtcagctccgtgaatatgatttctcgcatgctgatcaaccggtttaccatgagacacaagaaagccacgtacgaacctgacgttgatctcggcagcgggacccgcaatatcggaattgagtccgagacacccaaccttgacatcattggcaagcggatcgagaaaattaagcaggagcatgaaaccagctggcactatgatcaggaccatccgtacaagacatgggcgtatcacggctcttacgagaccaaacagacagggtccgccagctctatggtgaatggagtcgtgagactgctgaccaagccttgggacgtgatccccatggtcacgcaaatggctatgacagataccacccctttcggccagcagcgcgtttttaaagaaaaggtggacacaagaacgcaggagcccaaagaggggaccaagaagctcatgaaaattacagccgaatggctgtggaaggagcttggaaaacggaagacccctcgcatgtgtacaagagaagagttcacccggaaagtgagatccaacgctgccctgggcgctatctttacagatgagaataagtggaaaagcgcccgggaagcggtcgaggactctgggttctgggaactcgtggataaggagcgcaacctgcacctggaaggaaagtgcgagacctgtgtttataatatgatgggcaaaagagagaagaaactcggcgaatttgggaaggccaaaggatcccgggctatctggtacatgtggctgggcgcccgcttccttgagtttgaagctctggggttcctcaacgaggaccattggtttagcagagaaaattccctgagcggagtggagggcgaggggcttcacaagctgggctacattctccgggatgtctctaagaaagaaggaggcgccatgtatgccgacgatacggcggggtgggacacccgcatcacactggaggatctgaagaacgaagagatggtgaccaatcatatggaaggagttcacaaaaagctcgctgaggccattttcagactgacataccaaaacaaagtggtccgggtgcagcgccccaccccgagaggcacggttatggacatcattagccggcgcgaccagagagggtccggacaggtggtcacatatggccttaataccttcacaaacatggaggcccaactgatccggcagatggaaggggagggcgtgtttaagtctatccagcatctcaccgtcacggaagagattgctgtgaagaactggctggttcgcgtgggaagagagcggcttagcagaatggccatctccggcgatgactgcgtcgtgaaacctctggatgaccgcttcgcttctgccctcaccgcgctgaatgatatggggaaggtgcggaaagacattcaacagtgggaacccagcagaggatggaacgattggacacaggttcccttttgctcccaccacttccatgagctgatcatgaaggacggccgcgtgctcgtcgtgccttgtcggaatcaggatgaactgattgggagagcccgcatctctcaaggagctggctggagccttcgggagaccgcctgcctggggaaatcctacgctcagatgtggagcctcatgtattttcacagacgcgacctgcggcttgccgcgaacgccatctgttctgctgttccgtcccattgggtgcccacaagcagaaccacatggtctattcacgccacccacgaatggatgacgacagaggatatgctgaccgtctggaatcgcgtgtggatccaggagaacccttggatggaagacaagacccccattgagtcctgggaagagatcccttacctcggcaagcgggaagatcagtggtgcggaagcctgattggcctgacatccagagctacctgggccaaaaatatccaaacagctattaaccaggtccggtctctcatcgggaatgaggagtatacggactacatgcccagcatgaagagattccgccgggaagaggaagaggccggagtgctgtggtga

SEQ ID NO: 20256 - RNA, 9876 nt, synthetic construct
  misc_feature 1..9876: note = derived and/or modified CDS sequence (opt5) from DENV-2__JN851120__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaaagcctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacagttgggaccacctattttcagagagtgctcatcttcattctgcttacagccgtcacgccttccatggcgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcgtggaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaaggtggtccagcctgaaaacctggagtatacgatcgtgattacaccccactctggcgaagagaatgccgttgggaacgatacaggaaaacatggcaaggagatcaaagtgacccctcagtccagcattacagaagctgagctcaccggctacgggacggtcaccatggaatgttctccccggacaggactggacttcaatgagatggtgcttctgcagatggaaaacaaggcctggctcgttcaccgccaatggtttctggatcttccgctgccttggctccccggcgctgacacccaggggtccaactggatccagaaagagacactggtgaccttcaagaatcctcacgccaagaaacaggatgtcgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggttaaggagattgccgaaacccaacatggaacaatcgtgattagagtccagtacgagggcgacgggagcccctgcaaaatccccttcgagattatggatctggaaaagcgccacgtgctcggacggctgatcacggttaatcctatcgtgaccgagaaagactctccggtcaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtgtttacctctattggcaaagccctgcatcaagttttcggggcgatctatggcgctgcctttagcggagtctcctggacgatgaagatcctcattggcgtggtgatcacatggattgggatgaatagccggtctacctccctgagcgtctctctggtgcttgttggagtggtcaccctctacctgggcgtgatggttcaggccgactccgggtgtgtggtcagctggaaaaacaaggagctgaaatgcggatccggcatcttcattacagataatgtgcacacctggacagaacagtataagtttcagcctgagtctcccagcaagctcgcttccgccatccaaaaagctcacgaagaggggatctgtggcattagatctgttacgcgcctggaaaaccttatgtggaagcagatcaccccggagctgaatcatattctcacagagaacgaagtgaaactgaccatcatgacaggagacattaagggcatcatgcaggccgggaaacggagcctgagacctcagcccaccgagcttaagtactcctggaaagcgtggggaaaggccaagatgctcagcacggaactgcacaatcataccttcctgatcgatggccctgagacagctgaatgccccaacaccaatcgcgcctggaactctctcgaggtcgaggactatgggtttggagtgttcacaaccaatatttggctgaaacttaaggaacggcaagatgtgttttgtgactccaaactgatgagcgctgccatcaaggacaacagagcggtccacgccgatatgggctactggattgagtctgctctcaacgacacatggaaaatcgaaaaggcctccttcattgaggttaagagctgccactggcctaaatctcataccctgtggagcaatggcgtgctggagtccgaaatgatcatccccaagaacttcgctgggccggtgagccagcacaattatcgccctggataccatacgcagacagccggcccctggcaccttgggcggctcgagatggattttgacttctgtgaaggaaccaccgtcgtggttacagaggattgcggcaacagagggccctctctgcggaccacgacagcctccggaaaactgattaccgaatggtgctgtcgcagctgcacactccctccgctgagataccggggcgaggacggctgttggtatgggatggagatcagaccccttaaggaaaaagaggaaaatctggtgaactccctcgtcaccgctggacatggccagattgataatttttctctgggggtgctgggaatggcgcttttcctcgaggaaatgctgcgcacacgggttggcaccaagcacgccatcctgctcgtggctgtcagctttgtgacgctgattaccgggaacatgtccttcagagaccttggacgcgttatggtgatggtcggcgccacaatgaccgatgacatcggcatgggggtgacatacctggccctcctggctgcctttaaggtgagacctaccttcgcggctggactgcttctgcggaaactcacgtctaaggagctgatgatgacaaccattggcatcgtcctcctgagccaatccacaatccccgagtctattcttgaactgaccgatgccctcgccctggggatgatggttctgaaaatcgtgcgcaatatggagaagtatcagcttgctgtgaccattatggccatcctgtgcgtccctaacgcggtgattctccagaatgcttggaaagttagctgtacaacgctggccgtggtctccgtgagccccctcctgcttacctcttcccaacagaaggccgactggatccctctggctctcacaatcaagggactgaaccccaccgccatttttctgacaacccttagcagaacgtctaaaaagcggtcctggccgctgaatgaagctatcatggccgttggcatggtgagcattctcgcgtcttccctgctcaaaaacgatatccctatgacagggcccctggtcgccggaggccttctgaccgtgtgctacgtcctgaccggccgcagcgctgacctcgagctggaaagagccgctgacgtgcggtgggaggagcaggccgaaatttccgggagctctcctatccttagcatcacaatttccgaggatggatctatgagcatcaagaatgaagaggaggaacagaccctgacaattctcatccgcacgggcctgctcgttatttccgggctgttccccgtgtctatcccgattaccgccgctgcgtggtatctttgggaggtcaaaaagcaaagagccggagtgctgtgggacgttccttctccccctcccgtgggcaaagctgaactggaggatggggcctaccggatcaagcagaagggaatcctcggctattcccagattggcgccggggtctacaaagaaggaacatttcacaccatgtggcatgtgacacgcggcgctgtgctgatgcacaaggggaaaagaatcgagccctcctgggccgacgttaagaaagatcttattagctacggaggcgggtggaagctggagggagaatggaaggagggcgaagaggtccaggtgctcgcgctggaacctggcaaaaacccgcgggctgtgcaaaccaagcccggactcttcaaaacgaacaccggaacaatcggcgccgtctccctggactttagccctgggacctctggatcccccattgtggataagaaaggcaaggttgtggggctttatggaaatggcgtcgtgacaagaagcggcacctacgtttctgccatcgctcagacagagaagtccatcgaggacaaccctgaaattgaggatgacatcttccgcaaaaagcggctgacgattatggatctgcatcccggggccggaaaaaccaagagatatctccctgcgatcgtgcgcgaagctattaaacggggcctgagaacacttatcctggccccgacccgcgtcgtggccgctgagatggaagaggccctccgggggctgcccatcagataccagacccctgctattcgcgccgagcacacaggacgggaaatcgttgacctcatgtgtcatgcgacgttcaccatgagactgcttagccccattcgggtgcctaattataacctgatcattatggatgaggcccactttacagaccccgcttccatcgccgctcgcggctacatttctaccagagtcgaaatgggggaggccgccggcatcttcatgacagctaccccgcctggaagccgggacccctttccccagtccaatgcgcctatcatggatgaggaacgcgagattcccgaaagaagctggaactctggccacgagtgggtgacggacttcaaggggaagacagtgtggtttgtcccttccatcaaagccggaaatgatattgctgcctgcctgcggaagaacggcaaaaaggttatccaactcagcagaaaaaccttcgactctgaatatattaagacccgcacaaatgattgggactttgtggtgaccacagatatcagcgagatgggggccaacttcaaggctgagcgggtcatcgacccgagacgctgtatgaaacccgtgattctgaccgatggagaagaacgggttatccttgccggccctatgcccgtgacgcattcctctgcggctcagagacgcgggcgggtcggcagaaatcctaagaacgaaaatgaccagtacatttacatgggagagcccctggaaaacgatgaggactgcgcccactggaaagaggccaagatgctcctggacaatatcaacacaccggaaggcattatccctagcatgtttgagcccgaacgcgagaaagtggatgctatcgacggggaatatagactgcggggagaggcccgcaagaccttcgttgatctcatgagacggggcgaccttcctgtgtggctggcgtaccgcgtcgccgctgaggggattaactatgccgatagacggtggtgttttgacggagtgaaaaataaccaaatcctggaagagaatgtcgaagtggagatttggacaaaggagggcgaaagaaagaaactcaagccccgctggctggatgctcggatctactccgaccctcttgccctgaaagagttcaaggagttcgctgccgggagaaaatctctcaccctgaacctgattacggagatgggccgcctccccacctttatgacacagaaggcgaagaatgcccttgataacctggctgttctgcataccgccgaagctggaggccgggcctataatcacgccctcagcgagctgccggagacacttgaaaccctgctcctgctgacactccttgctaccgtgacaggcgggatcttcctgtttctgatgtccgggaaagggattggaaagatgacactcggcatgtgctgcatcatcaccgcgagcattctgctttggtacgcccagatccagcctcactggattgctgcctctatcattctggagttctttctcatcgtgctgctgatccccgaacccgagaaacaaagaacccctcaggacaaccagctcacatatgtcgttattgccatccttaccgtggtggctgccacaatggcgaatgaaatgggcttcctggagaagacgaaaaaggattttgggctgggatccattaccacacagcaaccggagagcaacatcctcgacattgatctgcggcccgcctccgcttggaccctttacgccgtcgctacaaccttcatcacgcctatgctgcgccattctatcgaaaatagctccgtgaacgtttctctcaccgccattgcgaatcaggccacagtgctgatgggcctggggaagggatggcccctcagcaaaatggacatcggcgtccctcttctggctattgggtgttactcccaggtgaaccccatcaccctgacagccgctctcctgcttctggtcgcccactatgctattatcggacctggcctccaggccaaggcgaccagagaggcccaaaaacgggctgccgctggcattatgaagaatccgacggtggacgggatgacagttatcgatctggaccccatcccttacgatcccaaatttgaaaagcagctgggacaggtgatgctccttgtcctgtgcgtgacccaggttctgatgatgcgcacaacctgggccctctgtgaggccctgacccttgcgacaggccctattagcacgctgtgggaagggaaccccggaagattctggaataccacaatcgctgtgtctatggccaacatttttcggggctcctatctcgctggggccggactgctgttcagcatcatgaagaacaccgccaatacacgcagaggcaccggcaacacgggggagacactcggagagaaatggaagaatcggcttaacgctctgggcaaatctgaatttcaaatttacaagaaatccgggatccaggaggtcgaccgcaccctggccaaggaaggaatcaaaagaggcgagaccgatcatcacgcggtgagccgggggtctgccaagctcagatggttcgtggagcgcaatctggttacaccggaaggaaaggtcgtggaccttggctgcggcagagggggatggagctattactgtggcgggctgaaaaacgtgaaggaggtcaaaggactcaccaagggcgggcctggacatgaagaacccattcccatgtccacatatggctggaatctggttagactgcagtctggcgtggatgtgttctttacgcctcccgaaaaatgcgacaccctcctttgtgatatcggggagagctcccctaacccgacagtcgaggctggacgcaccctgcgggtgctgaatctcgttgaaaactggctgaataacaatacacaattctgcattaaggtgcttaacccctacatgcctagcgtcatcgagaagatggaagccctgcagagaaaatacggcggggctctcgtgcgcaatcccctgtcccggaactctacccacgagatgtattgggttagcaacgcctccggaaatattgtgtctagcgtcaacatgatctccagaatgctgatcaatcgctttacgatgcggcacaagaaagcgacctacgaacctgacgtggatctcggctctgggacaagaaacattggaatcgagagcgagacccccaatcttgacattatcggcaagcgcattgagaaaatcaagcaggagcatgaaacatcctggcactatgatcaggaccatccgtacaagacctgggcctatcacggcagctacgagacaaaacaaaccgggtctgcttccagcatggtgaacggagtcgttcggctgctgacgaagccttgggacgtgatccccatggtgacacagatggccatgaccgataccacacctttcggccagcagagagtctttaaagaaaaggtggacacgcgcacccaagagcccaaagaggggacaaagaagctcatgaaaattaccgctgaatggctgtggaaggagcttggcaaaaagaaaacacctagaatgtgtacccgggaagagttcacacgcaaggttagatctaatgccgctctgggcgccatctttaccgatgagaacaaatggaagtccgcgcgggaagccgtggaggacagcgggttctgggaactcgtcgataaggagagaaatctgcacctggaaggaaaatgcgagacgtgtgtgtataacatgatgggcaagcgggagaaaaagctcggcgaatttgggaaagctaagggatctcgcgccatttggtacatgtggctgggcgctagattccttgagtttgaagccctggggttcctcaatgaggaccattggttttcccgggaaaacagcctgtccggagttgagggcgaggggcttcacaagctgggctacatcctccgcgatgtgagcaaaaaggaaggaggcgccatgtatgcggacgataccgctgggtgggacacaagaattaccctggaggatctgaaaaatgaagagatggtcacaaaccatatggaaggagagcacaagaaactcgccgaggccatcttcaagctgacctaccagaataaggtggttcgggtgcagcgccccacgccgagaggcacagtcatggacattatctctcggcgcgaccagagagggagcggacaagtggtcacctatggccttaacacattcaccaacatggaagctcagctgatccggcagatggagggggaaggcgtgtttaaatccattcaacagctcacggttaaggaggagatcgccgtgaaaaattggctgattcgcgtcggaagagaacggctttctcgcatggctatcagcggcgatgactgcgtggtgaagcctctggatgacagattcgcctccgcgctcaccgccctgaacgatatggggaaagttcggaaggacattcagcagtgggagccctctagaggatggaatgattggacacaagtgcccttttgcagccatcacttccacgaactgatcatgaaggacggccgcgtcctcgtggttccttgtcggaaccaggatgagctgatcgggagagctcgcatttcccagggagccggctggtctcttcgggaaaccgcttgcctggggaaaagctacgcccagatgtggtccctcatgtattttcatagacgcgacctgcggcttgcggccaatgctatctgtagcgccgtgccgtctcactgggtccccacatccagaaccacatggagcattcatgctacccacgagtggatgacgacagaggatatgctgaccgtgtggaaccgcgtctggatccaagaaaatccttggatggaggacaagacccccgtggaatcttgggaggaaattccttacctcggcaaacgggaggatcagtggtgcggatccctgatcggcctgacaagcagagccacctgggctaagaacatccagacagccattaatcaggttcgctccctcatcgggaacgaggaatatacggactacatgccctctatgaaacggttcagaattgaggaagaggaagcgggagtgctgtggtga

SEQ ID NO: 20257 - RNA, 9876 nt, synthetic construct
  misc_feature 1..9876: note = derived and/or modified CDS sequence (opt5) from DENV-2__JN851131__SS-prME
  source 1..9876: mol_type = other RNA
accgccggagtgatcattatgatgatccccacagtcatggctttccacctgacgaccagaaacggggagcctcatatgattgttagccggcaggaaaagggaaaatccctcctgtttaagacagagaatggagtgaacatgtgcacccttatggccatcgacctgggggaactctgtgaggatacaattacctacaattgcccgctgcttagacaaaacgaacccgaggacatcgattgttggtgcaattctacaagcacctgggtgacgtatggaacctgtacagcgaccggcgagcaccggcgggaaaaacgctccgtcgctctggtgcctcatgttgggatgggactcgagacaagaaccgaaacgtggatgtctagcgagggcgcctggaagcacgcccagcggatcgagacatgggtgctgcgccatcccggcttcaccattatggctgccatcctggcttacacaattgggaccacctattttcagagagtcctcatcttcattctgcttacagccgtggcgccttccatgacgatgcggtgcatcggaatttctaaccgcgactttgttgaaggcgtgagcgggggatcctgggtcgatatcgtgctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaaggaggaacaagataaacgctttgtctgcaagcatagcatggttgacagaggatggggcaatggctgtgggctgttcggaaagggcgggatcgtgacctgcgcgatgtttacatgcaaaaagaacatggagggaaaagtggtccagcctgaaaatctggagtatacgattgtgatcacaccccactctggcgaagagaacgccgttgggaatgatacaggaaagcatggcaaagagattaaggtgacccctcagtccagcatcacagaagctgagctcaccggctacgggacggtcaccatggaatgttctccccggacaggactggacttcaacgagatggtgcttctgcagatggaagataaagcctggctcgttcaccgccaatggtttctggaccttccgctgccttggctccccggcgctgatacccaggggtccaattggatccagaaggagacactggtgaccttcaagaaccctcacgccaaaaagcaggacgtcgtggtcctgggaagccaagagggcgccatgcatacggctctcacaggggcgaccgaaattcagatgtcctctggcaacctgctttttacaggacacctgaaatgcagactccggatggacaagctgcagcttaaaggcatgagctattccatgtgtaccgggaagttcaaggtggttaaagagatcgccgaaacccaacatggaacaattgtgatcagagtccagtacgagggcgatgggagcccctgcaagattcccttcgagatcatggacctggaaaaacgccacgtgctcggacggctgatcacggttaatcctattgtgaccgagaaggattctccggtcaacatcgaagctgagcccccttttggcgactcctacattatcattggggtggaacccggccagctgaaactcagctggttcaagaagggatctagcatcggccagatgtttgagacaaccatgagaggggccaaacgcatggccattctgggagatacagcttgggacttcggctcccttgggggagtgtttacctctatcggcaaggccctgcatcaagttttcggggcgatctatggcgctgcctttagcggagtctcctggacgatgaaaattctcatcggcgtggtgattacatggatcgggatgaatagccggtctacctccctgagcgtctctctggtgcttgttggagtggtcaccctctacctgggcgtgatggttcaggccgattccgggtgtgtggtcagctggaagaacaaagagctgaagtgcggatccggcattttcatcacagacaatgtgcacacctggacagaacagtataagtttcagcctgagtctcccagcaaactcgcttccgccatccaaaaggctcacgaagaggggatttgtggcatcagatctgttacgcgcctggaaaaccttatgtggaaacagattaccccggagctgaatcatatcctcagcgagaacgaagtgaagctgacaattatgaccggagatatcaaaggcatcatgcaggccgggaagcggtccctgagacctcagcccacagagcttaaatacagctggaagacctggggaaaggcgaaaatgctctctacggaactgcacaatcataccttcctgattgacggccctgagacagccgaatgccccaacaccaatcgcgcttggaactccctcgaggtcgaggattatgggtttggagtgttcacaaccaatatctggctgaaacttaaagaacggcaagaggtgttttgtgacagcaagctgatgtctgccgctattaaagacaacagagccgtccacgcggatatgggctactggatcgaatccgccctcaatgacacatggaagattgagaaggctagcttcatcgaggttaaatcttgccactggcctaagagccataccctgtggtccaacggcgtgctggaaagcgagatgatcattcccaaaaacttcgccgggccggtgtctcagcacaattatcgccctggataccatacgcagacagctggcccctggcaccttgggaagctcgaaatggattttgacttctgtgagggaaccaccgtcgtggttacagaagattgcggcaaccgggggccctccctgagaaccacgacagccagcggaaaactgatcaccgagtggtgctgtcggtcctgcacactccctccgctgcgctacagaggcgaggacggctgttggtatgggatggaaattcggccctctaaggagaaggaagagaatcttgtgaacagcctggtcaccgccggacatggccagatcgataatttttccctcggggtgctgggaatggctctgttccttgaagagatgctcagaacacgcgttggcaccaaacacgcgattctgctggtggccgtctcttttgtgacgctcatcaccgggaacatgagcttccgggacctgggaagagttatggtgatggtcggcgctacaatgaccgatgacattggcatgggggtgacataccttgccctgctcgccgcttttaaggtgcgccctaccttcgccgcgggactgctgcttagaaaactgacgtccaaggagctcatgatgacaaccatcggcatcgtcctgctctctcaaagcacaattcccgaaaccatcctggagcttaccgatgctctggccctcgggatgatggttctgaaaattgtgcggaatatggaaaagtatcagctggccgtgacaatcatggctattctttgcgtccctaacgccgtgatcctgcagaatgcgtggaaggtttcctgtacgaccctcgctgtggtcagcgtgtctcccctgctcctgacatccagccaacagaaagccgactggatccctcttgccctgaccattaagggactcaaccccacagctatctttctgaccacgctgtctcgcacatccaaaaagagaagctggccgcttaatgaggccattatggctgttggcatggtgtctatcctggcctccagcctcctgaaaaacgatattcctatgaccgggcccctcgtcgcgggaggcctgcttaccgtgtgctacgtcctgacaggccggtccgccgacctggaactcgagcgcgctgccgacgtgagatgggaggaacaggctgagatcagcgggtctagccctatcctgtccattaccatctctgaagatggaagcatgtccattaagaatgaggaggaggaacagacacttacgatcctgattcggaccggcctcctggttatctctggactcttccccgtgagcattccgatcacagccgccgcttggtatctgtgggaagtcaaaaagcaacgcgcgggagtgctttgggacgttccttctccccctcccgtgggcaaggccgagctggaagatggggcttacagaatcaaacagaagggcattctgggctatagccagatcggcgccggggtctacaaagagggaacctttcacacaatgtggcatgtgacccggggcgccgtgctcatgcacaaggggaaacgcattgagcccagctgggctgacgttaagaaggatctgatctcctacggaggcgggtggaaacttgaaggagagtggaaggaaggcgaggaagtccaggtgctggccctcgagcctggcaaaaacccgagagcggtgcaaacgaagcccgggctgttcaaaaccaatacaggaaccattggcgctgtcagcctcgacttttctcctgggacatccggaagccccatcgtggataagaagggcaaagttgtggggctgtatggaaacggcgtcgtgacccggtctggcacatacgtttccgccatcgcccagacggaaaagagcattgaagacaaccctgagatcgaagatgacattttccgcaagaagcgccttaccatcatggatctgcatcccggggctggaaaaacaaagcggtatctgcctgccattgtgagagaggcgatcaagcgcggcctccggaccctgatccttgctccgaccagagtcgtggccgccgaaatggaggaggctctgcgcgggctccccattcggtaccagacccctgctatcagagttgaacacacgggacgcgagattgtggacctgatgtgtcatgctaccttcacaatgcggctcctgtcccccatcagagtccctaattataaccttattatcatggatgaagcccactttaccgaccccgcgtctattgccgctcggggctacatcagcacacgcgtggagatgggggaggccgctggcatcttcatgaccgccacgccgcctggatccagagacccctttccccagagcaatgcccctattatggatgaagaacgggaaatccccgagcgctcttggaactccggccacgaatggattacagacttcaaagggaagaccgtgtggtttgtccctagcatcaaagctggaaatgatattgcggcctgcctgagaaagaacggcaaaaaggttatccaactgtctcggaagaccttcgacagcgagtatatcaaaacaagaaccaatgattgggactttgtggtgacaaccgatatttccgagatgggggctaacttcaaggccgaacgcgtcatcgacccgcggagatgtatgaaacccgtgattctcacggatggagaggaacgcgttatcctggccggccctatgcccgtgacacattctagcgctgcccagcggagagggcgcgtcggccggaatcctaagaacgagaatgaccagtacatttacatgggagaaccccttgagaacgatgaggactgcgcgcactggaaagaagctaagatgctgctcgacaatatcaacaccccggagggcatcattccttccatgtttgaacccgagagagaaaaagtggatgccatcgacggggagtatcgcctgagaggagaggcccggaagacattcgttgatctgatgcgcagaggcgacctccctgtgtggcttgcttaccgggtcgccgcggaagggattaattatgccgatcgcagatggtgttttgacggagtgaagaacaaccaaatcctggaggaaaatgtcgaggtggagatttggaccaaagaaggcgagcggaagaaactgaagcccagatggctcgatgctcgcatctactctgaccctctggcccttaaagagttcaaggagttcgctgccgggcggaagtccctgacgctcaacctgattaccgaaatgggcagactgcccacatttatgacccagaaagctcgcaatgccctcgataaccttgcggttctgcatacagccgaggctggaggccgggcctataatcacgctctgtccgagctcccggaaaccctggagacacttctgctcctgaccctgctcgccacggtgacagggggaatcttcctttttctgatgagcggcaaggggatcggaaaaatgaccctgggcatgtgctgcattatcaccgcctctgtgctcctgtggtacgctcagattcagcctcactggatcgcggcctccattatccttgagttctttctgatcgtcctcctgattcccgagcccgaaaagcaaagaacacctcaggacaaccagctgacctatgttgtgatcgctattctcacagtggtcgccgccacgatggctaatgagatgggcttccttgagaaaaccaagaaggattttgggctgggaagcatcgccattcagcaaccggaatccaacatcctggacatcgatctccggcccgcgtctgcctggacactgtacgctgtggccaccacattcattacccctatgcttcgccatagcatcgaaaattcctctgttaacgtgagcctgacggctattgccaatcaggcgaccgtcctcatgggcctggggaaaggatggcccctgtccaagatggacatcggcgtgcctctccttgccattgggtgttacagccaggtcaaccccatcacactgaccgctgccctgctcctgcttgtggctcactatgccattatcggacctggcctgcaggctaaagccacaagagaagcgcaaaagcgggccgctgccggcatcatgaaaaatccgaccgttgacgggattacggtgatcgatctcgaccccattccttacgatcccaagtttgagaagcagctgggacaggtcatgctgctcgtgctttgcgttacacaggtgctgatgatgcgcaccacatgggctctgtgtgaagccctcaccctggccaccggccctatctctacactttgggaggggaaccccggaagattctggaatacgaccattgcggtctccatggctaacatctttcggggcagctatctggccggggctggactcctgttctctatcatgaaaaatacagccaacacccgcagaggcacaggcaacaccggggagacgctgggagaaaagtggaaaaatcggctcaacgcccttggcaagtccgagtttcaaatttacaaaaagagcgggatccaggaagtggaccgcacactggctaaagagggaattaagagaggcgagaccgatcatcacgccgtgtctcgggggagcgcgaagctgagatggttcgttgaacgcaatctcgtcaccccggagggaaaagtggtggacctgggctgcggcagaggcgggtggtcctattactgtggagggcttaagaacgtcaaagaagttaaggggctgacaaaaggcgggcctggacatgaggaacccatccccatgtctacctatggctggaatctcgtgagactgcagagcggcgtggatgtcttctttacacctcccgagaagtgcgacacgctgctctgtgatattggggagtccagccctaacccgaccgtggaagccggacgcacacttcgggttctgaatctggtggagaactggctcaataacaatacccaattctgcatcaaggtcctgaacccctacatgccttccgtgatcgagaagatggaggcccttcagagaaagtacggcggggccctggttcgcaatcccctctctcggaacagcacacacgaaatgtattgggtgtccaatgcttctggaaacattgtcagctccgtgaacatgatctctagaatgctgattaatcgctttaccatgcggcacaaaaaggccacgtacgagcctgacgtggatctgggcagcgggaccagaaacatcggaattgagtccgaaaaacccaatctcgacatcatcggcaagcgcattgagaagatcaaacaggaacatgagacaagctggcactatgatcaggaccatccgtacaagacctgggcgtatcacggctcttacgaaacaaaacaaaccgggtccgccagctctatggtcaacggagttgtgcggcttctgacaaagccttgggacgtgattcccatggtcacccagatggctatgacggatacaacccctttcggccagcagagagtgtttaaagagaaggttgacacccgcacacaagagcccaaggaagggacgaaaaagctgatgaaaatcaccgccgagtggctctggaaggaactgggcaaaaagaaaacacctagaatgtgtacccgggaggagttcacacgcaaggtgagatccaatgctgcccttggcgctatttttaccgatgaaaacaagtggaaaagcgcccgggaggcggtcgaagactctgggttctgggagctggtgaataaggaaagaaacctccacctggagggaaaatgcgagacatgtgtttataatatgatgggcaagcgggagaaaaagctgggcgagtttgggaaggccaaaggatcccgcgctatctggtacatgtggctcggcgccagattcctggaatttgaggctcttgggttcctgaacgaagatcattggtttagccgggaaaattccctcagcggagtggagggcgaagggctgcacaaacttggctacattctgcgcgacgtctctaaaaaggagggaggcgccatgtatgccgatgacaccgcggggtgggatacgagaatcaccctcgaagacctgaaaaacgaggaaatggtgacaaatcatatggagggagagcacaagaagctggctgaagccatcttcaaactcacctaccagaacaaggttgtgcgggtccagcgccccacaccgagaggcaccgtgatggatattatcagccggcgcgaccagagagggtccggacaagtcgtgacgtatggcctgaatacattcaccaacatggaggcccagcttattcggcagatggaaggggagggcgtttttaaatctatccaacatctgacagtgaccgaggaaattgctgtcaagaactggctcgtgcgcgtgggaagagagcggctgagccgcatggccatctccggcgacgattgcgttgtgaaacctcttgacgatagattcgcttctgccctgacggcgctcaatgacatggggaaggtccggaaggatatccagcagtgggaacccagcagaggatggaacgactggacccaggtgcccttttgctcccaccacttccatgagctgattatgaaagatggccgcgttctggtggtcccttgtcggaatcaagacgaactcatcgggagagcccgcatttctcagggagctggctggagcctgcgggagacagcctgccttgggaagtcctacgctcagatgtggagcctgatgtattttcacagacgcgatctccggctggccgcgaacgccatctgttctgctgtgccgtcccattgggtccccaccagcagaacaacctggtctattcacgccacacacgagtggatgaccacggaagacatgcttacagtgtggaatcgcgtttggatccaggagaacccttggatggaagataaaacccccgtggagtcctgggaagagatcccttacctgggcaagcgggaggaccaatggtgcggaagcctcattggcctgacctccagagctacatgggccaaaaatatccagaccgctattaaccaggtccgctctctgatcgggaatgaagagtatacagattacatgcccagcatgaagcggttcagacgggaagaggaagaggccggagtgctctggtga

SEQ ID NO: 20258 - RNA, 9876 nt, synthetic construct
  misc_feature 1..9876: note = derived and/or modified CDS sequence (opt5) from DENV-2__JN851122__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggttagcatcctcgcgtcttccctgctcaaaaacgatattcctatgacagggcccctggtggccggaggccttctgaccgtctgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtttctattccgatcaccgccgctgcgtggtatctttgggaggtgaaaaagcaaagagccggagtcctgtgggacgtgccttctccccctcccgttggcaaagctgaactggaggatggggcctaccggatcaagcagaagggcattctcggctattcccagatcggcgccggggtgtacaaagaaggaacatttcacaccatgtggcatgtcacacgcggcgctgtgctgatgcacaaggggaaaagaattgagccctcctgggccgacgtgaagaaagatcttatcagctacggaggcgggtggaagctggagggagaatggaaggagggcgaagaggttcaggtcctcgcgctggaacctggcaaaaacccgcgggctgtgcaaaccaagcccggactcttcaaaacgaacaccggaacaattggcgccgtgtccctggactttagccctgggacctctggatcccccatcgtcgataagaaaggcaaggtggttgggctttatggaaatggcgtggtcacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggacctcatgtgtcatgcgacgttcaccatgagactgcttagccccatccgggttcctaattataacctgattatcatggatgaggcccactttacagaccccgcttccattgccgctcgcggctacatctctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggtcacggacttcaaggggaagacagtgtggtttgtgccttccattaaaaccggaaatgatatcgccgcttgcctgcggaagaacggcaaaaaggtcattcaactcagcagaaaaaccttcgactctgaatatatcaagacacgcaccaatgattgggactttgttgtgacaaccgatatcagcgagatgggggccaacttcaaggccgagcgggtgattgacccgagacgctgtatgaaacccgtcatcctgacggatggagaagaacgggtgattcttgctggccctatgcccgttacacattcctctgccgcgcagagacgcgggcgggtgggcagaaatcctaagaacgaaaatgaccagtacatctacatgggagagcccctggaaaacgatgaggactgcgctcactggaaagaggccaagatgctcctggacaatattaacaccccggaaggcatcatccctagcatgtttgagcccgaacgcgagaaagtcgatgccattgacggggaatatagactgcggggagaggctcgcaagacattcgtggatctcatgagacggggcgaccttcctgtttggctggcctaccgcgtggcggccgaggggatcaactatgctgatagacggtggtgttttgacggagtcaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgctgggagaaaatctctcacgctgaacctgatcaccgagatgggccgcctccccacatttatgacccagaaggccaagaatgcgcttgataacctggccgtgctgcatacagctgaagccggaggccgggcttataatcacgccctcagcgagctgccggagacccttgaaacactgctcctgctgaccctccttgccacggttacagggggaattttcctgtttctgatgtccggcaaagggatcggaaagatgaccctcggcatgtgctgcatcattaccgctagcatcctgctttggtacgcgcagattcagcctcactggatcgccgcttctattatcctggagttctttctcatcgtgctgctgattcccgaacccgagaaacaaagaacacctcaggacaaccagctcacctatgtggtcatcgccattcttacagttgtggccgctacgatggccaatgaaatgggcttcctggagaagaccaaaaaggattttgggctgggatccatcacaacccagcaaccggagagcaacattctcgacatcgatctgcggcccgcgtccgcctggacactttacgctgtggccaccacgttcatcacccctatgctgcgccattctattgaaaatagctccgtcaacgtgtctctcacagctatcgccaatcaggcgaccgttctgatgggcctggggaagggatggcccctcagcaaaatggacattggcgtgcctcttctggccatcgggtgttactcccaggtcaaccccattacactgaccgctgccctcctgcttctggtgacgcactatgctatcattggacctggcctccaggccaaggctacaagagaggcccaaaaacgggcggccgctggcatcatgaagaatccgaccgtcgacgggatgacagtgatcgatctggaccccattccttacgatcccaaatttgaaaagcagctgggacaggttatgctccttgtgctgtgcgtcacccaggtgctgatgatgcgcaccacatgggccctctgtgaggctctgacgcttgccaccggccctatcagcacactgtgggaagggaaccccggaagattctggaataccacaattgccgtttctatggcgaacatctttcggggctcctatctcgctggggccggactgctgttcagcattatgaagaacaccgctaatacgcgcagaggcacaggcaacatcggggagaccctcggagagaaatggaagaatcggcttaacgccctgggcaaatctgaatttcaaatctacaagaaatccgggattcaggaggtggaccgcaccctggccaaggaaggaatcaaaagaggcgagacagatcatcacgctgtcagccgggggtctgccaagctcagatggttcgtggagcgcaatctggtgaccccggaaggaaaggttgtcgaccttggctgcggcagaggcgggtggagctattactgtggagggctgaaaaacgtgaaggaggtgaaagggctcacaaagggcgggcctggacatgaagaacccattcccatgtccacgtatggctggaatctggtcagactgcagtctggcgttgatgtgttctttacccctcccgaaaaatgcgacacactcctttgtgatatcggggagagctcccctaacccgaccgtggaggcgggacgcacactgcgggtcctgaatctcgtggaaaactggctgaataacaatacccaattctgcattaaggttcttaacccctacatgcctagcgtgatcgagaagatggaagccctgcagagaaaatacggcggggctctcgtccgcaatcccctgtcccggaactctacgcacgagatgtattgggtgagcaacgcctccggaaatatcgtttctagcgtgaacatgatttccagaatgctgatcaatcgctttaccatgcggcacaagaaagctacatacgaacctgacgtcgatctcggctctgggaccagaaacattggaatcgagagcgagacacccaatcttgacattatcggcaagcgcatcgagaaaattaagcaggagcatgaaacctcctggcactatgatcaggaccatccgtacaagacatgggcctatcacggcagctacgagaccaaacaaacggggtctgcgtccagcatggtgaacggagtggtccggctgctgacaaagccttgggacgttatccccatggtgacccagatggccatgaccgatacaacgcctttcggccagcagagagtgtttaaagaaaaggtcgacacccgcacacaagagcccaaagaggggaccaagaagctcatgaaaattacagctgaatggctgtggaaggagcttggcaaaaagaaaacccctagaatgtgtacacgggaagagttcacccgcaaggtgagatctaatgccgctctgggcgccatctttacggatgagaacaaatggaagtccgctcgggaagccgttgaggacagcgggttctgggaactcgtggataaggagagaaatctgcacctggaaggaaaatgcgagacctgtgtctataacatgatgggcaagcgggagaaaaagctcggcgaatttgggaaagcgaagggatctcgcgccatttggtacatgtggctgggcgctagattccttgagtttgaagccctggggttcctcaatgaggaccattggttttcccgggaaaacagcctgtccggagtggagggcgaggggcttcacaagctgggctacatcctccgcgatgttagcaaaaaggaaggaggcgctatgtatgccgacgatacagccgggtgggacaccagaattacactggaggatctgaaaaatgaagagatggtgaccaaccatatggaaggagagcacaagaaactcgcggaggctatcttcaagctgacgtaccagaataaggtcgtgcgggttcagcgccccacaccgagaggcaccgtgatggacatcatttctcggcgcgaccagagagggagcggacaagtcgtgacatatggccttaacaccttcacgaacatggaagcccagctgatccggcagatggagggggaaggcgtctttaaatccattcaacagctcaccgtgaaggaggagatcgccgttaaaaattggctgattcgcgtgggaagagaacggctttctcgcatggctatcagcggcgatgactgcgtcgtgaagcctctggatgacagattcgcctccgctctcacagccctgaacgatatggggaaagtgcggaaggacatccagcagtgggagccctctagaggatggaatgattggacccaagttcccttttgcagccatcacttccacgaactgattatgaaggacggccgcgtgctcgtcgtgccttgtcggaaccaggatgagctgatcgggagagcgcgcatttcccagggagccggctggtctcttcgggaaacagcttgcctggggaaaagctacgcccagatgtggtccctcatgtattttcatagacgcgacctgcggcttgctgccaatgcgatctgtagcgccgttccgtctcactgggtgcccacctccagaacaacctggagcattcatgctacgcacgagtggatgacaaccgaggatatgctgaccgtctggaaccgcgtgtggatccaagaaaatccttggatggaggacaagacacccgtcgaatcttgggaggaaatcccttacctcggcaaacgggaggatcagtggtgcggatccctgattggcctgaccagcagagccacatgggctaagaacatccagacggccattaatcaggtgcgctccctcatcgggaacgaggaatataccgactacatgccctctatgaaacggttcagacgggaggaagaggaagctggagttctgtggtga

SEQ ID NO: 20259 - RNA, 9876 nt, synthetic construct
  misc_feature 1..9876: note = derived and/or modified CDS sequence (opt5) from DENV-2__JN851116__SS-prME
  source 1..9876: mol_type = other RNA
accgccggaatcattatcatgatgattcccacagtgatggctttccacctgacgaccagaaacggggagcctcatatgatcgtcagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaatcctggccgttgtgtccgtcagccccctcctgcttacgtcttcccaacagaaggccgactggattcctctggctctcaccatcaagggactgaaccccacagccatttttctgaccacacttagcagaacctctaaaaagcggtcctggccgctgaatgaagctatcatggccgtgggcatggttagcattctcgcgtcttccctgctcaaaaacgatatccctatgacggggcccctggtggccggaggccttctgacagtctgctacgtgctgaccggccgcagcgctgacctcgagctggaaagagccgctgacgtccggtgggaggagcaggccgaaatctccgggagctctcctattcttagcatcaccatttccgaggatggatctatgagcatcaagaatgaagaggaggaacagacactgaccattctcatccgcacaggcctgctcgtgatttccgggctgttccccgtttctatcccgatcacggccgctgcgtggtatctttgggaggtgaaaaagcaaagagccggagtcctgtgggacgtgccttctccccctcccgttggcaaagctgaactggaggatggggcctaccggattaagcagaagggaatcctcggctattcccagattggcgccggggtgtacaaagaaggaacctttcacacaatgtggcatgtcacccgcggcgctgtgctgatgcacaaggggaaaagaatcgagccctcctgggccgacgtgaagaaagatcttattagctacggaggcgggtggaagctggagggagaatggaaggagggcgaagaggttcaggtcctcgcgctggaacctggcaaaaacccgcgggctgtgcaaacaaagcccggactcttcaaaaccaacacgggaaccatcggcgccgtgtccctggactttagccctgggacatctggatcccccatcgtcgataagaaaggcaaggtggttgggctttatggaaatggcgtggtcaccagaagcggcacatacgtgtctgccattgctcagaccgagaagtccatcgaggacaaccctgaaattgaggatgacatcttccgcaaaaagcggctgacaattatggatctgcatcccggggccggaaaaacgaagagatatctccctgcgatcgttcgcgaagctatcaaacggggcctgagaacccttattctggccccgacacgcgtggtcgccgctgagatggaagaggccctccgggggctgcccatcagataccagacccctgctattcgcgccgagcacaccggacgggaaatcgtggacctcatgtgtcatgcgacattcacgatgagactgcttagccccattcgggttcctaattataacctgatcattatggatgaggcccactttaccgaccccgcttccatcgccgctcgcggctacatctctacaagagtggaaatgggggaggccgccggcattttcatgaccgctacaccgcctggaagccgggacccctttccccagtccaatgcgcctatcatggatgaggaacgcgagattcccgaaagaagctggaactctggccacgagtgggtcaccgacttcaaggggaagacggtgtggtttgtgccttccatcaaagccggaaatgatattgctgcctgcctgcggaagaacggcaaaaaggtcatccaactcagcagaaaaacattcgactctgaatatatcaagacccgcaccaatgattgggactttgttgtgacaaccgatattagcgagatgggggccaacttcaaggctgagcgggtgatcgacccgagacgctgtatgaaacccgtcattctgacagatggagaagaacgggtgatccttgccggccctatgcccgttacccattcctctgcggctcagagacgcgggcgggtgggcagaaatcctaagaacgaaaatgaccagtacatttacatgggagagcccctggaaaacgatgaggactgcgcccactggaaagaggccaagatgctcctggacaatatcaacacgccggaaggcatcattcctagcatgtttgagcccgaacgcgagaaagtcgatgctatcgacggggaatatagactgcggggagaggcccgcaagacattcgtggatctcatgagacggggcgaccttcctgtttggctggcgtaccgcgtggccgctgaggggattaactatgccgatagacggtggtgttttgacggagtcaaaaataaccaaatcctggaagagaatgtggaagtcgagatttggaccaaggagggcgaaagaaagaaactcaagccccgctggctggatgctcggatctactccgaccctcttgccctgaaagagttcaaggagttcgctgccgggagaaaatctctcacactgaacctgattaccgagatgggccgcctccccacgtttatgacccagaaggcgaagaatgcccttgataacctggctgtgctgcatacagccgaagctggaggccgggcctataatcacgccctcagcgagctgccggagacccttgaaacactgctcctgctgaccctccttgctacagttaccgggggaatcttcctgtttctgatgtccggcaaagggatcggaaagatgacgctcggcatgtgctgcattatcacagcgagcattctgctttggtacgcccagatccagcctcactggattgctgcctctatcatcctggagttctttctcattgtgctgctgatccccgaacccgagaaacaaagaacccctcaggacaaccagctcacctatgtggtcattgccatccttacagttgtggctgccaccatggcgaatgaaatgggcttcctggagaagaccaaaaaggattttgggctgggatccattacgacccagcaaccggagagcaacatcctcgacatcgatctgcggcccgcctccgcttggacactttacgccgtggctaccacattcattacccctatgctgcgccattctatcgaaaatagctccgtcaacgtgtctctcacggccattgcgaatcaggccaccgttctgatgggcctggggaagggatggcccctcagcaaaatggacatcggcgtgcctcttctggctattgggtgttactcccaggtcaaccccatcacactgaccgccgctctcctgcttctggtggcccactatgctattatcggacctggcctccaggccaaggcgacaagagaggcccaaaaacgggctgccgctggcatcatgaagaatccgaccgtcgacgggatgacggtgattgatctggaccccatcccttacgatcccaaatttgaaaagcagctgggacaggttatgctccttgtgctgtgcgtcacacaggtgctgatgatgcgcaccacatgggccctctgtgaggccctgacccttgcgaccggccctattagcacactgtgggaagggaaccccggaagattctggaatacgaccatcgctgtttctatggccaacatttttcggggctcctatctcgctggggccggactgctgttcagcatcatgaagaacacagccaatacccgcagaggcacaggcaacaccggggagacgctcggagagaaatggaagaatcggcttaacgctctgggcaaatctgaatttcaaatctacaagaaatccgggattcaggaggtggaccgcacactggccaaggaaggaatcaaaagaggcgagaccgatcatcacgcggtcagccgggggtctgccaagctcagatggttcgtggagcgcaatctggtgaccccggaaggaaaggttgtcgaccttggctgcggcagaggcgggtggagctattactgtggagggctgaaaaacgtgaaggaggtgaaagggctcacaaagggcgggcctggacatgaagaacccattcccatgtccacctatggctggaatctggtcagactgcagtctggcgttgatgtgttctttacacctcccgaaaaatgcgacacgctcctttgtgatatcggggagagctcccctaacccgaccgtggaggctggacgcacactgcgggtcctgaatctcgtggaaaactggctgaataacaatacccaattctgcattaaggttcttaacccctacatgcctagcgtgatcgagaagatggaagccctgcagagaaaatacggcggggctctcgtccgcaatcccctgtcccggaactctacacacgagatgtattgggtgagcaacgcctccggaaatatcgtttctagcgtgaacatgatttccagaatgctgatcaatcgctttaccatgcggcacaagaaagcgacgtacgaacctgacgtcgatctcggctctgggaccagaaacattggaatcgagagcgagacacccaatcttgacattatcggcaagcgcatcgagaaaattaagcaggagcatgaaacctcctggcactatgatcaggaccatccgtacaagacatgggcctatcacggcagctacgagaccaaacaaacagggtctgcttccagcatggtgaacggagtggtccggctgctgaccaagccttgggacgttatccccatggtgacgcagatggccatgacagataccacccctttcggccagcagagagtgtttaaagaaaaggtcgacacacgcacgcaagagcccaaagaggggaccaagaagctcatgaaaattacagctgaatggctgtggaaggagcttggcaaaaagaaaacccctagaatgtgtacacgggaagagttcacccgcaaggtgagatctaatgccgctctgggcgccatctttacagatgagaacaaatggaagtccgcgcgggaagccgttgaggacagcgggttctgggaactcgtggataaggagagaaatctgcacctggaaggaaaatgcgagacctgtgtctataacatgatgggcaagcgggagaaaaagctcggcgaatttgggaaagctaagggatctcgcgccatttggtacatgtggctgggcgctagattccttgagtttgaagccctggggttcctcaatgaggaccattggttttcccgggaaaacagcctgtccggagtggagggcgaggggcttcacaagctgggctacatcctccgcgatgttagcaaaaaggaaggaggcgccatgtatgcggacgatacggctgggtgggacaccagaattacactggaggatctgaaaaatgaagagatggtgaccaaccatatggaaggagagcacaagaaactcgccgaggccatcttcaagctgacataccagaataaggtcgtgcgggttcagcgccccaccccgagaggcacggtgatggacatcatttctcggcgcgaccagagagggagcggacaagtcgtgacatatggccttaacaccttcacaaacatggaagctcagctgatccggcagatggagggggaaggcgtctttaaatccattcaacagctcaccgtgaaggaggagatcgccgttaaaaattggctgattcgcgtgggaagagaacggctttctcgcatggctatcagcggcgatgactgcgtcgtgaagcctctggatgacagattcgcctccgcgctcacggccctgaacgatatggggaaagtgcggaaggacatccagcagtgggagccctctagaggatggaatgattggacccaagttcccttttgcagccatcacttccacgaactgattatgaaggacggccgcgtgctcgtcgtgccttgtcggaaccaggatgagctgatcgggagagctcgcatttcccagggagccggctggtctcttcgggaaacagcttgcctggggaaaagctacgcccagatgtggtccctcatgtattttcatagacgcgacctgcggcttgcggccaatgctatctgtagcgccgttccgtctcactgggtgcccacctccagaacaacctggagcattcatgctacacacgagtggatgaccacggaggatatgctgacagtctggaaccgcgtgtggatccaagaaaatccttggatggaggacaagacccccgtcgaatcttgggaggaaatcccttacctcggcaaacgggaggatcagtggtgcggatccctgattggcctgaccagcagagccacatgggctaagaacatccagaccgccattaatcaggtgcgctccctcatcgggaacgaggaatatacagactacatgccctctatgaaacggttcagacgggaggaagaggaagcgggagttctgtggtga

SEQ ID NO: 20260 - RNA, 9876 nt, synthetic construct
  misc_feature 1..9876: note = derived and/or modified CDS sequence (opt5) from DENV-2__GU370051__SS-prME
  source 1..9876: mol_type = other RNA
accgccggaatcattatcatgatgattcccaccgtgatggctttccacctgacgacccggaacggggaacctcatatgatcgtcagccggcaggaaaagggaaaaagcctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctcgaaaatgcttggaaagtgagctgtacaacgctggccgttgtgtccgtcagccccctcctgcttacctcttcccagcaaaaggccgactggatccctctggctctcacaattaagggactgaaccccaccgccatctttctgacaacccttagcagaacgtctaaaaagcggtcctggccgctgaatgaggctattatggccgtgggcatggttagcatcctcgcgtcttccctgctcaaaaacgatattcctatgacagggcccctggtggccggaggccttctgaccgtctgctacgtgctgaccggccgcagcgctgacctcgaactggagagagccgctgacgtccggtgggaggaacaggccgagatctccgggagctctcctatccttagcattacaatctccgaagatggatctatgagcattaagaatgaggaggaagaacagaccctgacaatcctcattcgcacgggcctgctcgtgatctccgggctgttccccgtttctattccgatcaccgccgctgcgtggtatctttgggaagtgaaaaagcagagagccggagtcctgtgggacgtgccttctccccctcccgttggcaaagctgagctggaagatggggcctaccggatcaagcaaaagggcattctcggctattcccagatcggcgccggggtgtacaaagagggaacatttcacaccatgtggcatgtcacacgcggcgctgtgctgatgcacaaggggaaaagaattgagccctcctgggccgacgtgaagaaagatcttatcagctacggaggcgggtggaagctggaaggagagtggaaggaaggcgaggaagttcaggtcctcgcgctggagcctggcaaaaacccgcgggctgtgcagaccaagcccggactcttcaaaacgaacaccggaacaattggcgccgtgtccctggactttagccctgggacctctggatcccccatcgtcgataagaaaggcaaggtggttgggctttatggaaatggcgtggtcacaagaagcggcacctacgtgtctgccatcgctcaaacagagaagtccattgaagacaaccctgatatcgaggacgatattttccgcaaaaagcggctgacgatcatggacctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggatctcatgtgtcatgcgacgttcaccatgagactgcttagccccatccgggttcctaattataacctgattatcatggacgaggcccactttacagaccccgcttccattgccgctcgcggctacatctctaccagagtggaaatgggggaggccgccggcatcttcatgacagctaccccgcctggaagccgggatccctttccccagtccaatgcgcctattatggacgaggaacgcgagatccccgaaagaagctggaactctggccacgagtgggtcacggatttcaaggggaagacagtgtggtttgtgccttccattaaagccggaaatgacatcgctgcctgcctgcggaagaacggcaaaaaggtcattcagctcagcagaaaaaccttcgattctgaatatatcaagacccgcacaaatgactgggattttgttgtgaccacagacatcagcgagatgggggccaacttcaaggctgagcgggtgattgatccgagacgctgtatgaaacccgtcatcctgaccgacggagaagaacgggtgattcttgccggccctatgcccgttacgcattcctctgcggctcaaagacgcgggcgggtgggcagaaatcctaagaacgataatgaccagtacatctacatgggagaacccctggagaacgacgaagattgcgcccactggaaagaggccaagatgctcctggacaatattaacacaccggagggcatcatccctagcatgtttgaacccgagcgcgaaaaagtcgatgctattgacggggagtatagactgcggggagaagcccgcaagaccttcgtggatctcatgagacggggcgaccttcctgtttggctggcgtaccgcgtggccgctgaggggatcaactatgccgatagacggtggtgttttgacggagtcaaaaataaccagattctggaggaaaatgtggaggtcgaaatctggacaaaggagggcgagagaaagaaactcaagccccgctggctggatgctcggatttactccgaccctcttgccctgaaagagttcaaggagttcgctgccgggagaaaatctctcaccctgaacctgatcacggaaatgggccgcctccccacctttatgacacaaaaggcgaagaatgcccttgataacctggctgtgctgcataccgccgaggctggaggccgggcctataatcacgccctcagcgaactgccggagacacttgagaccctgctcctgctgacactccttgctaccgttacaggcgggattttcctgtttctgatgtccgggaaagggatcggaaagatgacactcggcatgtgctgcatcattaccgcgagcatcctgctttggtacgcccagattcagcctcactggatcgctgcctctattatcctggagttctttctcatcgtgctgctgattcccgagcccgaaaaacagagaacccctcaagacaaccagctcacatatgtggtcatcgccattcttaccgttgtggctgccacaatggcgaatgagatgggcttcctggaaaagacgaaaaaggattttgggctgggatccatcaccacacagcagccggagagcaacattctcgacatcgacctgcggcccgcctccgcttggaccctttacgccgtggctacaaccttcatcacgcctatgctgcgccattctattgagaatagctccgtcaacgtgtctctcaccgccatcgcgaatcaagccacagttctgatgggcctggggaagggatggcccctcagcaaaatggatattggcgtgcctcttctggctatcgggtgttactcccaggtcaaccccattaccctgacagccgctctcctgcttctggtggcccactatgctatcattggacctggcctccaggccaaggcgaccagagaagcccagaaacgggctgccgctggcatcatgaagaatccgacggtcgacgggatcacagtgattgatctggaccccatcccttacgatcccaaatttgagaagcaactgggacaggttatgctccttgtgctgtgcgtcacccaggtgctgatgatgcgcacaacctgggccctctgtgaagccctgacccttgcgacaggccctattagcacgctgtgggaggggaaccccggaagattctggaataccacaatcgctgtttctatggccaacatttttcggggctcctatctcgctggggccggactgctgttcagcatcatgaagaacaccgccaatacacgcagaggcaccggcaacacgggggaaacactcggagagaaatggaagaatcggcttaacgctctgggcaaatctgagtttcagatctacaagaaatccgggattcaagaagtggaccgcaccctggccaaggagggaatcaaaagaggcgaaaccgatcatcacgcggtcagccgggggtctgccaagctcagatggttcgtggagcgcaatctggtgacaccggagggaaaggttgtcgaccttggctgcggcagagggggatggagctattactgtggcgggctgaaaaacgtgaaggaagtgaaaggactcaccaagggcgggcctggacatgaggaacccattcccatgtccacatatggctggaatctggtcagactgcagtctggcgttgatgtgttctttacgcctcccgagaaatgcgacaccctcctttgtgatatcggggaaagctcccctaacccgacagtggaggctggacgcaccctgcgggtcctgaatctcgtggagaactggctgaataacaatacacagttctgcattaaggttcttaccccctacatgcctagcgtgatcgaaaagatggaggccctgcaaagaaaatacggcggggctctcgtccgcaaccccctgtccagaaattctacgcacgaaatgtattgggtgagcaacgcctccggaaacatcgtttctagcgtgaatatgatttccagaatgctgatcaaccgctttaccatgcggcacaagaaagcgacatacgagcctgacgtcgatctcggctctgggaccagaaatattggaatcgaaagcgagacacccaaccttgacattatcggcaagcgcatcggcaaaattaagcaggagcatgaaacctcctggcactatgaccaggatcatccgtacaagacatgggcctatcacgggagctacgagaccaaacagacgggatctgcttccagcatggtgaatggcgtggtccggctgctgacaaagccttgggacgttatccccatggtgacccaaatggccatgaccgatacaacgcctttcgggcagcagagagtgtttaaagaaaaggtcgacacccgcacacaggagcccaaagaaggaaccaagaagctcatgaaaattacagctgagtggctgtggaaggagcttggcaaaaagaaaacccctagaatgtgtacacgggaagagttcacccgcaaggtgagatctaacgccgctctgggggccatctttacggatgaaaataaatggaagtccgcgcgggaggccgttgaggacagcggattctgggaactcgtggataaggagagaaacctgcacctggaaggcaaatgcgagacctgtgtctataatatgatgggcaagcgggagaaaaagctcggggagtttggaaaagctaagggctctcgcgccatttggtacatgtggctgggggctagattccttgagtttgaagccctgggattcctcaacgaggaccattggttttcccgggaaaatagcctgtccggcgtggagggggaaggccttcacaagctgggatacatcctccgcgatgttagcaaaaaggagggcggggccatgtatgcggacgatacagctggatgggacaccagaattacactggaggacctgaaaaacgaagagatggtgaccaatcatatggaaggcgagcacaagaaactcgccgaagccatcttcaagctgacgtaccaaaacaaggtcgtgcgggttcagcgccccacaccgagagggaccgtgatggatatcatttctcggcgcgaccagagaggaagcggccaggtcgtgacatatgggcttaataccttcacgaacatggaggctcaactgatccggcagatggagggcgaaggagtctttaaatccattcagcaactcaccgtgaaggaggaaatcgccgttgagaactggctgatgcgcgtgggcagagagcggctttctcgcatggctattagcggggatgactgcgtcgtgaaacctctggatgacagattcgcctccgcgctcacagccctgaatgatatgggaaaggtgcggaaagacatccagcagtgggaaccctctagaggctggaacgattggacccaggttcccttttgcagccatcacttccacgagctgatcatgaaggacgggcgcgtgctcgtcgtgccttgtcggaatcaagatgaactgattggacgggctcgcatctcccagggcgccgggtggtctcttcgggagacagcttgcctgggcaagagctacgcccagatgtggtccctcatgtattttcatagacgcgacctgcggcttgcggccaacgctatttgtagcgccgttccgtctcactgggtgcccacctccagaacaacctggagcatccatgctacgcacgaatggatgacaaccgaggatatgctgaccgtctggaatcgcgtgtggattcaggagaacccttggatggaagacaaaacacccgtcgagtcttgggaagagatcccttacctcggaaagcgggaagaccaatggtgcggctccctgatcgggctgaccagcagagccacatgggctaaaaatattcagacggccatcaaccaggtgcgctccctcattggaaatgaggagtataccgattacatgccctctatgaagcggttcagacgggaagaggaagaggcgggcgttctgtggtga

SEQ ID NO: 20261 - RNA, 9876 nt, synthetic construct
  misc_feature 1..9876: note = derived and/or modified CDS sequence (opt5) from DENV-2__EU359009__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaagagcctgctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaagcgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccatcgcgccttccatgacgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcatcgaagctaaactgacgaacacaaccaccgcctctcggtgtccgacacagggggagccctccctcaatgaggaacaagataagcgctttgtgtgcaaacatagcatggtggacagaggatggggcaacggctgtgggctgttcggaaagggcgggattgtgacctgcgcgatgtttacatgcaagaaaaatatggagggaaagatcgttcagcctgaaaacctggagtatacgattgtgatcacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaaaacaaggcctggctcgtgcaccgccaatggtttctggatcttccgttcccttggctgcccggcgctgacacccaggggtccaactggatccagaaagagacactcgtcacctttaagaatcctcacgccaagaaacaggatgtggttgtgctgggaagccaagagggcgccatgcatacggctctgacaggggcgaccgaaattcagatgtcctctggcaacctcctgttcacaggacaccttaagtgcagactgcggatggacaaactccagctgaagggcatgagctattccatgtgtaccgggaaattcaaggtcgtgaaggagatcgccgaaacccaacatggaacaattgtcatcagagtgcagtacgagggcgacgggagcccctgcaaaatcccctttgagattatggatcttgaaaagcgccacgttctgggacggctcatcacggtgaatcctattgtcaccgagaaagactctccggtgaacatcgaagctgagccccctttcggcgattcctacattatcattggggttgaacccggccagctgaagctgagctggtttaaaaagggatctagcatcggccagatgttcgagacaaccatgagaggggccaagcgcatggccatcctcggagacacagcttgggattttggctccctcgggggagtgttcacctctattggcaaagcccttcatcaagtctttggggcgatctatggcgctgccttcagcggagtgtcctggacgatgaagattctgatcggcgtggttattacatggatcgggatgaatagccggtctacctccctcagcgtctctctggtgctggtgggagtcgtgaccctttacctcggcgttatggtgcaggccgactccgggtgtgtcgtgagctggaaaaacaaggagctgaaatgcggatccggcatctttattacagataatgttcacacctggacagaacagtataagttccagcctgagtctcccagcaagctggcttccgccatccaaaaagctcacgaagaggggatttgtggcatcagatctgtgacgcgcctcgaaaacctgatgtggaagcagattaccccggagcttaatcatatcctgagcgagaacgaagtcaaactcacaatcatgaccggagacattaagggcatcatgcaggccgggaaacggtccctgagacctcagcccacagagctgaagtacagctggaaagcgtggggaaaggccaagatgctttctaccgaactccacaatcatacgtttctgattgatggccctgagaccgctgaatgccccaacacaaatcgcgcctggaactccctggaggtggaggactatgggttcggagtttttaccacaaatatctggctcaaactgaaggaacggcaagatgtgttctgtgacagcaaacttatgtctgctgccattaaggacaacagagcggtccacgccgatatgggctactggatcgagtccgctctgaacgacacctggaaaatcgaaaaggccagcttcattgaggtgaagtcttgccactggcctaaaagccatacactctggtccaatggcgtgctggagagcgaaatgatcattcccaagaactttgctgggccggtctctcagcacaattatcgccctggataccatacccagacggccggcccctggcacctggggcggcttgagatggatttcgacttttgtgaaggaacaaccgttgtggtgaccgaggattgcggcaacagagggccctccctccggacaaccacggccagcggaaaactgatcacagaatggtgctgtcgctcctgcaccctgcctccgctcagataccggggcgaggacggctgttggtatgggatggagattagacccctgaaggaaaaagaggaaaatcttgtcaactctctggtgacagctggacatggccagatcgataatttcagcctcggggttctgggaatggcgctgtttcttgaggaaatgctccgcacccgggtgggcacaaagcacgccattctgctggtcgctgtgtccttcgttaccctcatcacggggaacatgtcttttagagacctgggacgcgtgatggtcatggtgggcgccaccatgacagatgacatcggcatgggggttacctaccttgccctgctcgctgccttcaaggtgagacctacatttgcggctggactgctgcttcggaaactgaccagcaaggagctcatgatgacgacaattggcatcgtcctgctctcccaatctaccattcccgagacaatcctggaacttaccgatgccctggccctcgggatgatggtgctgaaaattgtgcgcaatatggagaagtatcagctggctgtcaccatcatggccatcctttgcgttcctaacgcggtgattctgcagaatgcttggaaagtgagctgtacaacgctcgccgtcgtgtccgttagccccctgctcctgacctcttcccaacagaaggccgactggatccctcttgctctgacaattaagggactcaaccccaccgccatcttcctgacaaccctgagcagaacgtctaaaaagcggtcctggccgcttaatgaagctattatggccgtgggcatggtcagcatcctggcgtcttccctcctgaaaaacgatatccctatgacagggcccctcgtggccggaggcctgcttaccgtttgctacgtgctgaccggccgcagcgctgacctggagctcgaaagagccgctgacgtccggtgggaggagcaggccgaaatttccgggagctctcctatcctgagcattacaatctccgaggatggatctatgagcattaagaatgaagaggaggaacagacccttacaatcctgattcgcacgggcctcctggtgatctccgggctctttcccgtctctatcccgattaccgccgctgcgtggtatctgtgggaggtgaaaaagcaaagagccggagttctttgggacgtgccttctccccctcccgtcggcaaagctgaactggaggatggggcctaccggatcaagcagaagggcattctgggctattcccagatcggcgccggggtgtacaaagaaggaacattccacaccatgtggcatgttacacgcggcgctgtgctcatgcacaaggggaaaagaattgagccctcctgggccgacgtcaagaaagatctgatcagctacggaggcgggtggaaacttgagggagaatggaaggagggcgaagaggtccaggtgctggcgctcgaacctggcaaaaacccgcgggctgttcaaaccaagcccgggctgtttaaaacgaacaccggaacaatcggcgccgtctccctcgacttcagccctgggacctctggatcccccattgtggataagaaaggcaaggtggtcgggctgtatggaaatggcgtggttacaagaagcggcacctacgtgtctgccatcgctcagacagagaagtccattgaggacaaccctgaaatcgaggatgacattttccgcaaaaagcggcttacgatcatggatctgcatcccggggccggaaaaaccaagagatatctgcctgcgatcgtccgcgaagctattaaacggggcctcagaacactgatccttgccccgacccgcgtggttgccgctgagatggaagaggccctgcgggggctccccattagataccagacccctgctatccgcgccgagcacacaggacgggaaattgtggacctgatgtgtcatgcgacgtttaccatgagactcctgagccccatccgggtccctaattataaccttattatcatggatgaggcccacttcacagaccccgcttccatcgccgctcgcggctacatttctaccagagtggaaatgggggaggccgccggcatctttatgacagctaccccgcctggaagccgggaccccttcccccagtccaatgcgcctattatggatgaggaacgcgagatccccgaaagaagctggaactctggccacgagtgggttacggactttaaggggaagacagtgtggttcgtcccttccattaaagccggaaatgatatcgctgcctgcctgcggaagaacggcaaaaaggtgatccaactgagcagaaaaacctttgacaccgaatatattaagacacgcaccaatgattgggacttcgtggtcacaaccgatatctctgagatgggggccaactttaaggctgagcgggttattgacccgagacgctgtatgaaacccgtgatcctcacggatggagaggaacgggtgattctggccggccctatgcccgtcacacatagctccgcggctcagagacgcgggcgggtgggcagaaatcctaagaacgaaaatgaccagtacatctacatgggagagccccttgaaaacgatgaggactgcgcccactggaaagaggccaagatgctgctcgacaatatcaacaccccggaaggcattatcccttctatgttcgagcccgaacgcgagaaagttgatgctattgacggggaatatagactgcggggagaggcccgcaagacatttgtggatctgatgagacggggcgacctccctgtctggcttgcgtaccgcgtggccgctgaggggatcaactatgccgatagacggtggtgtttcgacggagttaaaaataaccaaattctggaagagaatgtggaagtcgagatctggaccaaggagggcgaaagaaagaaactgaagccccgctggctcgatgctcggatttacagcgaccctctggcccttaaagagttcaaggaatttgctgccgggagaaaatccctgacgctcaacctgatcaccgagatgggccgcctgcccacattcatgacccagaaggcgcggaatgccctcgataaccttgctgtgctgcatacagccgaagctggaggcagagcctataatcacgccctgtctgagctcccggagaccctggaaacacttctgctcctgaccctgctcgctacggtcacagggggaatctttcttttcctgatgagcggcaaggggattggaaaaatgaccctgggcatgtgctgcatcattaccgcgtccatcctcctgtggtacgcccagattcagcctcactggatcgctgccagcatcattcttgagtttttcctgatcgtgctcctgattcccgaacccgagaagcaacggacacctcaggacaaccagctgacctatgttgtgatcgccattctcacagtggtcgctgccacgatggcgaatgaaatgggctttcttgagaaaaccaagaaagatttcgggctgggatctatcacaacccagcaaccggagtccaacatcctggacattgatctccgccccgccagcgcttggacactgtacgccgttgctaccacgtttatcacccctatgcttagacattccattgaaaattctagcgtgaacgtgtccctgacagccatcgcgaatcaggccaccgtcctcatgggcctggggaagggatggcccctgtctaagatggacattggcgtgcctctccttgctatcgggtgttacagccaggttaaccccattacactgaccgccgctctgctcctgcttgtggcccactatgctatcatcggacctggcctgcaggccaaagcgacgcgggaggcccaaaagcgcgctgccgctggcattatgaaaaatccgacagtcgacgggatcaccgtgattgatctcgaccccatcccttacgatcccaagttcgaaaaacagctgggacaggtcatgctgctcgtgctttgcgttacacaggtgctgatgatgagaaccacctgggccctgtgtgaggccctcacactggcgacgggccctatttccaccctttgggaagggaaccccggacggttttggaatacaaccatcgctgtcagcatggccaacatcttccgcggctcttatctggctggggccggactcctgttttccattatgaagaacacagccaataccagacggggcacgggcaacacaggggagaccctgggagagaagtggaaaaatcgcctcaacgctcttggcaagagcgagttccaaatctacaaaaagtctgggattcaggaggtggacagaaccctggccaaagaaggaatcaagcggggcgagacagatcatcacgcggtttccagagggagcgccaaactgcgctggttcgtggagcggaatctcgtcaccccggaaggaaaggtggtggacctgggctgcggcagagggggatggtcttattactgtggcgggcttaagaacgttaaagaggtcaagggactgacaaaaggcgggcctggacatgaagaacccattcccatgagcacgtatggctggaatctcgtgcgcctgcagtccggcgtggatgtctttttcacccctcccgaaaagtgcgacacactgctctgtgatatcggggagtctagccctaacccgaccgttgaggctggacggacacttagagtgctgaatctggtggaaaactggctcaataacaatacccaattttgcatcaaagtcctgaacccctacatgccttccgtgattgagaagatggaagcccttcagcgcaagtacggcggggctctggttcggaatcccctcagcagaaactccacgcacgagatgtattgggtgtctaacgccagcggaaatatcgtctcctctgtgaacatgattagccgcatgctgatcaatcggttcaccatgagacacaaaaaggcgacatacgaacctgacgttgatctgggctccgggacccgcaacattggaatcgagtctgagacacccaatctcgacatcattggcaaacggatcgaaaagattaaacaggagcatgaaaccagctggcactatgatcaggaccatccgtacaagacatgggcctatcacggctcctacgagaccaagcaaacggggagcgcttcttccatggtgaacggagtcgtgagacttctgacaaaaccttgggacgtgatccccatggtcacccagatggccatgaccgatacaacgccttttggccagcagcgcgttttcaaggaaaaagtggacaccagaacacaagagcccaaggaggggaccaaaaagctgatgaagattacagctgaatggctctggaaagagctgggaaagaaaaagacccctcggatgtgtacacgcgaagagtttaccagaaaagtgcggagcaatgccgctcttggcgccatcttcacggatgagaacaagtggaaatctgcgagagaagccgtcgaggactccgggttttgggaactggtggataaggagcggaatctccacctggaaggaaagtgcgagacctgtgtttataacatgatgggcaaacgcgagaagaaactgggcgagttcgggaaggctaaaggaagcagagccatttggtacatgtggctcggcgctcggtttctggagttcgaagcccttgggtttctgaatgaggaccattggttctctcgcgaaaactccctcagcggagtggagggcgaggggctgcacaaacttggctacatcctgagagatgtctccaagaaagaaggaggcgccatgtatgcggacgatacagctgggtgggacacccggatcacactcgaggatctgaagaatgaagagatggtgaccaaccatatggaaggagagcacaaaaagctggccgaggccattttccgcctcacgtaccagaataaagttgtgagagtccagcggcccacaccgcgcggcaccgtgatggacatcattagcagacgggaccagcgcgggtctggacaagttgtgacatatggcctgaacacctttacgaacatggaagctcagcttatcagacagatggagggggaaggcgtcttcaagagcattcaacatctgaccgtgacagaggagatcgccgtcaagaattggctcgtgcgggttggacgcgaaagactgtcccggatggctatctctggcgatgactgcgtggtcaaacctcttgatgacagatttgccagcgcgctgaccgccctcaacgatatggggaaggtgcgcaaagacattcagcagtgggagccctcccggggatggaatgattggacacaggtgcccttctgctctcaccactttcatgaactgatcatgaaggacggcagagttctggtggtcccttgtcgcaaccaagatgagctcattgggcgggctagaatcagccagggagccggctggtccctgcgcgaaaccgcttgccttgggaaatcttacgcccagatgtggagcctgatgtatttccaccggagagacctccgcctggcggccaatgctatttgttccgccgtgccgagccattgggttcccacatctcggaccacgtggtccatccacgctacacacgagtggatgaccaccgaggatatgcttacagtgtggaacagagtctggatccaggaaaatccttggatggaggacaagacccccgtggaaagctgggaggaaattccttacctgggcaagcgcgaggatcaatggtgcggatctctcatcggcctgacatcccgggccacgtgggctaaaaacattcagaccgccatcaatcaggtcagaagcctgattgggaacgaggaatatacagactacatgccctccatgaagcggtttagacgcgaggaagaggaagcgggagtgctctggtga

SEQ ID NO: 20262 - RNA, 9876 nt, synthetic construct
  misc_feature 1..9876: note = derived and/or modified CDS sequence (opt5) from DENV-2__KC131142__SS-prME
  source 1..9876: mol_type = other RNA
accgccggaatcattatcatggtgattcccaccgtcatggctttccacctgacgacccggaacggggagcctcatatgatcgttagccggcaggaaaagggaaagagcctcctgtttaagacagagaatggacttaacatgtgcaccctgatggccatggacctcggggaactgtgtgaggataccattacctacaattgcccgcttctgcgccaaaacgaacccgaggacatcgattgttggtgcaattctaccagcacctgggtgacgtatggaacctgtacagcgaccggcgagcacagacgggaaaaacgctccgtggctctcgtccctcatgtggggatgggactggagacaagaaccgaaacgtggatgtctagcgagggcgcctggaagcacgcccagcggatcgagacatgggttctgcgccatcccggcttcaccattatggctgccatcctcgcttacacaattgggaccacctattttcagagagtgctgatcttcattcttctgacagccatcgcgccttccatgacgatgcggtgcattggaatctctaaccgcgactttgtcgaaggcgtgagcgggggatcctgggttgatatcgtgctcgagcacggcagctgtgtcaccacaatggccaaaaataagcccaccctggacttcgaacttattaagacagaggctaaacaccctgccaccctgagaaagtactgcatcgaagctaaactcacgaacacaaccaccgcctctcggtgtccgacacagggggagccctccctgaatgaggaacaagataagcgctttgtgtgcaaacatagcatggtggacagaggatggggcaacggctgtgggctgttcggaaagggcgggattgtgacctgcgcgatgtttacatgcaagaaaaatatggagggaaagatcgttcagcctgaaaacctcgagtatacgattgtgatcacaccccactctggcgaagagaatgccgtggggaacgatacaggaaaacatggcaaggagatcaaagtcacccctcagtccagcattacagaagctgagctgaccggctacgggacggtgaccatggaatgttctccccggacaggacttgacttcaatgagatggttctgctccagatggaaaacaaggcctggctggtgcaccgccaatggtttcttgatctgccgctcccttggctgcccggcgctgacacccaggggtccaactggatccagaaagagacactggtcaccttcaagaatcctcacgccaagaaacaggatgtggttgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgtcatcagagtgcagtacgagggcgacgggagcccctgcaaaatccccttcgagattatggatctcgaaaagcgccacgttctgggacggctgatcacggtgaatcctattgtcaccgagaaagactctccggtgaacatcgaagctgagcccccttttggcgattcctacattatcattggggttgaacccggccagctcaagctgagctggttcaaaaagggatctagcatcggccagatgtttgagacaaccatgagaggggccaagcgcatggccatccttggagacacagcttgggatttcggctccctcgggggagtgtttacctctattggcaaagccctccatcaagtcttcggggcgatctatggcgctgcctttagcggagtgtcctggacgatgaagattctgatcggcgtggttattacatggatcgggatgaatagccggtctacctccctgagcgtctctcttgtgctcgtgggagtcgtgaccctgtacctgggcgttatggtgcaggccgactccgggtgtgtcgtgagctggaaaaacaaggagctcaaatgcggatccggcatcttcattacagataatgttcacacctggacagaacagtataagtttcagcctgagtctcccagcaagctggcttccgccatccaaaaagctcacgaagaggggatttgtggcatcagatctgtgacgcgccttgaaaacctgatgtggaagcagattaccccggagctcaatcatatcctgagcgagaacgaagtcaaactgacaatcatgaccggagacattaagggcatcatgcaggccgggaaacggtcccttagacctcagcccacagagctcaagtacagctggaaagcgtggggaaaggccaagatgctgtctaccgaactgcacaatcatacgttcctcattgatggccctgagaccgctgaatgccccaacacaaatcgcgcctggaactccctggaggtggaggactatgggtttggagttttcaccacaaatatctggcttaaactgaaggaacggcaagatgtgttttgtgacagcaaactcatgtctgctgccattaaggacaacagagcggtccacgccgatatgggctactggatcgagtccgctctgaacgacacctggaaaatcgaaaaggccagcttcattgaggtgaagtcttgccactggcctaaaagccatacactgtggtccaatggcgtgcttgagagcgaaatgatcattcccaagaacttcgctgggccggtctctcagcacaattatcgccctggataccatacccagacggccggcccctggcacctcgggcggctggagatggattttgacttctgtgaaggaacaaccgttgtggtgaccgaggattgcggcaacagagggccctccctgcggacaaccacggccagcggaaaactcatcacagaatggtgctgtcgctcctgcaccctgcctccgcttagataccggggcgaggacggctgttggtatgggatggagattagacccctgaaggaaaaagaggaaaatctcgtcaactctctggtgacagctggacatggccagatcgataattttagcctgggggttcttggaatggcgctgttcctggaggaaatgctgcgcacccgggtgggcacaaagcacgccattctcctggtcgctgtgtcctttgttacccttatcacggggaacatgtctttcagagacctgggacgcgtgatggtcatggtgggcgccaccatgacagatgacatcggcatgggggttacctacctcgccctgctggctgcctttaaggtgagacctacattcgcggctggacttctgctccggaaactgaccagcaaggagctcatgatgacgacaattggcatcgtcctgctttcccaatctaccattcccgagacaatcctggaactcaccgatgccctggccctggggatgatggtgcttaaaattgtgcgcaatatggagaagtatcagctggctgtcaccatcatggccatcctctgcgttcctaacgcggtgattctgcagaatgcttggaaagtgagctgtacaacgctcgccgtcgtgtccgttagccccctgcttctgacctcttcccaacagaaggccgactggatccctctcgctctgacaattaagggactgaaccccaccgccatctttcttacaaccctgagcagaacgtctaaaaagcggtcctggccgctcaatgaagctattatggccgtgggcatggtcagcatcctggcgtcttccctcctgaaaaacgatatccctatgacagggccccttgtggccggaggcctgctgaccgtttgctacgtgctcaccggccgcagcgctgacctggagcttgaaagagccgctgacgtccggtgggaggagcaggccgaaatttccgggagctctcctatcctgagcattacaatctccgaggatggatctatgagcattaagaatgaagaggaggaacagaccctcacaatcctgattcgcacgggcctcctggtgatctccgggcttttccccgtctctatcccgattaccgccgctgcgtggtatctgtgggaggtgaaaaagcaaagagccggagttctgtgggacgtgccttctccccctcccgtcggcaaagctgaactcgaggatggggcctaccggatcaagcagaagggcattctgggctattcccagatcggcgccggggtgtacaaagaaggaacatttcacaccatgtggcatgttacacgcggcgctgtgcttatgcacaaggggaaaagaattgagccctcctgggccgacgtcaagaaagatctgatcagctacggaggcgggtggaagctcgagggagaatggaaggagggcgaagaggtccaggtgctggcgctcgaacctggcaaaaacccgcgggctgttcaaaccaagcccgggctgttcaaaacgaacaccggaacaatcggcgccgtctcccttgactttagccctgggacctctggatcccccattgtggataagaaaggcaaggtggtcgggctgtatggaaatggcgtggttacaagaagcggcacctacgtgtctgccatcgctcagacagagaagtccattgaggacaacctggaaatcgaggatgacattttccgcaaaaagcggctcacggtcatggatctgcatcctggggccggaaaaaccaagagatatcttcccgcgatcgtgcgcgaagctatcaaacggggcctgagaacactcattctggcccctacccgcgttgtggccgctgagatggaagaggccctccgggggctgccgatcagataccagacccccgctattcgcgccgagcacacaggacgggaaatcgtcgaccttatgtgtcatgcgacgttcaccatgagactgctgagccctattcgggtgcccaattataacctcatcattatggatgaggcccactttacagaccctgcttccatcgccgctcgcggctacatctctaccagagttgaaatgggggaggccgccggcattttcatgacagctacacccccgggaagccgggacccttttccccagtccaatgcgcccatcatggatgaggaacgcgagattcctgaaagaagctggaactctggccacgagtgggtgacggacttcaaggggaagacagtctggtttgtgccctccatcaaagccggaaatgatattgctgcctgcctgcggaagaacggcaaaaaggtgatccaacttagcagaaaaaccttcgacaccgaatatatcaagacacgcaccaatgattgggactttgtcgttacaaccgatatttctgagatgggggccaacttcaaggctgagcgggtgatcgaccctagacgctgtatgaaaccggtgattctgacggatggagaggaacgggtcatcctcgccggccccatgcctgtgacacatagctccgcggctcagagacgcgggcgggttggcagaaatcccaagaacgaaaatgaccagtacatttacatgggagagcctctggaaaacgatgaggactgcgcccactggaaagaggccaagatgctgctcgacaatatcaacacccccgaaggcatcattccgtctatgtttgagcctgaacgcgagaaagtggatgctatcgacggggaatatagacttcggggagaggcccgcaagacattcgtcgatctgatgagacggggcgacctgcccgtgtggctcgcgtaccgcgttgccgctgaggggattaactatgccgatagacggtggtgttttgacggagtgaaaaataaccaaatcctggaagagaatgtcgaagtggagatttggaccaaggagggcgaaagaaagaaacttaagcctcgctggctggatgctcggatctacagcgaccccctcgccctgaaagagttcaaggagttcgctgccgggagaaaatccctgacgctcaaccttattaccgagatgggccgcctgcctacatttatgacccagaaggcgcggaatgccctggataacctcgctgtcctgcatacagccgaagctggaggcagagcctataatcacgccctttctgagctgcccgagaccctcgaaacactgctgctccttaccctgctggctacggtgacagggggaatcttcctctttctgatgagcggcaaggggatcggaaaaatgacccttggcatgtgctgcattatcaccgcgtccattctgctctggtacgcccagatccagccgcactggattgctgccagcatcatcctggagttctttctgattgttctccttatccctgaacccgagaagcaacggacaccccaggacaaccagctgacctatgtggtgattgccatcctgacagtcgttgctgccacgatggcgaatgaaatgggcttcctcgagaaaaccaagaaagattttgggctgggatctattacaacccagcaacctgagtccaacatccttgacatcgatctgcgcccggccagcgcttggacactctacgccgtggctaccacgttcattacccccatgctgagacattccatcgaaaattctagcgtgaacgtctccctgacagccattgcgaatcaggccaccgtgctcatgggccttgggaagggatggcctctgtctaagatggacatcggcgttcccctgctcgctattgggtgttacagccaggtgaaccctatcacactgaccgccgcccttctgctcctggtcgcccactatgctattatcggacccggcctgcaggccaaagcgacgcgggaggcccaaaagcgcgctgccgctggcatcatgaaaaatcctacagtggacgggattaccgtcatcgatctcgacccgattccctacgatcctaagtttgaaaaacagcttggacaggtgatgctgctggttctctgcgtgacacaggtcctgatgatgagaaccacctgggccctttgtgaggccctgacactcgcgacgggccccatctccaccctgtgggaagggaaccctggacggttctggaatacaaccattgctgtgagcatggccaacatctttcgcggctcttatctggctggggccggactccttttctccatcatgaagaacacagccaataccagacggggcacgggcaacacaggggagaccctgggagagaagtggaaaaatcgcctgaacgctctcggcaagagcgaatttcaaatttacaaaaagtctgggatccaggaggttgacagaaccctggccaaagaaggaattaagcggggcgagacagatcatcacgcggtgtccagagggagcgccaaacttcgctggttcgtcgagcggaatctggtgacccccgaaggaaaggtggttgacctcggctgcggcagagggggatggtcttattactgtggcgggctgaagaacgtcaaagaggtgaagggactgacaaaaggcgggccgggacatgaagaacctatccccatgagcacgtatggctggaatctcgtgcgccttcagtccggcgtcgatgttttctttacaccccctgaaaagtgcgacacactgctgtgtgatattggggagtctagccccaaccctaccgtggaggctggacggacactcagagtgctgaatcttgtcgaaaactggctgaataacaatacccaattctgcatcaaagtgctcaacccgtacatgccctccgttatcgagaagatggaagccctgcagcgcaagtacggcggggctctggtgcggaatcctctcagcagaaactccacgcacgagatgtattgggtctctaacgccagcggaaatattgtgtcctctgttaacatgatcagccgcatgcttattaatcggtttaccatgagacacaaaaaggcgacatacgaacccgacgtggatctgggctccgggacccgcaacatcggaattgagtctgagacacctaatctggacatcatcggcaaacggattgaaaagatcaaacaggagcatgaaaccagctggcactatgatcaggaccatccctacaagacatgggcctatcacggctcctacgagaccaagcaaacggggagcgcttcttccatggtcaacggagtggtgaaactcctgacaaagccgtgggacgtcattcctatggttacccagatggccatgaccgatacaacgcccttcggccagcagagagtgtttaaagaaaaggtggacacccgcacacaagagcctaaagaggggaccaagaaacttatgaaaatcacagctgaatggctgtggaaggagctcggcaagaagaaaacccccagaatgtgtacacgggaagagttcacccgcaaggtcagaagcaatgccgctctgggcgccatttttacggatgagaacaaatggaagtctgcgagaggggctgtggaagactccggattctgggagctggttgataaggaaagaaatctccacctggagggcaaatgcgaaacctgtgtgtataacatgatgggcaagcgggagaagaaacttggggagtttggaaaagctaaaggcagccgcgccatctggtacatgtggctgggggctagattcctcgaatttgaggccctgggattccttaatgaagaccattggttttctcgggagaactccctgagcggcgtcgaaggggagggcctccacaagctgggatacattctgcgcgatgtgtccaaaaaggagggcggggccatgtatgcggacgatacagctggatgggacaccagaatcacactcgaagatctgaaaaatgaggaaatggttaccaaccatatggagggcgtgcacaagaaacttgccgaagccatcttccggctgacgtaccagaataaggtcgtgcgcgttcagagacctacaccccgggggaccgtgatggacattatcagccgcagagaccagcggggatctggccaagtcgtgacatatgggctcaacaccttcacgaacatggaggctcagctgattcgccagatggagggcgaaggagtctttaagagcatccaacatcttaccgtgacagaggaaattgccgttaaaaattggctggtgagagtcggccgggagcgcctctccagaatggctatctctggggatgactgcgtggtgaagccgctggatgaccggttcgccagcgcgctgaccgccctcaacgatatgggaaaagttagaaaggacatccagcagtgggagccttcccgcggctggaatgattggacacaggtgcccttttgctctcaccacttccatgaactgattatgaaagacgggcgggtccttgtggttccctgtagaaaccaagatgagctgatcggacgcgctcggattagccagggcgccgggtggtccctcagagaaaccgcttgcctgggcaagtcttacgcccagatgtggagccttatgtattttcaccgccgggacctgagactcgcggccaatgctatctgttccgccgtgcctagccattgggtcccgacatctcgcaccacgtggtccattcacgctacacacgagtggatgaccaccgaagatatgctgacagtgtggaaccgggtctggatccaggagaatccctggatggaggacaagacccctgtggaaagctgggaggaaatcccctacctgggaaaaagagaggatcaatggtgcggctctctcattgggctgacatcccgcgccacgtgggctaagaacatccagaccgccattaatcaggttcggagccttatcggaaacgaagagtatacagactacatgccttccatgaaaagattccggagagaggaagaggaagcgggcgtgctgtggtga

SEQ ID NO: 20263 - RNA, 9876 nt, synthetic construct
  misc_feature 1..9876: note = derived and/or modified CDS sequence (opt5) from DENV-2__AY858035__SS-prME
  source 1..9876: mol_type = other RNA
accgccggaatcattatcatgatgattcccacagtgatggctttccacctgacgaccagaaacggggagcctcatatgatcgtcagccggcaggaaaaggggaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcagcgagaacgaagtgaaactgacaatcatgaccggagacatcaagggcattatgcaggccgggaaacggtccctgagacctcagcccacagagcttaagtacagctggaaaacctggggaaaggcgaagatgctctctacggaactgcacaatcataccttcctgatcgatggccctgagacagccgaatgccccaacaccaatcgcgcttggaactccctcgaggttgaggactatgggtttggagtgttcacaaccaatatttggctgaaacttaaggaacggcaagatgtcttttgtgacagcaaactgatgtctgccgctatcaaggacaacagagccgtgcacgcggatatgggctactggattgagtccgccctcaacgacacatggaaaatcgaaaaggctagcttcatcgaggtgaagtcttgccactggcctaaaagccataccctgtggtccaatggcgtcctggagagcgaaatgattatccccaagaacttcgccgggccggtttctcagcacaattatcgccctggataccatacgcagacagctggcccctggcaccttgggcggctcgagatggattttgacttctgtgaaggaaccaccgtggtggtcacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtgaactctctcgttaccgccggacatggccagattgataattttagcctgggggtgctgggaatggctcttttcctcgaggaaatgctgcgcacacgggtcggcaccaagcacgcgatcctgctcgtggccgtttcctttgtgacgctgattaccgggaacatgtctttcagagaccttggacgcgtcatggtgatggttggcgctacaatgaccgatgacatcggcatgggggtgacatacctggccctcctggccgcttttaaggtcagacctaccttcgccgcgggactgcttctgcggaaactcacgagcaaggagctgatgatgacaaccatcggcattgtgctcctgtcccaatctacaatccccgagaccattcttgaactgaccgatgctctcgccctggggatgatggtgctgaaaatcgtccgcaatatggagaagtatcagcttgccgttacaattatggctatcctgtgcgtgcctaacgccgtgatcctccagaatgcgtggaaagtcagctgtacgaccctggctgtggtttccgtgagccccctcctgcttacatcttcccaacagaaggccgactggattcctctggccctcaccatcaagggactgaaccccacagctatttttctgaccacgcttagcagaacatctaaaaagcggtcctggccgctgaatgaagccatcatggctgtcggcatggtgagcattctcgcctcttccctgctcaaaaacgatatccctatgaccgggcccctggttgcgggaggccttctgaccgtgtgctacgtcctgacaggccgcagcgccgacctcgagctggaaagagctgccgacgtgcggtgggaggagcaggctgaaatctccgggagctctcctattcttagcatcaccatttccgaggatggatctatgagcatcaagaatgaagaggaggaacagacactgacgattctcatccgcaccggcctgctcgtcgtgtccgggctgttccccgtttctattccgatcacagccgccgcttggtatctttgggaggtgaaaaagcaaagagcgggagtcctgtgggacgtgccttctccccctcccgttggcaaagccgaactggaggatggggcttaccggatcaagcagaagggcattctcggctattcccagatcggcgccggggtgtacaaagaaggaacctttcacacaatgtggcatgtcacccgcggcgccgtgctgatgcacaaggggaaaagaattgagccctcctgggctgacgtgaagaaagatcttatcagctacggaggcgggtggaagctggagggagaatggaaggagggcgaagaggttcaggtcctcgccctggaacctggcaaaaacccgcgggcggtgcaaacgaagcccggactcttcaaaaccaacacaggaaccattggcgctgtgtccctggactttagccctgggacatctggatcccccatcgtcgataagaaaggcaaggtggttgggctttatggaaatggcgtggtcaccagaagcggcacatacgtgtctgccatcgcccagacggagaagtccattgaggacaaccctgaaatcgaggatgacattttccgcaaaaagcggctgaccatcatggatctgcatcccggggctggaaaaacaaagagatatctccctgccattgttcgcgaagcgatcaaacggggcctgagaacccttatcctggctccgacccgcgtggtcgccgccgagatggaagaggctctccgggggctgcccattagataccagacccctgccatccgcgctgagcacacgggacgggaaattgtggacctcatgtgtcatgccaccttcacaatgagactgcttagccccatccgggttcctaattataacctgattatcatggatgaggcgcactttaccgaccccgcctccattgctgcccgcggctacatctctacaagagtggaaatgggggaggctgccggcatcttcatgaccgccacgccgcctggaagccgggacccctttccccagtccaatgctcctattatggatgaggaacgcgagatccccgaaagaagctggaactctggccacgagtgggtcacagacttcaaggggaagaccgtgtggtttgtgccttccattaaagcgggaaatgatatcgccgcttgcctgcggaagaacggcaaaaaggtcattcaactcagcagaaaaaccttcgactctgaatatatcaagacacgcaccaatgattgggactttgttgtgacaaccgatatcagcgagatgggggccaacttcaaggccgagcgggtgattgacccgagacgctgtatgaaacccgtcatcctgacggatggagaagaacgggtgattcttgctggccctatgcccgttacacattcctctgccgcgcagagacgcgggcgggtgggcagaaatcctaagaacgaaaatgaccagtacatctacatgggagagcccctggaaaacgatgaggactgcgctcactggaaagaggccaagatgctcctggacaatattaacaccccggaaggcatcatccctagcatgtttgagcccgaacgcgagaaagtcgatgccattgacggggaatatagactgcggggagaggctcgcaagacattcgtggatctcatgagacggggcgaccttcctgtttggctggcctacaaagtggcggccgaggggatcaactatgctgatcgcagatggtgttttgacggagtcaagaataaccaaattctggaagagaatgtggaagtcgagatctggaccaaggagggcgaacggaaaaagctcaaacccagatggctggatgcccgcatttactccgaccctcttgctctgaaggagttcaaagagttcgccgctgggcggaagtctctcacgctgaacctgatcaccgagatgggcagactccccacatttatgacccagaaggcccgcaatgcgcttgataacctggccgtgctgcatacagctgaagccggaggccgggcttataatcacgccctcagcgagctgccggagacccttgaaacactgctcctgctgaccctccttgccacggttacagggggaattttcctgtttctgatgtccggcaaagggatcggaaagatgaccctcggcatgtgctgcatcattaccgctagcatcctgctttggtacgcgcagattcagcctcactggatcgccgcttctattatcctggagttctttctcatcgtgctgctgattcccgaacccgagaaacaaagaacacctcaggacaaccagctcacctatgtggtcatcgccattcttacagttgtggccgctacgatggccaatgaaatgggcttcctggagaagaccaaaaaggattttgggctgggatccatcacaacccagcaaccggagagcaacattctcgacatcgatctgcggcccgcgtccgcctggacactttacgctgtggccaccacgttcatcacccctatgctgcgccattctattgaaaatagctccgtcaacgtgtctctcacagctatcgccaatcaggcgaccgttctgatgggcctggggaagggatggcccctcagcaaaatggacattggcgtgcctcttctggccatcgggtgttactcccaggtcaaccccattacactgaccgctgccctcctgcttctggtggctcactatgccatcattggacctggcctccaggctaaggccacgagagaggcgcaaaaacgggccgctgccggcatcatgaagaatccgacagtcgacgggatcaccgtgattgatctggaccccatcccttacgatcccaaatttgaaaagcagctgggacaggttatgctccttgtgctgtgcgtcacacaggtgctgatgatgcgcaccacctgggctctctgtgaggccctgacacttgccacgggccctattagcaccctgtgggaagggaaccccggaagattctggaatacaaccatcgcggtttctatggctaacatttttcggggctcctatctcgccggggctggactgctgttcagcatcatgaagaacacagccaatacccgcagaggcacgggcaacacaggggagaccctcggagagaaatggaagaatcggcttaacaccctgggcaaatctgaatttcaaatctacaagaaatccgggattcaggaggtggaccgcacactggccaaggaaggaatcaaaagaggcgagaccgatcatcacgctgtcagccgggggtctgccaagctcagatggttcgtggagcgcaatctggtgacaccggaaggaaaggttgtcgaccttggctgcggcagaggcgggtggagctattactgtggagggctgaaaaacgtgaaggaggtgaaagggctcacgaagggcgggcctggacatgaagaacccattcccatgtccacctatggctggaatctggtcagactgcagtctggcgttgatgtgttctttacacctcccgaaaaatgcgacaccctcctttgtgatatcggggagagctcccctaacccgacagtggaggcgggacgcaccctgcgggtcctgaatctcgtggaaaactggctgaataacaatacgcaattctgcattaaggttcttaacccctacatgcctagcgtgatcgagaagatggaagccctgcagagaaaatacggcggggctctcgtccgcaatcccctgtcccggaactctacccacgagatgtattgggtgagcaacgcctccggaaatatcgtttctagcgtgaacatgatttccagaatgctgatcaatcgctttacaatgcggcacaagaaagctacctacgaacctgacgtcgatctcggctctgggacaagaaacattggaatcgagagcgagattcccaatcttgacatcatcggcaagcgcattgagaaaatcaagcaggagcatgaaacctcctggcactatgatcaggaccatccgtacaagacatgggcctatcacggcagctacgagaccaaacaaacggggtctgcgtccagcatggtgaacggagtggtccggctgctgacaaagccttgggacgttattcccatggtgacccagatggccatgaccgatacaacgcctttcggccagcagagagtgtttaaagaaaaggtcgacacccgcacacaagagcccaaagaggggaccaagaagctcatgaaaatcacagctgaatggctgtggaaggagcttggcaaaaagaaaaccagacggatgtgtacacgcgaagagttcaccagaaaggtgcggtctaatgccgctctgggcgccatttttacggatgagaacaaatggaagtccgctagagaagccgttgaggacagcgggttctgggaactcgtggataaggagcggaatctgcacctggaaggaaaatgcgagacctgtgtctataacatgatgggcaagcgcgagaaaaagctcggcgaatttgggaaagcgaagggatctagagccatctggtacatgtggctgggcgctcggttccttgagtttgaagccctggggttcctcaatgaggaccattggttttcccgcgaaaacagcctgtccggagtggagggcgaggggcttcacaagctgggctacattctcagagatgttagcaaaaaggaaggaggcgctatgtatgccgacgatacagccgggtgggacacccggatcacactggaggatctgaaaaatgaagagatggtgaccaaccatatggaaggagagcacaagaaactcgcggaggctatcttcaagctgacgtaccagaataaggtcgtgcgcgttcagagacctacaccccggggcaccgtgatggacattatctctcgcagagaccagcgggggagcggacaagtcgtgacatatggccttaacaccttcacgaacatggaagcccagctgattcgccagatggagggggaaggcgtctttaaatccatccaacagctcaccgtgacagaggagattgccgttaagaattggctggaaagagtgggacgggagcgcctttctagaatggctatcagcggcgatgactgcgtcgtgaaaccgctggatgaccggttcgcctccgctctcaccgccctgaacgatatggggaaggtgagaaaagacatccagcagtgggaaccttctcgcggatggaatgattggacacaagttcccttttgcagccatcacttccacgagctgattatgaaggacggccgggtgctcgtcgtgccctgtagaaaccaggatgaactgatcgggcgcgcgcggatttcccagggagccggctggtctcttagagagaccgcttgcctgggaaagagctacgcccagatgtggtccctcatgtattttcatcgccgggacctgagacttgctgccaatgcgatctgtagcgccgttccttctcactgggtgccgacatcccgcaccacgtggagcattcatgctacacacgagtggatgaccaccgaagatatgctgacagtctggaaccgggtgtggatccaagagaatccctggatggaagacaaaacccctgtcgagtcttgggaagagatcccctacctcggcaagagagaggatcagtggtgcggatccctgattggcctgacaagccgcgccacgtgggctaaaaacatccagaccgccattaatcaggtgcggtccctcatcgggaacgaagagtatacagactacatgccttctatgaagagattccggagagaagaggaagaggctggagttctgtggtga

SEQ ID NO: 20264 - RNA, 9873 nt, synthetic construct
  misc_feature 1..9873: note = derived and/or modified CDS sequence (opt5) from DENV-2__JX567951__SS-prME
  source 1..9873: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccaaatccagcctcactggattgcggcctctatcattcttgagttctttctgatcgtgctcctgattcccgaacccgagaaacagcggacccctcaggataaccaactgacatacgttgtgatcgctatcctcaccgtcgtggccgctacaatggccaatgaaatggggttccttgagaagacgaagaaagacctgggatttggctccattaccacacaggagagcgaatccaacatcctggacattgatctcagaccggcgtctgcctggaccctgtatgctgtcgccacaaccttcgtgacgcccatgcttcggcatagcatcgaaaatagctctgttaacgtgagcctgaccgctattgccaatcaggctacagtgctcatggggctgggaaagggctggcctctgtccaaaatggacatcggggtccccctccttgccattggatgttacagccaggttaaccctatcaccctgacagcggccctgctcctgcttgtggctcactacgccatcattggccccggcctgcaagctaaggccacccgcgaagcccagaaaagagcggctgccgggatcatgaagaatcctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctctacgctttgggagggaaaccctggccgcttctggaataccacaattgctgtctccatggccaacatctttagagggagctacctggcgggagccggcctcctgttctctattatgaagaataccacaaacacccggcgcggcacggggaatgtgggagaaacactgggcgagaaatggaagtccagactcaacgctcttgggaaaagcgaatttcagatctataagaaatctggcattcaggaggtcgaccggaccctggccaaggagggcatcaagcgcggggaaaccgatcatcacgctgtgagcagaggatccgccaaactgcggtggttcgttgagagaaacatggtgacacccgaaggcaaggtcgtggacctcggctgcgggcgcggaggctggtcttactattgtgggggactgaaaaatgttcgggaggtgaagggccttaccaaagggggaccgggccatgaggaacctatccccatgagcacatacggctggaacctggtcagactccaatccggggtggatgtgttctttacgccccctgagaagtgcgacaccctgctgtgtgatattggagaaagctcccccaatcctacaatcgaggcgggccgcaccctccgggttcttaacctggtcgaaaattggctgaacaataacacacagttctgcattaaggtgctcaatccgtatatgccctctgtgatcgagaaaatggaaaccctgcagagaaagtacgggggagcccttgtccgcaaccctctgagcagaaattccacgcacgagatgtactgggtttctaacgctaccggcaatattgtgagctccgtgaacatgatctctagaatgctcatcaatcgctttacaatgaaacacaagaaagccacctatgagcccgacgtcgatctggggagcggaacacggaacattggcatcgaatccgagattcctaacctggacatcattggcaagagaatcgaaaagattaaacaggagcatgaaaccagctggcactacgaccaagatcatccctataagacatgggcttaccacgggtcttatgagaccaaacagacgggatccgccagctctatggtgaatggcgttgtgcgcctccttacaaagccgtgggacgtcgtgcctatggttacccagatggctatgaccgatacaacgcccttcgggcagcaacgggtgtttaaagagaaggtcgacaccagaacacaggaacctaaggagggaaccaaaaagctgatgaaaatcacagccgaatggctgtggaaggagctcggcaaagagaagacaccccgcatgtgtacaagagaagagttcacccggaaagtgcgctccaacgcggccctgggggctgtgtttacggatgaaaataagtggaaaagcgccagagaggctgtcgaagacggacggttctgggagcttgttgatagagagcggaacctgcacctcgaaggcaaatgcgagacctgtgtgtacaatatgatgggcaagcgcgagaagaagctgggggagtttggaaaagccaagggctctagagccatctggtatatgtggctgggggcgcggttcctcgaatttgaggctctgggattccttaacgaggaccattggttttcccgcggcaatagcctgtccggggtggaaggcgagggactccacagactgggctacattcttcgggaagtcgggaagaaagagggaggcgccatgtacgccgatgacacagctgggtgggatacccgcatcacactggaagacctcaagaacgaggagatggtgaccaatcatatgaaaggagaacacaagaaactggccgaggctattttcaagctgacgtatcagaacaaggttgtgagagtccagcggcctacaccccgcggcaccgtgatggacatcattagcagaaaagatcaacgggggtctggccaggttggaacatacggcctcaataccttcacgaacatggaagcccagctgatccgccaaatggagggggagggaatctttaagagcattcagcatcttaccgcgacagaagagatcgccgtgcagaattggctggctagagtcggccgggaacgcctctccagaatggccatttctggggacgattgcgtggttaaaccgatcgacgatcggttcgctagcgccctgaccgcgcttaacgacatgggaaaggtgagaaaagatattcagcaatgggagccttcccgcggctggaatgactggacacaggtccccttttgctctcaccacttccatgaactggtgatgaaggatgggcgggtcctcgtggttccctgtagaaaccaggacgagctgatcggccgcgcccggatcagccagggagctggctggtccctgaaggagaccgcctgcctcgggaaatcttatgctcaaatgtggacactgatgtactttcacagacgcgatcttcggctggccgctaacgccatttgtagcgcggtgccttcccattgggtcccgaccagcagaacgacatggtctatccacgccaagcacgaatggatgaccaccgaggacatgctcgctgtgtggaatcgcgtgtggattcaggaaaacccctggatggaggataaaacacctgttgaatcctgggaggaggtgccctatctgggaaagcgggaagaccagtggtgcggcagccttatcgggctgacctctagagccacatgggccaaaaatattcagacggctatcaaccaagtccgctccctcattggaaatgagggctacaccgactatatgcctagcatgaagcggttcagacgggaagaggaagaggccggggtgctgtgg

SEQ ID NO: 20265 - RNA, 9873 nt, synthetic construct
  misc_feature 1..9873: note = derived and/or modified CDS sequence (opt5) from DENV-2__JX567950__SS-prME
  source 1..9873: mol_type = other RNA
accgccggcgtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagacccggacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcgaagagatcaaaatcacacctcagtcttccattaccgaagccgagcttacggggtatggaaccgtgacaatggaatgtagcccccggaccggcctggatttcaacgagatggttctcctgcagatggaggacaaggcttggcttgtgcaccgccaatggtttctggatctcccgctgccttggctgcccggggccgacacacagggatctaattggatccagaaagaaaccctcgtcacgttcaagaaccctcatgctaagaaacaggacgtggttgtgctgggctcccaagagggggccatgcacacagcccttaccggcgctacagaaattcagatgagctccggaaatctgctctttaccggccatctgaagtgcagacttcggatggataaactgcagctcaaggggatgtcttacagcatgtgtaccggaaaattcaagatcgtcaaggagattgcggagacacaacacggcacgatcgtgatcagagtccagtatgaaggggacggatccccctgcaaaattcccttcgagatcaccgatctggaaaagcgccatgtgctgggccggctcattacagttaaccctatcgtgaccgagaaagacagcccggtcaacattgaagccgagcccccttttggggattcttacatcattgtgggcgttgagcccggacagctgaaacttaattggttcaaaaagggctccagcatcgggcagatgtttgaaacaaccatgagaggagctaagcgcatggccatcctgggcgacacggcctgggatttcgggtctctcggaggcgtgtttacaagcattgggaaagctctgcaccaagtcttcggcgccatctacggagcggctttttccggcgtgtcttggaccatgaagattctgatcggggtgattatcacctggatcggaatgaacagccggtccacaagcctttctgtttccctcgtcctggtgggcgtggtcaccctgtatctcggggccatggtgcaggccgacagcggatgtattgtttcttggaaaaataaggagctgaaatgcggctccgggatcttcattacagataacgtgcacacgtggaccgaacagtacaagtttcagcctgagagcccctccaaacttgcttctgccatccaaaaagctcatgaagagggcatttgtggaatcagaagcgtcacacgcctggagaatctcatgtggaagcagatcaccccggaactgaaccacattctgtccgagaatgaagtgaaacttacaatcatgaccggcgacattaaggggatcatgcaggccggaaaacggtctctcagacctcagcccacggagctgaagtatagctggaaaacctggggcaaggcgaagatgctgtccacagaaagccataaccaaaccttcctcattgatgggcctgagacagccgagtgccccaataccaaccgcgcttggaactctctggaagttgaggactacggatttggcgtgttcacaaccaacatctggcttaaactgcgggaaaagcaggacgtcttttgtgattccaaactcatgagcgccgctatcaaggacaatagagccgtgcacgcggatatgggctattggattgagtctgccctgaacgacacgtggaaaatggagaaggcttccttcatcgaagttaagagctgccactggcctaaatctcatacactgtggagcaatggggtgcttgagtccgaaatgattatccccaagaacttcgccggaccggtcagccagcacaactaccgccctggctatcatacccagaccgctgggccctggcacctcggaaaactggagatggattttgacttctgtgaaggcacaaccgtggtggtcacggaggattgcgggaatcggggaccctctctgagaacaaccacagcctccggcaagctcattaccgagtggtgctgtcggagctgcacactgcctccgcttcgctacagaggcgaagacgggtgttggtacggaatggagatccggcccctgaaagaaaaggaggaaaacctcgttaattccctggtgaccgccggccatgggcaaattgataacttttctctgggagtgcttggcatggctctcttcctggaggagatgctgagaacgcgcgtcgggaccaagcacgcgatcctcctggtggcccttagctttgttacactgatcaccggaaatatgtccttccgggacctcggcagagtgatggtcatggtgggcgctacaatgaccgatgacattgggatgggagttacgtatctggccctgcttgccgcttttaaagtgcgccctacattcgccgcgggcctgctcctgagaaagctcacctctaaagaactgatgatggctacaatcgggattgcccttctgagccagtccaccctccccgagaccatcctggaactgacagatgcccttgctctgggaatgatggccctcaagattgtccggaacatggagaaataccagctggcggtgacgatcatggctatctcttgcgttcctaatgccgtgattctccaaaacgcctggaaggtcagctgtaccatcctggctgccgtgtccgtgagcccccttctgctcacatcttcccagcagaaggctgactggattcctctggccctgaccatcaaaggccttaatcccacagcgatttttctgaccacgctcagccgcacatctaagaaaagatcctggccgctgaacgaagccatcatggctgtcgggatggttagcatcctcgcctcttccctgcttaagaatgacattcctatgaccggacccctggtggctggcggcctgctcaccgtgtgctatgtcctgacagggcggagcgccgatcttgagctggagcgcgccgctgacgtgaaatgggaagatcaggcggagatctccggaagctctcctattctcagcgttaccatctccgaagacggctctatgagcattaagaacgaggaggaagaacaaacactgacgatcctcattagaaccgggctgcttgtgatctccggagtcttccccgtgtctatcccgattacagccgctgcctggtacctgtgggaagttaaaaagcagcgggccggcgtgctgtgggatgtcccttctccccctcccgtggggaaggctgagctcgaagacggagcctatcgcatcaaacagagaggcattctgggctactcccagatcggggcgggagtctataaggagggcacctttcacacaatgtggcatgtgaccagaggggctgttcttatgcaccgcggaaaaagaattgagccctcctgggccgatgtgaagaaagacctgatcagctacggcgggggatggaagctcgaaggcgagtggaaggaaggcgaggaagtccaagtgctggccctcgagcctgggaaaaatccgcgggctgttcagacgaagcccggaatcttcaaaaccaacacaggcaccattggggccgtgtccctggattttagccctggaacatctggctcccccatcgtcgacagaaaggggaaagtggtgggactttacggcaatggcgttgtcacccgcagcggggcgtatgtgtctgctattgcccagacagagaagtccatcgaagataaccctgagattgaagacgatatcttccggaagaaaagactgacgatcatggacctgcatcccggagccggcaagaccaaacgctacctccctgctattgtgcgggaggccatcaagagagggctgcgcacacttattctggctccgacccgggtcgtggccgcggaaatggaggaggccctcagaggactgcccatccgctatcagacccctgctattcgggccgaacacacaggcagagagatcgttgacctcatgtgtcatgctacgttcaccatgcggctgcttagccccgtgcgcgtccctaactacaatctgattatcatggatgaagcccacttttccgaccccgcctctatcgctgcgagagggtatattagcacacgggtggagatgggcgaggccgctggaatcttcatgaccgccacaccgcctggctcccgcgatccctttccccaaagcaacgcccctattatggacgaagagagagaaatccccgagcggtcttggaatagcgggcacgaatgggttaccgatttcaaaggaaagacggtgtggtttgtccctagcattaaggctggcaacgacatcgccgcgtgcctgcgcaagaatgggaagaaagtgatccagctctctcgcaagacattcgatagcgagtacgttaaaacccgggctaacgactgggattttgtggtcaccacagacatttccgagatgggagccaatttcaaggccgaaagagtgatcgatccgcgccggtgtatgaagcccgtgattctgaccgacggcgaggaaagagtcatccttgctgggcctatgcccgttacacattctagcgccgcgcagcgccggggcagaattggacgcaaccctaaaaatgagaacgaccaatatatctacatgggcgaacccctggagaatgatgaggactgcgcccactggaaggaagctaaaatgctcctggataacatcaataccccggaggggattatcccttccatgtttgaacccgagagagaaaaggtggacgccattgatggagagtaccggctgcgcggcgaggctagaaaaacgttcgtggacctcatgcggcgcggggatcttcctgtctggctggcctataaggtggctgccgaaggaatcaactacgcggacagaaaatggtgttttgatggcattaagaataaccagatcctggaggaaaacgttgaggtggagatttggacaaaggaaggggagcggaaaaagctcaaacccagatggctggacgcccgcatctattctgatcctcttgctctgaaggagttcaaagagttcgccgctggcagaaagagcctcaccctgaatctgatcacagaaatgggaagactccccacctttatgacgcagaaggcccgcaacgcccttgacaatctggctgtcctgcataccgcggaggtgggcgggaaagcctacacacacgctctcaacgagctgccggaaacccttgagacactgctcctgctgaccctccttgccgccgttacaggaggcattttcctgtttctgatgtccgggaagggaatcggcaaaatgaccctcggcatgtgctgcattatcacggctagcattctgctttggtatgcccagatccaacctcactggatcgcggcctctattatcctggagttctttctcattgtgctgctgatccccgagcccgaaaagcagcggacacctcaggataatcagctcacctacgtcgtgattgctatccttaccgtcgtggccgctacaatggccaacgagatggggttcctggagaaaaccaagaagtatctgggactcggctccatcacaacgcaagaaagcgagtccaatattctggacatcgaccttagaccggcgtctgcctggaccctgtacgctgttgccacaacctttgtgacacccatgctccggcatagcattgtgaactcctctgtcaatgttaccctgacggctatcgccaaccaggctaccgtgctgatggggctcggaaaaggctggcctcttagcaagatggatattggggtgcccctgctggccatcggatgttactcccaggtcaatcctattacactcaccgcggccctgcttctgctcgtggctcactatgccatcatcggccccggcctgcaggctaaagccacacgcgaagcccaaaagagagcggctgccgggattatgaaaaaccctaccgttgacggaatcacggtgattgatctggagccgatcccctacgaccctaagttcgaaaagcagctcggccaggtcatgcttctgattctgtgcgtgacacaggtcctcatgatgcggaccacatgggctctgtgtgaggcccttaccctggccaccgggcccatcagcacactctgggagggaaatcctggccgcttttggaacacgaccatcgctgtgtctatggccaatattttcagagggtcctatctggcgggagccggcctgctctttagcatcatgaaaaacacaaccaatacacggcgcggcaccgggaacgttggagaaacgcttggcgagaagtggaaatctagactgaacgctctggggaagaatgagttccaaatttacaaaaagtccggaatccaggaggtggatcggacactcgccaaagagggcattaagcgcggggaaaccgaccatcacgctgtcagcagaggatctgccaagctgcggtggtttgtggagagaaacatggttacccccgaaggcaaagtggtcgatcttggctgcgggcgcggaggctggagctattactgtgggggactgaagaatgtgcgggaggtgaaaggcctcacaaaagggggaccgggccatgaagaacctatccccatgtccacctatggctggaacctggttagactgcagtctggggtcgacgtgttcttcacaccccctgagaaatgcgatacgctcctttgtgacatcggagaaagctcccccaatcctaccattgaggcgggccgcacactgcgggtgctgaacctcgccgaaaattggctgaacaataacacccaattttgcatcaaggtccttaatccgtacatgcccagcgttattgagaagatggaaacactgcagagaaaatacgggggagctctcgtgcgcaaccctctgtccagaaattctacccacgagatgtattgggtgagcaacgccacgggcaatatcgtctcctctgtgaacatgattagcagaatgctgatcaaccgcttcaccatgaagcacaaaaaggctacatacgagcccgatgttgacctcgggtccggaacccggaatatcggcattgaatctgagatccctaaccttgatattatcggcaaaagaattgaaaagatcaagcaggagcatgaaacaagctggcactatgaccaggaccatccctacaaaacctgggcctatcacgggtcctacgagacaaagcaaaccggaagcgcttcttccatggtgaatggcgtcgtgcgcctgctgacgaaaccgtgggatgttgtgcctatggtcacacagatggccatgaccgacaccacaccctttgggcagcagcgggtgttcaaggagaaagtggatacgagaacccaagaacctaaggagggaacaaagaaactcatgaagattaccgcggaatggctgtggaaagagcttggcaaggagaaaacaccccgcatgtgtaccagagaagagtttacacggaaggtccgcagcaacgccgctctgggggccgttttcaccgacgaaaataaatggaagtctgctagagaggccgtggaagatggacggttttgggagctcgtggacagagagcggaacctgcacctggaaggcaagtgcgagacgtgtgtctataatatgatgggcaaacgcgaaaagaaactcggggagttcggaaaggccaaaggctccagagcgatctggtacatgtggctgggggctcggtttcttgagttcgaggccctgggatttctcaacgaggatcattggttcagccgcgaaaattctctgtccggcgtggagggggaaggccttcacagactgggatacatcctccgggacgttagcaagaaggagggcggggccatgtatgctgatgacaccgccggatgggatacacgcattaccctggaagacctgaaaaacgaggagatggtgacaaatcatatgaagggcgaacacaaaaagctcgctgaggccatctttaaactgacctaccagaacaaggtcgtgagagttcagcggcctacgccccgcgggacagtgatggacattatctccagacgggatcagcgcggaagcggccaagtcgggacctatggccttaatacattcaccaacatggaagcgcagctgattagacagatggagggagagggcatcttcaagtctatccaacatctcacggccaccgaagagattgctgtgcagaattggctggcccgggttgggcgcgaaagacttagccggatggctatctccggagacgattgcgtggtcaaaccgattgacgatagatttgcctctgcgctgacagccctcaacgacatgggcaaggtgcgcaaagatatccagcagtgggagcctagccgggggtggaacgactggacccaagtccccttctgctcccaccactttcatgaactggtgatgaaggatggaagagttctggtggtcccctgtcgcaatcaggacgagctcattggccgggctagaatctctcagggggccggctggagcctgaaagagacagcttgccttggaaagtcctacgcccagatgtggaccctgatgtatttccaccgccgggatctcagactggctgccaacgcgatctgttctgccgtgcctagccattgggtgccgacatcccgcaccacgtggagcattcacgctaagcacgaatggatgacaaccgaggacatgcttgccgtttggaatcgggtgtggatccaagaaaacccctggatggaggataaaacccctgtcgaatcttgggaggagattccctacctgggcaagagagaagaccagtggtgcgggtccctcatcggactgacaagccgcgccacctgggctaaaaatattcagacagccatcaaccaggtgcggtctctgattggcaatgaggggtatacggactacatgccttccatgaagagatttcggagagaagaggaagaggcgggagttctctgg

SEQ ID NO: 20266 - RNA, 9873 nt, synthetic construct
  misc_feature 1..9873: note = derived and/or modified CDS sequence (opt5) from DENV-2__HQ012538__SS-prME
  source 1..9873: mol_type = other RNA
accgcgggagtgatcattatgctgatccccaccgctatggccttccacctcacgaccagaaatggggaacctcatatgattgtgggacggcaggaaaagggcaagagcctgctttttaagaccgaagacggggttaatatgtgcaccctgatggcgatcgatctcggagaactgtgtgaggacaccattacctacaagtgcccgcttctgagacaaaatgaacccgaggatatcgactgttggtgcaattccacctctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcgaagagatcaaaattacccctcagtcttccatcacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggattcagaaagagacactcgtgaccttcaagaaccctcatgccaagaaacaggacgtcgtggttctgggctcccaagaaggggccatgcacacggctcttacaggcgcgaccgagatccagatgagctccggaaatctgctctttacaggccatctgaagtgcagacttcggatggacaaactgcagctcaaggggatgtcttacagcatgtgtaccggaaaattcaagattgtgaaggagatcgccgaaacccaacacggcacaatcgtcattagagtgcagtatgagggggatggatccccctgcaaaatccccttcgaaattatggacctggagaagcgccatgtcctgggccggctcatcacggtgaaccctattgttaccgaaaaagatagcccggtgaacatcgaggctgagcccccttttggggactcttacattatcatcggcgtcgaacccggacagctgaaacttaattggttcaaaaagggctccagcattgggcagatgtttgagacaaccatgagaggagccaagcgcatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaaaaataaggaactgaaatgcggctccgggattttcatcacagacaacgttcacacctggacagagcagtacaagtttcagcctgaaagcccctccaaacttgcctctgctattcaaaaagcccatgaggagggcatctgtggaatcagaagcgtgacgcgcctggaaaatctcatgtggaagcagattaccccggagctgaaccacatcctgtccgaaaatgaggtcaaacttacaattatgaccggcgatatcaaggggattatgcaggcgggaaaacggtctctcagacctcagcccacagaactgaagtatagctggaaaacctggggcaaggccaagatgctgtccacggagagccataaccaaaccttcctcatcgacgggcctgagacagctgaatgccccaataccaaccgcgcctggaactctctggaggtggaagattacggatttggcgttttcacaaccaacatctggcttaaactgcgggagaagcaggacgtgttttgtgactccaaactcatgagcgctgccattaaggataatagagcggtccacgccgacatgggctattggatcgagtctgctctgaacgatacatggaaaatggaaaaggcctccttcattgaggtcaagagctgccactggcctaaatctcataccctgtggagcaatggggttcttgaatccgagatgatcattcccaagaacttcgctggaccggtgagccagcacaactaccgccctggctatcatacgcagacagccgggccctggcacctcggaaaactggaaatggactttgatttctgtgagggcaccaccgtcgtggtgacagaggactgcgggaatcggggaccctctctgagaaccacgacagcctccggcaagctcatcaccgaatggtgctgtcggagctgcacactgcctccgcttcgctacagaggcgaggatgggtgttggtacggaatggaaattcggcccctgaaagagaaggaagagaacctcgtcaattccctggttaccgctggccatgggcaaatcgacaacttttctctgggagtgcttggcatggccctcttcctggaggaaatgctgagaacacgcgtggggaccaagcacgccatcctcctggtcgctgtgagctttgttacgcttattaccggaaatatgtccttccgggatctgggcagagtgatggtcatggtgggcgttacaatgaccgacgatatcgggatgggagtgacatatctcgccctgctggccgcttttaaagtccgccctaccttcgccgcgggccttctgctcagaaagctgacgtctaaagagctcatgatggctacaattgggatcgccctgcttagccagtccaccattcccgaaacaatcctggagctcaccgacgccctggctctgggaatgatggtgcttaagatcgttcggaacatggaaaaataccagctggccgtgaccattatggcgatctcttgcgtccctaatgctgtgattctcctgaacgcctggaaggtgagctgtacaatcctcgccgctgtctccgttagccccctgcttctgacgtcttcccaacagaagaccgattggattcctctcgccctgacaatcaaaggcctgaatcccaccgctatctttcttacaaccctgagccgcacgtctaagaaaagatcctggccgctcaacgaggccgtgatggcggtggggatggtcagcattctggcctcttccctcctgaagaatgacatccctatgacaggaccccttgtggctggcggcctgctgaccgtttgctatgtgctcaccgggcggagcgccgacctggagcttgaacgcgctgccgatgtcaaatgggaggaccaggccgaaatttccggaagctctcctatcctgagcattacaatctccgaggatggctctatgagcattaagaacgaggaagaggaacagaccctcacaatcctgatcagaacggggctcctggtgatttccggagttttccccgtgtctatcccgattaccgctgcggcctggtacctttgggaggtcaaaaagcaacgggctggcgtgctgtgggacgtcccttctccccctcccgtggaaaaggccgagctggaggatggggcctatcgcatcaaacagagaggcattctcggctactcccagatcggcgctggggtttataaggaaggaacatttcacaccatgtggcatgtgacacggggcgccgtcctgatgcaccgcgggaaaagaatcgagccctcctgggcggacgtgaagaaagatcttattagctacggaggcgggtggaagctggaaggagagtggaaggaaggcgaggaggttcaggtgctcgctctggaacctggcaaaaatccgcgggccgtccaaaccaagcccggactcttcaaaacgaacaccggaacaatcggcgccgtgtccctggactttagccctgggacctctggatcccccattgtggatagaaagggcaaagttgtcgggctttacggaaatggcgtggtgacacgcagcggcgcttatgtctctgccatcgcgcagaccgagaagtccattgaagacaaccctgagatcgaagatgacatcttccggaagaaaagactgacaattatggatctgcatcccggggctggaaagacgaaacgctacctccctgccatcgtgcgggaggccattaagagaggcctgcgcacccttatcctggctccgacacgggttgtggccgctgagatggaagaggccctcagagggctgcccattcgctatcagacccctgcgatccgggccgaacacaccggaagagagattgtcgacctcatgtgtcatgctacattcacgatgcggctgcttagccccgtgcgcgttcctaactacaatctgatcatcatggacgaggcccactttaccgatcccgcttccattgccgccagaggctatatctctacacgggtggaaatgggggaggctgcgggcattttcatgaccgccacaccgcctggaagccgcgacccctttccccagtccaacgctcctatcatggatgaagagagagaaattcccgagcggagctggaactctggccacgagtgggtcaccgacttcaaagggaagacggtgtggtttgttccttccatcaaggccggaaacgatatcgccgcttgcctgcgcaagaatggcaagaaagtgattcaactcagccgcaagacattcgactctgaatacgtcaaaacccgggccaacgattgggactttgtggtgaccacagatatcagcgagatgggggcgaatttcagagctgaacgcgtcattgacccgcggagatgtatgaagcccgttatcctgaccgatggagaggaacgcgtgattcttgccggccctatgcccgtgacacattcctctgccgctcagcggagagggcgcatcggcagaaaccctaagaatgagaacgaccagtatatctacatgggagagcccctggaaaatgacgaggattgcgcccactggaaagaagcgaagatgctcctggacaacattaataccccggagggcatcattcctagcatgtttgaacccgagcgggagaaagtcgatgccatcgacggggaataccgcctgagaggagaggctcggaagacgttcgtggatctcatgcgcagaggcgaccttcctgtttggctggcctatcgggtggctgccgaagggattaactacgctgatagacgctggtgttttgacggaatcaaaaataaccaaattctggaggagaacgtcgaagtggagatctggacaaaggaaggcgagcggaaaaagctcaagcccagatggctggatgcccgcatctattccgaccctcttgcgctgaaagagttcaaggagttcgccgctgggcggaaatctctcaccctgaatctgattacagagatgggcagactccccacctttatgacgcagaaggcccgggatgctcttgacaacctggccgttctgcataccgccgaagctggaggccgcgcgtacaatcacgccctcagcgagctgccggaaacacttgagaccctgctcctgctgacactccttgctaccgtgacagggggaatcttcctgtttctgatgtccggcaaagggattggaaagatgaccctcggcatgtgctgcatcattacggccagcatcctgctttggtatgcccagatccagcctcactggattgctgcctctatcattctggagttctttctcatcgtcctgctgattcccgagcccgagaagcaaagaacacctcaggataaccagctcacctacgtggtcatcgcgatccttaccgtggttgccgctacaatggccaatgaaatgggcttcctggagaaaaccaagaaagacctggggctcggatccattacaacgcaggaaagcgagtccaacatcctggacattgatcttcggccggcttctgcctggaccctgtatgcggtggccacaacctttgtgacacccatgctccgccatagcatcgaaaattcctctgtcaacgttagcctgaccgctattgccaatcaagctacggtgctgatgggcctcgggaagggatggcctctttccaaaatggacatcggcgtgcccctgctggccattgggtgttacagccaggtcaaccctatcaccctcacagctgccctgcttctgctcgtggcgcactacgccatcattggacccggcctgcaggctaaggccaccagagaggctcagaagcgggccgccgcgggcatcatgaaaaatcctacagttgatgggattaccgtgatcgacctggagccgattccctatgatcctaagttcgaaaaacaactcggacaggtcatgcttctgatcctgtgcgtgacgcaggtcctcatgatgcgcacaacctgggctctgtgtgaggcccttacactggctaccggccccatctctaccctctgggaagggaaccctggaagattttggaatacaacgattgccgtgtccatggccaacatcttccggggcagctacctggctggggccggactgctcttttctattatgaagaataccacaaacacccgcagaggcacaggcaatatcggggagacccttggagagaaatggaagtcccggctgaacgcgctgggcaagagcgagttccagatttataaaaagtctgggatccaagaggttgacagaacgctcgccaaagaaggaatcaagcgcggcgagacagatcatcacgctgtgagccgggggtccgccaaactgagatggtttgtcgaacgcaacatggtgacccccgagggaaaggttgtggaccttggctgcggcagagggggatggtcttactattgtggcgggctgaaaaatgtccgggaggtgaagggactcaccaagggcgggccgggacatgaagaacctattcccatgagcacatacggctggaacctggtgcgcctgcagtccggcgttgatgtcttcttcacaccccctgaaaaatgcgacacactcctttgtgatatcggggagagctcccccaatcctacgattgaagctggacggaccctgagagtgctgaacctcgtggagaattggctgaacaataacacacagttttgcatcaaggtccttaatccgtatatgccctctgttattgagaaaatggaaaccctgcaacgcaagtacggcggggccctcgtgcggaaccctctgagcagaaattccacacacgagatgtactgggtgtctaacgcgaccggaaatatcgtcagctccgtgaacatgatctctcgcatgctgattaatcggttcacgatgaaacacaagaaggccacctatgaacccgacgttgatctcggcagcgggacaagaaacatcggaattgagtccgaaatccctaaccttgacattatcggcaaacgcattgagaagatcaaacaggagcatgaaaccagctggcactacgaccaggatcatccctataagacatgggcttaccacggctcttatgagaccaaacagacagggtccgccagctctatggtgaatggagtcgtgagactgctgaccaagccgtgggacgttgtgcctatggtcacgcaaatggctatgacagataccaccccctttggccagcagcgggtgttcaaggaaaaagtggacacacgcacgcaggagcctaaggaggggaccaaaaagctcatgagaatcacagccgaatggctgtggaaagagcttggaaagaagaaaacaccccggatgtgtacaagagaagagtttacccggaaggtccgctccaacgctgccctgggcgcgattttcacagatgaaaataaatggaaaagcgccagagaggctgttgaggactctcggttttgggaactcgtggatcgcgagagaaacctgcacctggaagggaaatgcgagacctgtgtgtacaatatgatgggaaagcgggagaagaagctcggcgagttcggcaaggccaaagggtcccgcgctatctggtatatgtggctgggagccagatttcttgagttcgaagccctgggctttctcaacgaggaccattggttcagccgggggaatagcctgagcggagtcgaaggcgaggggcttcaccgcctgggctacattctcagagatgtgtctaagaaagaaggaggcgcgatgtacgctgacgatacggccgggtgggacacccggatcacactggaggacctgaagaacgaggaaatggttaccaatcatatgaaaggagagcacaagaagctcgccgaagctatttttaaactgacatatcaaaacaaggtggtccgcgtgcagagacctacaccccggggcacggttatggatatcatcagccgcagagaccagcgggggtccggacaggtgggcacatacgggcttaataccttcacaaacatggaggcccaactgattagacagatggagggcgaaggaatcttcaaatctattcagcatctcaccgtcacggaggaaatcgctgtgcaaaattggctggcccgcgttggccgggagagacttagccgcatggcgatttccggggatgactgcgtggtcaagccgctggatgaccggtttgcctctgctctcaccgccctgaacgatatgggaaaagtgagaaaggacatccagcagtgggaacctagccgcggctggaatgattggacacaggtccccttctgctcccaccactttcatgagctggtgatgaaggacgggcgggttctcgtggtcccctgtagaaaccaagatgagctgatcggacgcgctcggatttctcagggcgccgggtggagccttaaagaaaccgcgtgcctgggcaagtcctatgcccagatgtggacactcatgtacttccacagacgcgacctgcggcttgctgccaacgctatctgtagcgccgtgccttctcattgggtgccgacctccagaacaacctggagcattcacgctaaacacgagtggatgacgacagaagatatgctggccgtttggaatcgggtgtggatccaggagaacccctggatggaagacaagacccctgtcgagtcttgggaggaagtgccctatctcggaaaaagagaggaccaatggtgcggctccctgattgggctgaccagccgcgcgacatgggccaagaatatccagaccgctattaaccaggttcggtccctcatcggaaatgaagagtacacagattatatgccttctatgaagagatttcgcagagaagaggaggaagccggcgtgctgtgg

SEQ ID NO: 20267 - RNA, 9873 nt, synthetic construct
  misc_feature 1..9873: note = derived and/or modified CDS sequence (opt5) from DENV-2__HQ012533__SS-prME
  source 1..9873: mol_type = other RNA
accgccggcgtgatcattatgctgatccccaccgctatggccttccacctcacgacccggaatggggagcctcatatgattgtgggacggcaggaaaagggcaagagcctgctttttaagaccgaggacggggttaatatgtgcaccctgatggcgatcgatctcggagaactgtgtgaggacaccattacctacaagtgcccgcttctgcgccaaaatgaacccgaggatatcgactgttggtgcaattccacctctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaagacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcgaagagatcaaaattacccctcagtcttccatcacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggattcagaaagagacactcgtgaccttcaagaaccctcatgccaagaaacaggacgtcgtggttctgggctcccaagaaggggccatgcacacggctcttacaggcgcgaccgagatccagatgagctccggaaatctgctctttacaggccatctgaagtgcagacttcggatggacaaactgcagctcaaggggatgtcttacagcatgtgtaccggaaaattcaagattgtgaaggagatcgccgaaacccaacacggcacaatcgtcattagagtgcagtatgagggggatggatccccctgcaaaatccccttcgaaattatggacctggagaagcgccatgtcctgggccggctcatcacggtgaaccctattgttaccgaaaaagatagcccggtgaacatcgaggctgagcccccttttggggactcttacattatcatcggcgtcgaacccggacagctgaaacttaattggttcaaaaagggctccagcattgggcagatgtttgagacaaccatgagaggagccaagcgcatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaaaaataaggaactgaaatgcggctccgggattttcatcacagacaacgttcacacctggacagagcagtacaagtttcagcctgaaagcccctccaaacttgcctctgctattcaaaaagcccatgaggagggcatctgtggaatcagaagcgtgacgcgcctggaaaatctcatgtggaagcagattaccccggagctgaaccacatcctgtccgaaaatgaggtcaaacttacaattatgaccggcgatatcaaggggattatgcaggcgggaaaacggtctctcagacctcagcccacagaactgaagtatagctggaaaacctggggcaaggccaagatgctgtccacggagagccataaccaaaccttcctcatcgacgggcctgagacagctgaatgccccaataccaaccgcgcctggaactctctggaggtggaagattacggatttggcgttttcacaaccaacatctggcttaaactgcgggagaagcaggacgtgttttgtgactccaaactcatgagcgctgccattaaggataatagagcggtccacgccgacatgggctattggatcgagtctgctctgaacgatacatggaaaatggaaaaggcctccttcattgaggtcaagagctgccactggcctaaatctcataccctgtggagcaatggggttcttgaatccgagatgatcattcccaagaacttcgctggaccggtgagccagcacaactaccgccctggctatcatacgcagacagccgggccctggcacctcggaaaactggaaatggactttgatttctgtgagggcaccaccgtcgtggtgacagaggactgcgggaatcggggaccctctctgagaaccacgacagcctccggcaagctcatcaccgaatggtgctgtcggagctgcacactgcctccgcttcgctacagaggcgaggatgggtgttggtacggaatggaaattcggcccctgaaagagaaggaagagaacctcgtcaattccctggttaccgctggccatgggcaaatcgacaacttttctctgggagtgcttggcatggccctcttcctggaggaaatgctgagaacacgcgtggggaccaagcacgccatcctcctggtcgctgtgagctttgttacgcttattaccggaaatatgtccttccgggatctgggcagagtgatggtcatggtgggcgttacaatgaccgacgatatcgggatgggagtgacatatctcgccctgctggccgcttttaaagtccgccctaccttcgccgcgggccttctgctcagaaagctgacgtctaaagagctcatgatggctacaattgggatcgccctgcttagccagtccaccattcccgaaacaatcctggagctcaccgacgccctggctctgggaatgatggtgcttaagatcgttcggaacatggaaaaataccagctggccgtgaccattatggcgatctcttgcgtccctaatgctgtgattctcctgaacgcctggaaggtgagctgtacaatcctcgccgctgtctccgttagccccctgcttctgacgtcttcccaacagaagaccgattggattcctctcgccctgacaatcaaaggcctgaatcccaccgctatctttcttacaaccctgagccgcacgtctaagaaaagatcctggccgctcaacgaggccgtgatggcggtggggatggtcagcattctggcctcttccctcctgaagaatgacatccctatgacaggaccccttgtggctggcggcctgctgaccgtttgctatgtgctcaccgggcggagcgccgacctggagcttgaacgcgctgccgatgtcaaatgggaggaccaggccgaaatttccggaagctctcctatcctgagcattacaatctccgaggatggctctatgagcattaagaacgaggaagaggaacagaccctcacaatcctgatcagaacggggctcctggtgatttccggagttttccccgtgtctatcccgattaccgctgcggcctggtacctttgggaggtcaaaaagcaacgggctggcgtgctgtgggacgtcccttctccccctcccgtggggaaggccgaactggaggatggagcctatcgcatcaaacagagaggcattctcggctactcccagatcggggctggagtttataaggagggcacatttcacaccatgtggcatgtgacaagaggggcggtcctgatgcaccgcggaaaaagaatcgaaccctcctgggcggacgtgaagaaagatcttattagctacggcgggggatggaagctggagggcgaatggaaggagggcgaagaggttcaggtgctcgctctggagcctgggaaaaatccgcgggccgtccaaaccaagcccggactcttcaaaacgaacaccggcacaatcggggccgtgtccctggactttagccctggaacctctggctcccccattgtggatagaaaggggaaagttgtcggactttacggcaatggcgtggtgacacgcagcggggcttatgtctctgccatcgcgcagaccgaaaagtccattgaggacaaccctgaaatcgaggatgacatcttccggaagaaaagactgacaattatggatctgcatcccggagctggcaagacgaaacgctacctccctgccatcgtgcgggaagccattaagagagggctgcgcacccttatcctggctccgacacgggttgtggccgctgagatggaggaagccctcagaggactgcccattcgctatcagacccctgcgatccgggccgagcacaccggcagagaaattgtcgacctcatgtgtcatgctacattcacgatgcggctgcttagccccgtgcgcgttcctaactacaatctgatcatcatggacgaggcccactttaccgatcccgcttccattgccgccagagggtatatctctacacgggtggagatgggcgaagctgcgggaattttcatgaccgccacaccgcctggcagccgcgacccctttccccagtccaacgctcctatcatggatgaggaaagagagattcccgaacggagctggaactctgggcacgagtgggtcaccgacttcaaaggaaagacggtgtggtttgttccttccatcaaggccggcaacgatatcgccgcttgcctgcgcaagaatgggaagaaagtgattcaactcagccgcaagacattcgactctgagtacgtcaaaacccgggccaacgattgggactttgtggtgaccacagatatcagcgaaatgggagcgaatttcagagctgagcgcgtcattgacccgcggagatgtatgaagcccgttatcctgaccgatggcgaagaaagagtgattcttgccgggcctatgcccgtgacacattcctctgccgctcagcggagaggccgcatcggaagaaaccctaagaatgaaaacgaccagtatatctacatgggcgagcccctggagaatgacgaagattgcgcccactggaaagaggcgaagatgctcctggacaacattaataccccggaagggatcattcctagcatgtttgagcccgaacgggagaaagtcgatgccatcgacggagagtaccgcctgagaggcgaagctcggaagacgttcgtggatctcatgcgcagaggggaccttcctgtttggctggcctatcgggtggctgccgagggaattaactacgctgatagacgctggtgttttgacggcatcaaaaataaccaaattctggaagagaacgtcgaggtggaaatctggacaaaggagggggaacggaaaaagctcaagcccagatggctggatgcccgcatctattccgaccctcttgcgctgaaagagttcaaggagttcgccgctggccggaaatctctcaccctgaatctgattacagagatgggaagactccccacctttatgacgcagaaggcccgggatgctcttgacaacctggccgttctgcataccgccgaggctggcgggcgcgcgtacaatcacgccctcagcgaactgccggagacacttgaaaccctgctcctgctgacactccttgctaccgtgacaggaggcatcttcctgtttctgatgtccgggaaaggaattggcaagatgaccctcggcatgtgctgcatcattacggccagcatcctgctttggtatgcccagatccagcctcactggattgctgcctctatcattctggagttctttctcatcgtcctgctgattcccgaacccgagaagcaaagaacacctcaggataaccagctcacctacgtggtcatcgcgatccttaccgtggttgccgctacaatggccaatgagatggggttcctggagaaaaccaagaaagacctgggactcggctccattacaacgcaggaaagcgaatccaacatcctggacattgatcttcggccggcttctgcctggaccctgtatgcggtggccacaacctttgtgacacccatgctccgccatagcatcgagaatagctctgtcaacgttagcctgaccgctattgccaatcaagctacggtgctgatggggctcggaaagggctggcctctttccaaaatggacatcggggtgcccctgctggccattggatgttacagccaggtcaaccctatcaccctcacagctgccctgcttctgctcgtggcgcactacgccatcattggccccggcctgcaggctaaggccaccagagaagctcagaagcgggccgccgcggggatcatgaaaaatcctacagttgatggaattaccgtgatcgacctggagccgattccctatgatcctaagttcgagaaacaactcggccaggtcatgcttctgatcctgtgcgtgacgcaggtcctcatgatgcgcacaacctgggctctgtgtgaagcccttacactggctaccgggcccatctctaccctctgggagggaaaccctggcagattttggaatacaacgattgccgtgtccatggccaacatcttccgggggagctacctggctggagccggcctgctcttttctattatgaagaataccacaaacacccgcagaggcacagggaatatcggagaaacccttggcgagaaatggaagtcccggctgaacgcgctgggaaagagcgagttccagatttataaaaagtctggaatccaagaagttgacagaacgctcgccaaagagggcatcaagcgcggggaaacagatcatcacgctgtgagccggggatccgccaaactgagatggtttgtcgagcgcaacatggtgacccccgaaggcaaggttgtggaccttggctgcgggcggggaggctggtcttactattgtgggggactgaaaaatgtcagagaggtgaagggcctcaccaaagggggaccgggccatgaggaacctattcccatgagcacatacggctggaacctggtgcgcctgcagtccggggttgatgtcttcttcacaccccctgagaaatgcgacacactcctttgtgatatcggagaaagctcccccaatcctacgattgaggctggccggaccctgagagtgctgaacctcgtggaaaattggctgaacaataacacacagttttgcatcaaggtccttaatccgtatatgccctctgttattgagaaaatggagaccctgcaacgcaagtacgggggagccctcgtgcggaaccctctgagcagaaattccacacacgaaatgtactgggtgtctaacgcgaccggcaatatcgtcagctccgtgaacatgatctctcgcatgctgattaatcggttcacgatgaaacacaagaaggccacctatgagcccgacgttgatctcgggagcggaacaagaaacatcggcattgaatccgagatccctaaccttgacattatcggcaaacgcattgaaaagatcaaacaggagcatgagaccagctggcactacgaccaggatcatccctataagacatgggcttaccacgggtcttatgaaaccaaacagacaggatccgccagctctatggtgaatggcgtcgtgagactgctgaccaagccgtgggacgttgtgcctatggtcacgcaaatggctatgacagataccaccccctttgggcagcagcgggtgttcaaggagaaagtggacacacgcacgcaggaacctaaggagggaaccaaaaagctcatgagaatcacagccgagtggctgtggaaagaacttggcaagaagaaaacaccccggatgtgtacaagagaggaatttacccggaaggtccgctccaacgctgccctgggggcgattttcacagatgagaataaatggaaaagcgccagagaagctgttgaggactctcggttttgggagctcgtggatcgcgaaagaaacctgcacctggagggaaaatgcgaaacctgtgtgtacaatatgatgggcaagcgggagaaaaagctcggcgagttcgggaaggccaaaggatcccgcgctatctggtatatgtggctgggcgccagatttcttgagttcgaggccctggggtttctcaacgaagaccattggttcagccggggaaattccctgagcggcgtcgagggggaaggccttcaccgcctgggatacattctcagagatgtgtctaagaaagagggcggggcgatgtacgctgacgatacggccggatgggacacccggatcacactggaagacctgaagaacgaggagatggttaccaatcatatgaaaggcgaacacaagaagctcgccgaggctatttttaaactgacatatcaaaacaaggtggtccgcgtgcagagacctacaccccgggggacggttatggatatcatcagccgcagagaccagcggggatccggccaggtggggacatacggccttaataccttcacaaacatggaagcccaactgattagacagatggagggagagggcatcttcaaatctattcagcatctcaccgtcacggaagagatcgctgtgcaaaattggctggcccgcgttgggcgggaaagacttagccgcatggcgatttccggagatgactgcgtggtcaagccgctggatgaccggtttgcctctgctctcaccgccctgaacgatatgggcaaagtgagaaaggacatccagcagtgggagcctagccgcgggtggaatgattggacacaggtccccttctgctcccaccactttcatgaactggtgatgaaggacggacgggttctcgtggtcccctgtagaaaccaagatgagctgatcggccgcgctcggatttctcagggggccggctggagccttaaagagaccgcgtgcctgggaaagtcctatgcccagatgtggacactcatgtacttccacagacgcgacctgcggcttgctgccaacgctatctgtagcgccgtgccttctcattgggtgccgacctccagaacaacctggagcattcacgctaaacacgaatggatgacgacagaggatatgctggccgtttggaatcgggtgtggatccaggaaaacccctggatggaggacaagacccctgtcgaatcttgggaggaggtgccctatctcggcaaaagagaagaccaatggtgcgggtccctgattggactgaccagccgcgcgacatgggccaagaatatccagaccgctattaaccaggttcggtccctcatcggcaatgaggaatacacagattatatgccttctatgaagagatttcgcagagaggaagaggaggccggggtgctgtgg

SEQ ID NO: 20268 - RNA, 9873 nt, synthetic construct
  misc_feature 1..9873: note = derived and/or modified CDS sequence (opt5) from DENV-2__HQ012534__SS-prME
  source 1..9873: mol_type = other RNA
accgccggcgtgatcattatgctgatccccaccgctatggccttccacctcacgacccggaatggggagcctcatatgattgtgggacggcaggaaaagggcaagagcctgctttttaagacagaggacggggttaatatgtgcaccctgatggcgatcgatctcggagaactgtgtgaggacacaattacctacaagtgcccccttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaagacagaggccaagcagcctgctaccctgagaaaatattgcatcgaagccaagctcacgaacacaaccaccgagagccggtgtccgacacaaggagagccctctctgaatgaggaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcgaagagatcaaaattacccctcagtcttccatcacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggattcagaaagagacactcgtgaccttcaagaaccctcatgccaagaaacaggacgtcgtggttctgggctcccaagaaggggccatgcacacggctcttacaggcgcgaccgagatccagatgagctccggaaatctgctctttacaggccatctgaagtgcagacttcggatggacaaactgcagctcaaggggatgtcttacagcatgtgtaccggaaaattcaagattgtgaaggagatcgccgaaacccaacacggcacaatcgtcattagagtgcagtatgagggggatggatccccctgcaaaatccccttcgaaattatggacctggagaagcgccatgtcctgggccggctcatcacggtgaaccctattgttaccgaaaaagatagcccggtgaacatcgaggctgagcccccttttggggactcttacattatcatcggcgtcgaacccggacagctgaaacttaattggttcaaaaagggctccagcattgggcagatgtttgagacaaccatgagaggagccaagcgcatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaaaaataaggaactgaaatgcggctccgggattttcatcacagacaacgttcacacctggacagagcagtacaagtttcagcctgaaagcccctccaaacttgcctctgctattcaaaaagcccatgaggagggcatctgtggaatcagaagcgtgacgcgcctggaaaatctcatgtggaagcagattaccccggagctgaaccacatcctgtccgaaaatgaggtcaaacttacaattatgaccggcgatatcaaggggattatgcaggcgggaaaacggtctctcagacctcagcccacagaactgaagtatagctggaaaacctggggcaaggccaagatgctgtccacggagagccataaccaaaccttcctcatcgacgggcctgagacagctgaatgccccaataccaaccgcgcctggaactctctggaggtggaagattacggatttggcgttttcacaaccaacatctggcttaaactgcgggagaagcaggacgtgttttgtgactccaaactcatgagcgctgccattaaggataatagagcggtccacgccgacatgggctattggatcgagtctgctctgaacgatacatggaaaatggaaaaggcctccttcattgaggtcaagagctgccactggcctaaatctcataccctgtggagcaatggggttcttgaatccgagatgatcattcccaagaacttcgctggaccggtgagccagcacaactaccgccctggctatcatacgcagacagccgggccctggcacctcggaaaactggaaatggactttgatttctgtgagggcaccaccgtcgtggtgacagaggactgcgggaatcggggaccctctctgagaaccacgacagcctccggcaagctcatcaccgaatggtgctgtcggagctgcacactgcctccgcttcgctacagaggcgaggatgggtgttggtacggaatggaaattcggcccctgaaagagaaggaagagaacctcgtcaattccctggttaccgctggccatgggcaaatcgacaacttttctctgggagtgcttggcatggcgcttttcctggaggaaatgctgagaacacgcgtggggaccaagcacgccatcctcctggtcgctgtgagctttgttacgcttattaccggaaatatgtccttccgggatctgggcagagtgatggtcatgctcggcgtgcctatgacagacgatatcgggatgggagttacctatctggccctgcttgccgcttttaaagtgcgccccacattcgccgcgggcctgctcctgagaaagctcacctctaaagagctgatgatggctacgattgggatcgcccttctgagccagtccacaattcctgaaaccatcctcgagctgacagacgccctggctcttggaatgatggtcctgaagatcgtgcggaacatggaaaaataccagctcgccgttaccattatggcgatctcttgcgtgcccaatgctgtcattctgctcaacgcctggaaggtgagctgtaccatcctggccgctgtgtccgtcagccctcttctgctcacatcttcccaacagaagacggattggattcccctggccctgaccatcaaaggccttaatccgacagctatctttctgaccacactcagccgcacctctaagaaaagatcctggcctctgaacgaggccgttatggcggtggggatggtgagcattctcgcctcttccctgcttaagaatgacatccccatgacgggacctctggtcgctggcggcctgctcacagtgtgctatgttctgaccgggcggagcgccgaccttgagctggaacgcgctgccgatgtgaaatgggaggaccaggccgaaatttccggaagctctcccatcctcagcattaccatctccgaggatggctctatgagcattaagaacgaggaagaggaacagacactgaccatcctcatcagaacagggctgcttgtcatttccggagtgttcccggtttctatccctattacggctgcggcctggtacctgtgggaggtgaaaaagcaacgggctggcgtcctgtgggacgtgcccagccctccgcccgtcgggaaggccgaactcgaggatggagcctatcgcatcaaacagagaggcattctgggctactcccagatcggggctggagtgtataaggagggcacctttcacacaatgtggcatgttaccagaggggccgtgcttatgcaccgcggaaaaagaatcgaaccttcttgggcggacgtcaagaaagatctgattagctacggcgggggatggaagctcgagggcgaatggaaggagggcgaagaggtgcaggttctggctctcgagccggggaaaaatccccgggccgtgcaaacaaagcctggactgttcaaaaccaacacgggcaccatcggggccgtctcccttgactttagccccggaacatctggctcccctattgtggatagaaaggggaaagtggttggactgtacggcaatggcgtcgtgacccgcagcggggcttatgtgtctgccatcgcgcagacagaaaagtccattgaggacaaccccgaaatcgaggatgacatcttccggaagaaaagactgaccattatggatctccatcctggagctggcaagacaaaacgctacctgccggccatcgtccgggaagccattaagagagggcttcgcacgctgatcctcgctcccacccgggtggttgccgctgagatggaggaagccctgagaggactccctattcgctatcagacacccgcgatccgggccgagcacaccggcagagaaattgtggacctgatgtgtcatgctaccttcacaatgcggcttctgagccctgtccgcgtgcccaactacaatctgatcatcatggacgaggcccactttacggatccggcttccattgccgccagagggtatatctctacccgggttgagatgggcgaagctgcgggaattttcatgacagccacccctcccggcagccgcgacccctttcctcagtccaacgctcccatcatggatgaggaaagagagattcctgaacggagctggaactctgggcacgagtgggtgacagacttcaaaggaaagaccgtctggtttgtgccgtccatcaaggccggcaacgatatcgccgcttgcctccgcaagaatgggaagaaagttattcaactgagccgcaagacgttcgactctgagtacgtgaaaacacgggccaacgattgggactttgtcgtgaccaccgatatcagcgaaatgggagcgaatttcagagctgagcgcgtgattgacccccggagatgtatgaagcctgtcatccttacagatggcgaagaaagagttattctggccgggcccatgcctgtgacccattcctctgccgctcagcggagaggccgcatcggaagaaaccccaagaatgaaaacgaccagtatatctacatgggcgagccgctcgagaatgacgaagattgcgcccactggaaagaggcgaagatgctgctggacaacattaatacacctgaagggatcattcccagcatgtttgagcctgaacgggagaaagtggatgccatcgacggagagtaccgcctcagaggcgaagctcggaagaccttcgtcgatcttatgcgcagaggggacctgcccgtgtggctggcctatcgggttgctgccgagggaattaactacgctgatagacgctggtgttttgacggcatcaaaaataaccaaattctcgaagagaacgtggaggtcgaaatctggacgaaggagggggaacggaaaaagctgaagcctagatggcttgatgcccgcatctattccgaccccctggcgctcaaagagttcaaggagttcgccgctggccggaaatctctgacactgaatctcattaccgagatgggaagacttccgacatttatgacccagaaggcccgggatgctctggacaacctggccgtgctccatacggccgaggctggcgggcgcgcgtacaatcacgccctgagcgaacttcctgagaccctggaaacactcctgctgctcacccttctggctacagttaccggaggcatcttcctgtttctcatgtccgggaaaggaattggcaagatgacactgggcatgtgctgcatcattaccgccagcatccttctgtggtatgcccagatccagccccactggattgctgcctctatcattctcgagttctttctgatcgtgctgctcattcccgaacctgagaagcaaagaacgccgcaggataaccagcttacatacgtcgtgatcgcgatcctgaccgtcgtggccgctaccatggccaatgagatggggttcctggagaaaacaaagaaagacctcggactgggctccattaccacacaggaaagcgaatccaacatccttgacattgatctgcggcccgcttctgcctggacgctctatgcggttgccaccacatttgtgacccctatgctgcgccatagcatcgaaaattcctctgtgaacgtcagcctgacagctattgccaatcaagctaccgttctcatggggcttggaaagggctggcccctgtccaaaatggacatcggggtgcctctgctcgccattggatgttacagccaggtgaaccccatcacgctgaccgctgcccttctgctcctggtcgcgcactacgccatcattggccctggcctgcaggctaaggccacaagagaagctcagaagcgggccgccgcggggatcatgaaaaatccgaccgtggatggaattacagttatcgacctcgagcccattccttatgatcccaagttcgagaaacaacttggccaggtgatgctgctgatcctctgcgtcacccaggtgctgatgatgcgcacgacatgggctctttgtgaagccctgaccctcgctacagggcctatctctaccctgtgggagggaaaccccggcagattttggaataccacaattgccgtctccatggccaacatcttccgggggagctacctggctggagccggcctcctcttttctattatgaagaatacgaccaacacacgcagaggcaccgggaatatcggagaaacactgggcgagaaatggaagtcccggctgaacgcgctcggaaagagcgagttccagatttataaaaagtctggaatccaagaagtggacagaaccctggccaaagagggcatcaagcgcggggaaacggatcatcacgctgttagccggggatccgccaaacttagatggtttgtggagcgcaacatggtcacaccggaaggcaaggtggttgacctgggctgcgggcggggaggctggtcttactattgtgggggactcaaaaatgtgagagaggtcaagggcctgaccaaagggggacctggccatgaggaacccattcccatgagcacctacggctggaacctggtgcgcctccagtccggggtggatgttttcttcacacctcccgagaaatgcgacacccttctgtgtgatatcggagaaagctcccctaatccgacaattgaggctggccggacgctgagagtcctcaacctggtggaaaattggcttaacaataacacccagttttgcatcaaggtgctgaatccctatatgccttctgtcattgagaaaatggagacactccaacgcaagtacgggggagccctggttcggaaccccctgagcagaaattccacccacgaaatgtactgggtgtctaacgcgacaggcaatatcgtgagctccgtcaacatgatctctcgcatgctcattaatcggttcaccatgaaacacaagaaggccacgtatgagcctgacgtggatcttgggagcggaaccagaaacatcggcattgaatccgagatccccaacctggacattatcggcaaacgcattgaaaagatcaaacaggagcatgagacaagctggcactacgaccaggatcatccgtataagacctgggcttaccacgggtcttatgaaacaaaacagaccggatccgccagctctatggttaatggcgtggtcagactgctcacaaagccttgggacgtggttcccatggtgacccaaatggctatgacggatacaaccccttttgggcagcagcgggtcttcaaggagaaagtggacacccgcacacaggaacccaaggagggaacgaaaaagctgatgagaatcaccgccgagtggctttggaaagaactgggcaagaagaaaacacctcggatgtgtaccagagaggaatttacacggaaggtgcgctccaacgctgccctcggggcgattttcaccgatgagaataaatggaaaagcgccagagaagctgtcgaggactctcggttttgggagctggttgatcgcgaaagaaacctgcacctcgagggaaaatgcgaaacatgtgtgtacaatatgatgggcaagcgggagaaaaagctgggcgagttcgggaaggccaaaggatcccgcgctatctggtatatgtggcttggcgccagatttctggagttcgaggccctcgggtttctgaacgaagaccattggttcagccggggaaattcccttagcggcgtggagggggaaggcctgcaccgcctcggatacattctgagagatgtctctaagaaagagggcggggcgatgtacgctgacgataccgccggatgggacacgcggatcaccctggaagacctcaagaacgaggagatggtgacaaatcatatgaaaggcgaacacaagaagctggccgaggctatttttaaacttacctatcaaaacaaggttgtgcgcgtccagagacccacaccgcgggggaccgtgatggatatcatcagccgcagagaccagcggggatccggccaggttgggacgtacggcctgaatacattcaccaacatggaagcccaactcattagacagatggagggagagggcatcttcaaatctattcagcatctgacagtgaccgaagagatcgctgtccaaaattggcttgcccgcgtggggcgggaaagactgagccgcatggcgatttccggagatgactgcgttgtgaagcctctcgatgaccggtttgcctctgctctgacggccctgaacgatatgggcaaagtcagaaaggacatccagcagtgggagcccagccgcgggtggaatgattggacccaggtgcccttctgctcccaccactttcatgaactcgtcatgaaggacggacgggtgctggttgtgccttgtagaaaccaagatgagcttatcggccgcgctcggatttctcagggggccggctggagcctgaaagagacagcgtgcctcggaaagtcctatgcccagatgtggaccctgatgtacttccacagacgcgaccttcggctggctgccaacgctatctgtagcgccgtcccgtctcattgggtgcccacatccagaaccacatggagcattcacgctaaacacgaatggatgaccacggaggatatgctcgccgtgtggaatcgggtttggatccaggaaaacccttggatggaggacaagacacccgtggaatcttgggaggaggtcccttatctgggcaaaagagaagaccaatggtgcgggtccctgattggactcaccagccgcgcgacctgggccaagaatatccagacagctattaaccaggtgcggtccctgatcggcaatgaggaatacaccgattatatgccctctatgaagagatttcgcagagaggaagaggaggccggggttctttgg

SEQ ID NO: 20269 - RNA, 9873 nt, synthetic construct
  misc_feature 1..9873: note = derived and/or modified CDS sequence (opt5) from DENV-2__HQ012535__SS-prME
  source 1..9873: mol_type = other RNA
accgcgggagtgatcattatgctgatccccaccgctatggccttccacctcacgaccagaaatggggaacctcatatgattgtgggacggcaggaaaagggcaagagcctgctttttaagaccgaagacggggttaatatgtgcaccctgatggcgatcgatctcggagaactgtgtgaggacaccattacctacaagtgcccgcttctgagacaaaatgaacccgaggatatcgactgttggtgcaattccacctctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcgaagagatcaaaattacccctcagtcttccatcacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggattcagaaagagacactcgtgaccttcaagaaccctcatgccaagaaacaggacgtcgtggttctgggctcccaagaaggggccatgcacacggctcttacaggcgcgaccgagatccagatgagctccggaaatctgctctttacaggccatctgaagtgcagacttcggatggacaaactgcagctcaaggggatgtcttacagcatgtgtaccggaaaattcaagattgtgaaggagatcgccgaaacccaacacggcacaatcgtcattagagtgcagtatgagggggatggatccccctgcaaaatccccttcgaaattatggacctggagaagcgccatgtcctgggccggctcatcacggtgaaccctattgttaccgaaaaagatagcccggtgaacatcgaggctgagcccccttttggggactcttacattatcatcggcgtcgaacccggacagctgaaacttaattggttcaaaaagggctccagcattgggcagatgtttgagacaaccatgagaggagccaagcgcatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaaaaataaggaactgaaatgcggctccgggattttcatcacagacaacgttcacacctggacagagcagtacaagtttcagcctgaaagcccctccaaacttgcctctgctattcaaaaagcccatgaggagggcatctgtggaatcagaagcgtgacgcgcctggaaaatctcatgtggaagcagattaccccggagctgaaccacatcctgtccgaaaatgaggtcaaacttacaattatgaccggcgatatcaaggggattatgcaggcgggaaaacggtctctcagacctcagcccacagaactgaagtatagctggaaaacctggggcaaggccaagatgctgtccacggagagccataaccaaaccttcctcatcgacgggcctgagacagctgaatgccccaataccaaccgcgcctggaactctctggaggtggaagattacggatttggcgttttcacaaccaacatctggcttaaactgcgggagaagcaggacgtgttttgtgactccaaactcatgagcgctgccattaaggataatagagcggtccacgccgacatgggctattggatcgagtctgctctgaacgatacatggaaaatggaaaaggcctccttcattgaggtcaagagctgccactggcctaaatctcataccctgtggagcaatggggttcttgaatccgagatgatcattcccaagaacttcgctggaccggtgagccagcacaactaccgccctggctatcatacgcagacagccgggccctggcacctcggaaaactggaaatggactttgatttctgtgagggcaccaccgtcgtggtgacagaggactgcgggaatcggggaccctctctgagaaccacgacagcctccggcaagctcatcaccgaatggtgctgtcggagctgcacactgcctccgcttcgctacagaggcgaggatgggtgttggtacggaatggaaattcggcccctgaaagagaaggaagagaacctcgtcaattccctggttaccgctggccatgggcaaatcgacaacttttctctgggagtgcttggcatggccctcttcctggaggaaatgctgagaacacgcgtggggaccaagcacgccatcctcctggtcgctgtgagctttgttacgcttattaccggaaatatgtccttccgggatctgggcagagtgatggtcatggtgggcgttacaatgaccgacgatatcgggatgggagtgacatatctcgccctgctggccgcttttaaagtccgccctaccttcgccgcgggccttctgctcagaaagctgacgtctaaagagctcatgatggctacaattgggatcgccctgcttagccagtccaccattcccgaaacaatcctggagctcaccgacgccctggctctgggaatgatggtgcttaagatcgttcggaacatggaaaaataccagctggccgtgaccattatggcgatctcttgcgtccctaatgctgtgattctcctgaacgcctggaaggtgagctgtacaatcctcgccgctgtctccgttagccccctgcttctgacgtcttcccaacagaagaccgattggattcctctcgccctgacaatcaaaggcctgaatcccaccgctatctttcttacaaccctgagccgcacgtctaagaaaagatcctggccgctcaacgaggccgtgatggcggtggggatggtcagcattctggcctcttccctcctgaagaatgacatccctatgacaggaccccttgtggctggcggcctgctgaccgtttgctatgtgctcaccgggcggagcgccgacctggagcttgaacgcgctgccgatgtcaaatgggaggaccaggccgaaatttccggaagctctcctatcctgagcattacaatctccgaggatggctctatgagcattaagaacgaggaagaggaacagaccctcacaatcctgatcagaacggggctcctggtgatttccggagttttccccgtgtctatcccgattaccgctgcggcctggtacctttgggaggtcaaaaagcaacgggctggcgtgctgtgggacgtcccttctccccctcccgtggaaaaggccgagctggaggatggggcctatcgcatcaaacagagaggcattctcggctactcccagatcggcgctggggtttataaggaaggaacatttcacaccatgtggcatgtgacacggggcgccgtcctgatgcaccgcgggaaaagaatcgagccctcctgggcggacgtgaagaaagatcttattagctacggaggcgggtggaagctggaaggagagtggaaggaaggcgaggaggttcaggtgctcgctctggaacctggcaaaaatccgcgggccgtccaaaccaagcccggactcttcaaaacgaacaccggaacaatcggcgccgtgtccctggactttagccctgggacctctggatcccccattgtggatagaaagggcaaagttgtcgggctttacggaaatggcgtggtgacacgcagcggcgcttatgtctctgccatcgcgcagaccgagaagtccattgaagacaaccctgagatcgaagatgacatcttccggaagaaaagactgacaattatggatctgcatcccggggctggaaagacgaaacgctacctccctgccatcgtgcgggaggccattaagagaggcctgcgcacccttatcctggctccgacacgggttgtggccgctgagatggaagaggccctcagagggctgcccattcgctatcagacccctgcgatccgggccgaacacaccggaagagagattgtcgacctcatgtgtcatgctacattcacgatgcggctgcttagccccgtgcgcgttcctaactacaatctgatcatcatggacgaggcccactttaccgatcccgcttccattgccgccagaggctatatctctacacgggtggaaatgggggaggctgcgggcattttcatgaccgccacaccgcctggaagccgcgacccctttccccagtccaacgctcctatcatggatgaagagagagaaattcccgagcggagctggaactctggccacgagtgggtcaccgacttcaaagggaagacggtgtggtttgttccttccatcaaggccggaaacgatatcgccgcttgcctgcgcaagaatggcaagaaagtgattcaactcagccgcaagacattcgactctgaatacgtcaaaacccgggccaacgattgggactttgtggtgaccacagatatcagcgagatgggggcgaatttcagagctgaacgcgtcattgacccgcggagatgtatgaagcccgttatcctgaccgatggagaggaacgcgtgattcttgccggccctatgcccgtgacacattcctctgccgctcagcggagagggcgcatcggcagaaaccctaagaatgagaacgaccagtatatctacatgggagagcccctggaaaatgacgaggattgcgcccactggaaagaagcgaagatgctcctggacaacattaataccccggagggcatcattcctagcatgtttgaacccgagcgggagaaagtcgatgccatcgacggggaataccgcctgagaggagaggctcggaagacgttcgtggatctcatgcgcagaggcgaccttcctgtttggctggcctatcgggtggctgccgaagggattaactacgctgatagacgctggtgttttgacggaatcaaaaataaccaaattctggaggagaacgtcgaagtggagatctggacaaaggaaggcgagcggaaaaagctcaagcccagatggctggatgcccgcatctattccgaccctcttgcgctgaaagagttcaaggagttcgccgctgggcggaaatctctcaccctgaatctgattacagagatgggcagactccccacctttatgacgcagaaggcccgggatgctcttgacaacctggccgttctgcataccgccgaagctggaggccgcgcgtacaatcacgccctcagcgagctgccggaaacacttgagaccctgctcctgctgacactccttgctaccgtgacagggggaatcttcctgtttctgatgtccggcaaagggattggaaagatgaccctcggcatgtgctgcatcattacggccagcatcctgctttggtatgcccagatccagcctcactggattgctgcctctatcattctggagttctttctcatcgtcctgctgattcccgagcccgagaagcaaagaacacctcaggataaccagctcacctacgtggtcatcgcgatccttaccgtggttgccgctacaatggccaatgaaatgggcttcctggagaaaaccaagaaagacctggggctcggatccattacaacgcaggaaagcgagtccaacatcctggacattgatcttcggccggcttctgcctggaccctgtatgcggtggccacaacctttgtgacacccatgctccgccatagcatcgaaaattcctctgtcaacgttagcctgaccgctattgccaatcaagctacggtgctgatgggcctcgggaagggatggcctctttccaaaatggacatcggcgtgcccctgctggccattgggtgttacagccaggtcaaccctatcaccctcacagctgccctgcttctgctcgtggcgcactacgccatcattggacccggcctgcaggctaaggccaccagagaggctcagaagcgggccgccgcgggcatcatgaaaaatcctacagttgatgggattaccgtgatcgacctggagccgattccctatgatcctaagttcgaaaaacaactcggacaggtcatgcttctgatcctgtgcgtgacgcaggtcctcatgatgcgcacaacctgggctctgtgtgaggcccttacactggctaccggccccatctctaccctctgggaagggaaccctggaagattttggaatacaacgattgccgtgtccatggccaacatcttccggggcagctacctggctggggccggactgctcttttctattatgaagaataccacaaacacccgcagaggcacaggcaatatcggggagacccttggagagaaatggaagtcccggctgaacgcgctgggcaagagcgagttccagatttataaaaagtctgggatccaagaggttgacagaacgctcgccaaagaaggaatcaagcgcggcgagacagatcatcacgctgtgagccgggggtccgccaaactgagatggtttgtcgaacgcaacatggtgacccccgagggaaaggttgtggaccttggctgcggcagagggggatggtcttactattgtggcgggctgaaaaatgtccgggaggtgaagggactcaccaagggcgggccgggacatgaagaacctattcccatgagcacatacggctggaacctggtgcgcctgcagtccggcgttgatgtcttcttcacaccccctgaaaaatgcgacacactcctttgtgatatcggggagagctcccccaatcctacgattgaagctggacggaccctgagagtgctgaacctcgccgagaattggctgaacaataacacacagttttgcatcaaggtgcttaatccgtatatgccctctgtcattgagaaaatggaaaccctgcaacgcaagtacggcggggcgctcgttcggaaccctctgagcagaaattccacacacgagatgtactgggtgtctaacgccaccggaaatatcgtgagctccgtcaacatgatctctcgcatgctgattaatcggttcacgatgaaacacaagaaggctacctatgaacccgacgtggatctcggcagcgggacaagaaacatcggaattgagtccgaaatccctaaccttgacattatcggcaaacgcattgagaagatcaaacaggagcatgaaaccagctggcactacgaccaggatcatccctataagacatgggcctaccacggctcttatgagaccaaacagacagggtccgctagctctatggttaatggagtggtcagactgctgaccaagccgtgggacgtggttcctatggtgacgcaaatggccatgacagataccaccccctttggccagcagcgggtcttcaaggaaaaagtggacacacgcacgcaggagcctaaggaggggaccaaaaagctcatgagaatcacagctgaatggctgtggaaagagcttggaaagaagaaaacaccccggatgtgtacaagagaagagtttacccggaaggtgcgctccaacgccgcgctgggcgccattttcacagatgaaaataaatggaaaagcgctagagaggccgtcgaggactctcggttttgggaactcgttgatcgcgagagaaacctgcacctggaagggaaatgcgagacctgtgtgtacaatatgatgggaaagcgggagaagaagctcggcgagttcggcaaggctaaagggtcccgcgccatctggtatatgtggctgggagccagatttcttgagttcgaagcgctgggctttctcaacgaggaccattggttcagccgggggaatagcctgagcggagtggaaggcgaggggcttcaccgcctgggctacattctcagagatgtctctaagaaagaaggaggcgctatgtacgccgacgatacggccgggtgggacacccggatcacactggaggacctgaagaacgaggaaatggtgaccaatcatatgaaaggagagcacaagaagctcgctgaagccatttttaaactgacatatcaaaacaaggttgtgcgcgtccagagacctacaccccggggcacggtgatggatatcatcagccgcagagaccagcgggggtccggacaggttggcacatacgggcttaataccttcacaaacatggaggctcaactgattagacagatggagggcgaaggaatcttcaaatctattcagcatctcaccgtgacggaggaaatcgccgtccaaaattggctggcgcgcgtgggccgggagagacttagccgcatggccatttccggggatgactgcgttgtgaagccgctggatgaccggtttgcttctgccctcaccgctctgaacgatatgggaaaagtcagaaaggacatccagcagtgggaacctagccgcggctggaatgattggacacaggtgcccttctgctcccaccactttcatgagctggtcatgaaggacgggcgggtgctcgttgtgccctgtagaaaccaagatgagctgatcggacgcgcccggatttctcagggcgcggggtggagccttaaagaaaccgcctgcctgggcaagtcctatgctcagatgtggacactcatgtacttccacagacgcgacctgcggcttgccgctaacgccatctgtagcgctgtcccttctcattgggtgccgacctccagaacaacctggagcattcacgccaaacacgagtggatgacgacagaagatatgctggcggtgtggaatcgggtttggatccaggagaacccctggatggaagacaagacccctgtggagtcttgggaggaagtcccctatctcggaaaaagagaggaccaatggtgcggctccctgattgggctgaccagccgcgccacatgggctaagaatatccagaccgccattaaccaggtgcggtccctcatcggaaatgaagagtacacagattatatgccttctatgaagagatttcgcagagaagaggaggaagccggcgttctgtgg

SEQ ID NO: 20270 - RNA, 9873 nt, synthetic construct
  misc_feature 1..9873: note = derived and/or modified CDS sequence (opt5) from DENV-2__HQ012536__SS-prME
  source 1..9873: mol_type = other RNA
accgccggagtgatcattatgctgatccccaccgctatggccttccaccttacgacccggaatggggagcctcatatgattgtcggacggcaggaaaagggcaagagcctgctttttaagacggaggacggggttaatatgtgcaccctgatggcgatcgatctcggagaactgtgtgaggacaccattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggctggacaagctccagctgaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctcggccggctgatcacggtgaaccctattgttaccgggaaggatagcccggtgaacatcgaggctgaacccccttttggcgactcttacattatcatcggagtcgagcccggccagcttaaactgaattggttcaagaaggggtccagcattggacagatgtttgagacaaccatgagaggcgccaaacgcatggccatcctcggggatacagcttgggacttcggatctctgggcggggtgtttaccagcattggcaaggccctgcaccaagttttcggagcgatctacggcgctgccttttccggggtgtcttggacgatgaaaattcttatcggagtcatcattacatggatcggcatgaacagccggtccaccagcctctctgtgtccctggtgctggttggggtcgtgaccctctatctgggagccatggtgcaggctgatagcggctgtgtcgtgtcttggaagaataaagaacttaagtgcgggtccggcattttcatcacagacaacgttcacacctggacagagcagtacaagtttcagcctgaaagcccctccaaactggcctctgctattcaaaaggcccatgaggaaggaatctgtggcatcagaagcgtgacgcgcctcgagaatctgatgtggaaacagattaccccggagctgaaccacatcctttccgaaaatgaggtcaagctcacaattatgaccggggatatcaaaggaattatgcaggcgggcaagcggtctctgagacctcagcccacagaactgaaatatagctggaagacctgggggaaggccaaaatgctctccacggagagccataaccaaaccttcctgatcgacggacctgaaacagctgagtgccccaataccaaccgcgcctggaactctcttgaggtggaagattacggctttggcgttttcacaaccaacatctggctgaagctccgggagaaacaggacgtgttttgtgactccaagctgatgagcgctgccattaaagataatagagcggtccacgccgacatggggtattggatcgaatctgctctgaacggaacatggaagatggagaaggcctccttcattgaggtgaaaagctgccactggcctaagtctcataccctttggagcaatggcgttctcgaatccgagatgatcattcccaaaaacttcgctgggccggtgagccagcacaactaccgccctggatatcatacgcagacagccggcccctggcacctggggaagctggaaatggattttgacttctgtgagggaaccaccgtcgtggtgacagaagattgcggcaatcggggcccctctctcagaaccacgacagcctccgggaaactgatcaccgagtggtgctgtcggagctgcacacttcctccgctgcgctacagaggagaggacggctgttggtacgggatggaaattcggcccctcaaggagaaggaagagaacctggtcaattccctggttaccgctggacatggccaaatcgataacttttctcttggggtgctcggaatggcgctgttcctggaagagatgctcagaacacgcgtgggcaccaaacacgccatcctgcttgtcgctgtgagctttgttacgctgattaccggcaatatgtccttcaaggacctcgggcgggtgatggtcatggtgggagttgccatgacagatgacatcggcatgggggtgacctatctggccctgcttgctgcctttaaagtcagacctacattcgcggctggactgctcctgcgcaagctcacctctaaagagctgatgatggccacgattggcatcacacttctgagccagtccaccattcccgaaacaatcctcgagctgaccgatgccctggctcttgggatgatggtgctgaagatcgttagaaacatggaaaagtaccagctcgccgtgaccattatggcgatctcttgcgtccctaatgctgtgattctgctcaacgcctggaaagtgagctgtacaatcctggccgctgtctccgttagcccccttctgctcacgtcttcccaacagaagaccgactggattcctctggccctgacaatcaaaggacttaatcccaccgctatctttctgacaaccctcagccggacgtctaagaaacgctcctggccgctgaacgaggccgtgatggcggtgggcatggtcagcattctcgcctcttccctgcttaagaatgatatccctatgacaggccccctggtggctgggggactgctcaccgtttgctatgtgctgaccggcagaagcgccgaccttgaactggagcgggctgccgacgtcaaatgggaggatcaggccgaaatttccgggagctctcctatcctcagcattacaatctccgaggacggatctatgagcattaagaacgaagaggaggaacagaccctgacaatcctcatccgcacgggcctgcttgtgatttccggggttttccccgtgtctatcccgattaccgctgcggcctggtacctgtgggaggtcaagaaacaaagagctggagtgctgtgggatgtcccttctccccctcccgtgggcaaggccgaactcgaggacggcgcctatcggatcaaacagcgcgggattctgggatactcccagatcggcgctggggtttataaggaaggaacatttcacaccatgtggcatgtgacaagaggcgccgtccttatgcaccgggggaaacgcatcgagccctcctgggcggatgtgaagaaggacctgattagctacggaggcggctggaaactcgagggggaatggaaggagggagaagaggttcaggtgctggctctcgaacctggcaaaaatccgagagccgtccaaaccaagcccgggctgttcaaaacgaacaccggaacaatcggcgccgtgtcccttgattttagccctgggacctctggatcccccattgtggaccggaagggcaaggttgtcggcctgtacgggaatggagtggtgacaagaagcggcgcttatgtctctgccatcgcgcagaccgagaaatccattgaggataaccctgaaatcgaggacgatatcttccgcaagaaacggctgacaattatggacctccatcccggggctggaaagacgaaaagatacctgcctgccatcgtgcgcgaagccattaagcggggccttagaaccctgatcctcgctccgacacgcgttgtggccgctgagatggaagaggccctgcgggggctccccattagatatcagacccctgcgatccgcgccgagcacaccggccgggaaattgtcgatctgatgtgtcatgctacattcacgatgagacttctgagccccgtgcgggttcctaactacaatctgatcatcatggacgaggcccactttaccgaccccgcttccattgccgcccgcggatatatctctacaagagtggaaatgggcgaggctgcggggattttcatgaccgccacaccgcctggaagccgggatccctttccccagtccaacgctcctatcatggacgaggaacgcgagattcccgaaagaagctggaactctggccacgagtgggtcaccgatttcaaggggaaaacggtgtggtttgttccttccatcaaggccggaaacgacatcgccgcttgcctccggaaaaatggcaagaaagtgattcaactgagcagaaagacattcgattctgaatacgtcaagacccgcgccaacgactgggattttgtggtgaccacagacatcagcgagatgggggcgaatttccgggctgagagagtcattgatccgcgccggtgtatgaaacccgttatccttaccgacggcgaagagagagtgattctggccggacctatgcccgtgacacattcctctgccgctcagcgccggggcagagtcgggcgcaaccctaagaatgaaaacgatcagtatatctacatgggagagcccctcgaaaatgacgaggactgcgcccactggaaagaggcgaagatgctgctggataacatcaataccccggaaggcattatccctagcatgtttgagcccgaaagagagaaagtggacgccattgatggggaataccggctccgcggagaggctagaaagacgttcgttgaccttatgcggcgcggcgatctgcctgtgtggctggcctatagagtcgctgccgaggggatcaactacgctgaccggagatggtgttttgatggcattaaaaataaccaaatcctcgaagagaacgtggaagttgagatttggacaaaggagggagaacgcaagaaactgaagccccggtggcttgacgccagaatctattccgatcctctggcgctcaaagagttcaaggagttcgccgctggccgcaaatctctgaccctgaatctcatcacagagatggggcggcttcccacctttatgacgcagaaggccagagacgctctggataacctggccgtgctccataccgccgaagctggaggccgggcgtacaatcacgccctgagcgagcttccggagacactggaaaccctcctgctgctcacacttctggctaccgtcacagggggaattttcctgtttctcatgtccggcaagggcatcgggaaaatgaccctgggaatgtgctgcattatcacggccagcattcttctgtggtatgcccagatccagcctcactggatcgctgcctctattatcctcgagttctttctgattgtgctgctcatccccgaacccgagaagcaacgcacacctcaggacaaccagcttacctacgtcgtgattgcgatcctgaccgttgtggccgctacaatggccaatgaaatgggcttcctggagaaaaccaagaaagatctcgggctgggatccatcacaacgcaggagagcgaatccaacattcttgacatcgacctgagaccggcttctgcctggaccctctatgcggtggccacaacctttgtcacacccatgctgcggcatagcattgaaaatagctctgttaacgtgagcctgaccgctatcgccaatcaagctacggtgctcatgggccttgggaagggatggcctctgtccaagatggatattggcgtccccctgctcgccatcggctgttacagccaggtgaaccctattaccctgacagctgcccttctgctcctggttgcgcactacgccatcatcgggcccggactgcaggctaaagccacccgcgaagctcagaagagagccgccgcgggcattatgaaaaatcctacagtggacgggatcaccgtcattgatctcgagccgatcccctatgaccctaagttcgaaaaacaacttggacaggtgatgctgctgattctctgcgtcacacaggtgctgatgatgcggacaacctgggctctttgtgaggccctgacactcgctaccggccccatctctaccctgtgggaggggaaccctggacgcttttggaatacaacgatcgccgtttccatggccaacattttcagaggcagctacctggctggcgccgggctcctcttttctatcatgaagaataccacaaacacccggcgcggaacaggcaatattggggaaaccctgggagagaagtggaaatccagactgaacgcgctcggcaagagcgagttccagatctataaaaagtctgggattcaagaggtggatcggacgctggccaaagagggaatcaagagaggcgaaacagaccatcacgctgtcagccgcggctccgccaaacttcggtggtttgtggagagaaacatggttacccccgaagggaaggtggtcgatctgggatgcggccgcgggggatggtcttactattgtggcgggctcaagaatgtgcgggaggtgaaaggactgaccaagggcggcccggggcatgaagaacctatccccatgagcacatacggatggaacctggttagactccagtccggcgtcgacgtgttcttcacaccccctgagaaatgcgatacacttctgtgtgacattggggaaagctcccccaatcctacgatcgaggctggacgcaccctgcgggtgctcaacctggtcgaaaattggcttaacaataacacacagttttgcattaaggttctgaatccgtatatgccctctgtgatcgagaaaatggaaaccctccaaagaaagtacggcggggccctggtgcgcaaccctctgagcagaaattccacacacgagatgtactgggtctctaacgcgaccggaaatattgtgagctccgttaacatgatctctagaatgctcatcaatcgcttcacgatgaagcacaaaaaggccacctatgagcccgatgtggaccttggcagcggcacacggaacattgggatcgaatccgagattcctaacctggatatcattggaaaaagaatcgaaaagattaaacaggagcatgaaaccagctggcactacgaccaggaccatccctataagacatgggcttaccacggctcttatgagaccaagcagacagggtccgccagctctatggtcaatggagtggttcgcctgctcaccaaaccgtgggatgtggtccctatggtgacgcaaatggctatgacagacaccaccccctttggccagcagagagtgttcaaggagaaagtcgatacacggacgcaggaacctaaggaggggaccaaaaagctgatgcgcatcacagccgaatggctttggaaggagctgggcaagaagaaaacccccagaatgtgtacacgggaggaatttaccagaaaggttcggtccaacgctgccctcggcgcgatcttcacagacgagaataaatggaaaagcgcccgcgaagctgtggaggattctagattttgggaactggtggaccgggagcgcaacctgcacctcgagggcaaatgcgaaacctgtgtctacaatatgatggggaagagagagaagaaactgggagagttcggcaaggccaaagggtcccgggctatttggtatatgtggcttggagcccgctttctggagttcgaagccctcggctttctgaacgaggatcattggttcagcagaggaaattcccttagcggcgtggagggagaaggcctgcaccggctcgggtacatcctgcgcgacgtttctaagaaagagggaggcgcgatgtacgctgatgacacggccgggtgggataccagaattacactggaagacctcaagaacgaggaaatggtgaccaatcatatgaagggagagcacaaaaagctggccgaggctatctttaaacttacatatcaaaacaaggtcgtgcgggttcagcgccctacccccagaggcacggtgatggacattatcagccggcgcgatcagagagggtccggccaggtcggaacatacggcctgaataccttcacaaacatggaagcccaactcatccggcagatggagggggaaggaattttcaaatctatccagcatctgaccgtgacggaggagattgctgttcaaaattggcttgccagagtgggccgcgaacggctgagcagaatggcgatctccggggacgattgcgtcgtgaagccgctcgacgatcgctttgcctctgctctgaccgccctgaacgacatgggaaaggtccggaaagatattcagcagtgggagcctagcagaggctggaatgactggacacaggtgcccttctgctcccaccactttcatgaactcgttatgaaggatgggcgcgtgctggtcgtgccctgtcggaaccaagacgagcttatcggcagagctcgcatctctcagggagccggctggagcctgaaagaaaccgcgtgcctcgggaagtcctatgcccagatgtggacactgatgtacttccaccggagagatcttcgcctggctgccaacgctatttgtagcgccgtgccttctcattgggttccgacctcccggacaacctggagcatccacgctaaacacgagtggatgacgacagaggacatgctcgccgtgtggaatagagtctggattcaggaaaacccctggatgggagataagacccctgtggagtcttgggaagaggttccctatctgggcaagcgggaagaccaatggtgcgggtccctgatcggactcaccagcagagcgacatgggccaaaaatattcagaccgctatcaaccaggtgcgctccctgattggcaatgaggagtacacagactatatgccttctatgaagcggtttagacgcgaagaggaagaggccggggtcctttgg

SEQ ID NO: 20271 - RNA, 9873 nt, synthetic construct
  misc_feature 1..9873: note = derived and/or modified CDS sequence (opt5) from DENV-2__HQ012537__SS-prME
  source 1..9873: mol_type = other RNA
accgcgggagtgatcattatgctgatccccaccgctatggccttccacctcacgaccagaaatggggagcctcatatgattgtcggacggcaggaaaagggcaaaagcctgctttttaagacagaggacggggttaatatgtgcaccctgatggcgatcgatctcggagaactgtgtgaggacaccattacctacaaatgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctgggccggctcatcacggtgaaccctattgttaccgagaaggatagcccggtgaacatcgaagctgagcccccttttggggactcttacattatcatcggcgtcgagcccggacagctgaaacttaattggttcaagaagggctccagcattgggcagatgtttgaaacaaccatgagaggagccaaacgcatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaagaataaagagctgaagtgcggctccgggattttcatcacagacaacgttcacacctggacagaacagtacaagtttcagcctgagagcccctccaaacttgcctctgctattcaaaaggcccatgaagagggcatctgtggaatcagaagcgtgacgcgcctggagaatctcatgtggaaacagattaccccggaactgaaccacatcctgtccgagaatgaagtcaaacttacaattatgaccggcgatatcaaagggattatgcaggcgggaaagcggtctctcagacctcagcccacagagctgaaatatagctggaagacctggggcaaggccaaaatgctgtccacggaaagccataaccaaaccttcctcatcgacgggcctgagacagctgagtgccccaataccaaccgcgcctggaactctctggaagtggaggattacggatttggcgttttcacaaccaacatctggcttaagctgcgggaaaaacaggacgtgttttgtgactccaagctcatgagcgctgccattaaagataatagagcggtccacgccgacatgggctattggatcgagtctgctctgaacgatacatggaagatggagaaggcctccttcattgaagtgaaaagctgccactggcctaagtctcataccctgtggagcaatggggttcttgagtccgaaatgatcattcccaaaaacttcgctggaccggtgagccagcacaactaccgccctggctatcatacgcagacagccgggccctggcacctcggaaagctggagatggactttgatttctgtgaaggcaccaccgtcgtggtgacagaggactgcgggaatcggggaccctctctgagaaccacgacagcctccggcaaactcatcaccgagtggtgctgtcggagctgcacactgcctccgcttcgctacagaggcgaagatgggtgttggtacggaatggagattcggcccctgaaggaaaaggaggaaaacctcgtcaattccctggttaccgctggccatgggcaaatcgacaacttttctctgggagtgcttggcatggccctcttcctggaggagatgctgagaacacgcgtggggaccaaacacgccatcctcctggtcgctgtgagctttgttacgcttattaccggaaatatgtccttccgggatctgggcagagtgatggtcatggtgggcgttacaatgaccgacgatatcgggatgggagtgacatatctcgccctgctggccgcttttaaggtccgccctaccttcgccgcgggccttctgctcagaaaactgacgtctaaggaactcatgatggctacaattgggatcgccctgcttagccagtccaccattcccgagacaatcctggaactcaccgacgccctggctctgggaatgatggtgcttcggatcgttcgcaacatggagaaataccagctggccgtgaccattatggcgatctcttgcgtccctaatgctgtgattctcctgaacgcctggaaggtgagctgtacaatcctcgccgctgtctccgttagccccctgcttctgacgtcttcccaacagaagaccgattggattcctctcgccctgacaatcaaaggcctgaatcccaccgctatctttcttacaaccctgagcagaacgtctaagaaacggtcctggccgctcaacgaagccgtgatggcggtggggatggtcagcattctggcctcttccctcctgaagaatgacatccctatgacaggaccccttgtggctggcggcctgctgaccgtttgctatgtgctcaccgggcgcagcgccgacctggagcttgagagagctgccgatgtcaaatgggaagaccaggccgagatttccggaagctctcctatcctgagcattacaatctccgaagatggctctatgagcattaagaacgaggaggaagaacagaccctcacaatcctgatccggacggggctcctggtgatttccggagttttccccgtgtctatcccgattaccgctgcggcctggtacctttgggaagtcaaaaagcaacgcgctggcgtgctgtgggacgtcccttctccccctcccgtggagaaggccgaactggaggatggggcctatagaatcaaacagcggggcattctcggctactcccagatcggcgctggggtttataaggagggaacatttcacaccatgtggcatgtgacacgcggcgccgtcctgatgcacagagggaaacggatcgaaccctcctgggcggacgtgaagaaagatcttattagctacggaggcgggtggaagctggagggagaatggaaggagggcgaagaggttcaggtgctcgctctggagcctggcaaaaatccgagagccgtccaaaccaagcccggactcttcaaaacgaacaccggaacaatcggcgccgtgtccctggactttagccctgggacctctggatcccccattgtggatcgcaagggcaaagttgtcgggctttacggaaatggcgtggtgacacggagcggcgcttatgtctctgccatcgcgcagaccgaaaagtccattgaggacaaccctgaaatcgaggatgacatcttcagaaagaaacgcctgacaattatggatctgcatcccggggctggaaagacgaaacggtacctccctgccatcgtgagagaagccattaagcgcggcctgcggacccttatcctggctccgacaagagttgtggccgctgagatggaggaagccctccgcgggctgcccattcggtatcagacccctgcgatcagagccgagcacaccggacgggaaattgtcgacctcatgtgtcatgctacattcacgatgcgcctgcttagccccgtgagagttcctaactacaatctgatcatcatggacgaggcccactttaccgatcccgcttccattgccgcccggggctatatctctacacgcgtggagatgggggaagctgcgggcattttcatgaccgccacaccgcctggaagcagagacccctttccccagtccaacgctcctatcatggatgaggaacgggagattcccgaaagaagctggaactctggccacgagtgggtcaccgacttcaaagggaagacggtgtggtttgttccttccatcaaggccggaaacgatatcgccgcttgcctgcgcaaaaatggcaagaaagtgattcaactcagccggaagacattcgactctgagtacgtcaaaaccagagccaacgattgggactttgtggtgaccacagatatcagcgaaatgggggcgaatttccgcgctgagcgggtcattgacccgagacgctgtatgaagcccgttatcctgaccgatggagaagaacgggtgattcttgccggccctatgcccgtgacacattcctctgccgctcagagacgcgggagaatcggccggaaccctaagaatgaaaacgaccagtatatctacatgggagagcccctggagaatgacgaagattgcgcccactggaaagaggcgaagatgctcctggacaacattaataccccggaaggcatcattcctagcatgtttgagcccgaacgcgagaaagtcgatgccatcgacggggagtacagactgcggggagaagctcgcaagacgttcgtggatctcatgagacggggcgaccttcctgtttggctggcctatagagtggctgccgaggggattaactacgctgatcgccggtggtgttttgacggaatcaaaaataaccaaattctggaagagaacgtcgaggtggaaatctggacaaaggagggcgaacgcaagaagctcaagccccgctggctggatgcccggatctattccgaccctcttgcgctgaaagagttcaaggagttcgccgctgggagaaaatctctcaccctgaatctgattacagagatgggccggctccccacctttatgacgcagaaggcccgcgatgctcttgacaacctggccgttctgcataccgccgaggctggaggcagagcgtacaaacacgccctcagcgaactgccggagacacttgaaaccctgctcctgctgacactccttgctaccgtgacagggggaatcttcctgtttctgatgtccggcaaggggattggaaagatgaccctcggcatgtgctgcatcattacggccagcatcctgctttggtatgcccagatccagcctcactggattgctgcctctatcattctggagttctttctcatcgtcctgctgattcccgaacccgagaaacaacggacacctcaggataatcagctcacctacgtggtcatcgcgatccttaccgtggttgccgctacaatggccaacgagatgggcttcctggaaaagaccaaaaaggacctggggctcggatccattacaacgcaggagagcgaatccaatatcctggacattgatcttcgcccggcttctgcctggaccctgtatgcggtggccacaacctttgtgacacccatgctcagacatagcatcgagaactcctctgtcaatgttagcctgaccgctattgccaaccaagctacggtgctgatgggcctcgggaaaggatggcctctttccaagatggacatcggcgtgcccctgctggccattgggtgttacagccaggtcaatcctatcaccctcacagctgccctgcttctgctcgtggcgcactacgccatcattggacccggcctgcaggctaaggccacccgggaagctcagaaacgcgccgccgcgggcatcatgaagaaccctacagttgatgggattaccgtgatcgacctggagccgattccctatgatcctaaattcgagaagcaactcggacaggtcatgcttctgatcctgtgcgtgacgcaggtcctcatgatgagaacaacctgggctctgtgtgaagcccttacactggctaccggccccatctctaccctctgggaggggaatcctggacggttttggaacacaacgattgccgtgtccatggccaatatcttccgcggcagctacctggctggggccggactgctcttttctattatgaaaaacaccacaaataccagacggggcacaggcaacatcggggaaacccttggagagaagtggaagtccagactgaatgcgctgggcaaaagcgagttccagatttataagaaatctgggatccaagaagttgaccgcacgctcgccaaggagggaatcaaacggggcgaaacagatcatcacgctgtgagcagagggtccgccaagctgcgctggtttgtcgagcggaacatggtgacccccgaaggaaaagttgtggaccttggctgcggcagagggggatggtcttactattgtggcgggctgaagaacgtccgcgaggtgaagggactcaccaaaggcgggccgggacatgaggaacctattcccatgagcacatacggctggaatctggtgcggctgcagtccggcgttgatgtcttcttcacaccccctgagaagtgcgacacactcctttgtgatatcggggaaagctcccccaaccctacgattgaggctggaagaaccctgcgcgtgctgaatctcgccgaaaactggctgaataacaatacacagttttgcatcaaagtgcttaacccgtatatgccctctgtcattgagaagatggagaccctgcaacggaaatacggcggggcgctcgttagaaatcctctgagccgcaactccacacacgaaatgtactgggtgtctaatgccaccggaaacatcgtgagctccgtcaatatgatctctcggatgctgattaacagattcacgatgaagcacaagaaagctacctatgagcccgacgtggatctcggcagcgggacacgcaatatcggaattgaatccgagatccctaaccttgacattatcggcaagagaattgagaagatcaagcaggagcatgagaccagctggcactacgaccaggatcatccctataaaacatgggcctaccacggctcttatgaaaccaagcagacagggtccgctagctctatggttaacggagtggtccggctgctgaccaagccgtgggacgtggttcctatggtgacgcaaatggccatgacagataccaccccctttggccagcagcgcgtcttcaaagagaaggtggacacaagaacgcaggaacctaaagaggggaccaagaaactcatgcggatcacagctgagtggctgtggaaggaacttggaaagaaaaagacccccagaatgtgtacacgggaggaatttacccgcaaagtgagatccaatgccgcgctgggcgccattttcacagatgagaacaagtggaaaagcgctcgggaagccgtcgaggactctcgcttttgggagctcgttgatagagaacggaatctgcacctggaggggaagtgcgaaacctgtgtgtacaacatgatgggaaaacgcgagaagaagctcggcgagttcggcaaagctaaggggtccagagccatctggtatatgtggctgggagcccggtttcttgagttcgaggcgctgggctttctcaatgaagaccattggttcagccgcgggaactccctgagcggagtggagggcgaagggcttcacagactgggctacattctccgggatgtctctaaaaaggagggaggcgctatgtacgccgacgatacggccgggtgggacacccgcatcacactggaagacctgaaaaatgaggagatggtgaccaaccatatgaagggagaacacaagaaactcgctgaggccatttttaagctgacatatcaaaataaagttgtgagagtccagcggcctacccccagaggcacggtgatggatatcatcagcagaaaggaccagcgggggtccggacaggttggcacatacgggcttaacaccttcacaaatatggaagctcaactgattagacagatggagggcgagggaatcttcaaatctattcagcatctcaccgtgacggaagagatcgccgtccaaaactggctggcgcgcgtgggccgggaaagacttagccgcatggccatttccggggatgactgcgttgtgaagccgctggatgaccggtttgcttctgccctcaccgctctgaatgatatgggaaaggtcagaaaagacatccagcagtgggagcctagccgcggctggaacgattggacacaggtgcccttctgctcccaccactttcatgaactggtcatgaaggacgggcgggtgctcgttgtgccctgtagaaatcaagatgagctgatcggacgcgcccggatttctcagggcgcggggtggagccttaaagagaccgcctgcctgggcaagtcctatgctcagatgtggacactcatgtacttccacagacgcgacctgcggcttgccgctaacgccatctgtagcgctgtcccttctcattgggtgccgacctccagaacaacctggagcattcacgccaaacacgaatggatgacgacagaggatatgctggcggtgtggaaccgggtttggatccaggaaaatccctggatggaggacaagacccctgtggaatcttgggaggaggtcccctatctcggaaagagagaagaccaatggtgcggctccctgattgggctgaccagccgcgccacatgggctaaaaacatccagaccgccattaatcaggtgcggtccctcatcggaaacgaggaatacacagattatatgccttctatgaagagatttcgcagagaggaagaggaggccggcgttctgtgg

SEQ ID NO: 20272 - RNA, 9876 nt, synthetic construct
  misc_feature 1..9876: note = derived and/or modified CDS sequence (opt5) from DENV-2__KU365901__SS-prME
  source 1..9876: mol_type = other RNA
accgccggcatcattatcatgatgattcccaccgtgatggctttccacctcacgaccagaaacggggagcctcatatgatcgtgagccggcaggaaaaggggaaatccctcctgtttaagaccgagaatggcgttaacatgtgcacccttatggccatggacctgggggaactctgtgaggataccattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcacccaggagctgaatcatattctcagcgagaacgaagtgaaactgacaatcatgaccggagacatcaagggcattatgcaggccgggaaacggtccctgagaccgcaacctacagagcttaagtacagctggaaaacctggggaaaggcgaagatgctctctacggaactgcacaatcataccttcctgatcgatggccccgagacagccgaatgccctaacaccaatcgcgcttggaactccctcgaggttgaggactatgggtttggagtgttcacaaccaatatttggctgaaacttaaggaaaaacaggatgtcttttgtgacagcaagctgatgtctgccgctatcaaagacaaccgggccgtgcacgcggatatgggctactggattgagtccgccctcaacgacacatggaagatcgaaaaggctagcttcatcgaggtgaaatcttgcaattggcccaagagccacaccctgtggtccaacggcgtcctggagagcgaaatgattatccctaaaaatttcgccgggcccgtttctcagcataactatagaccgggataccacacgcagacagctggcccttggcatcttgggcgcctcgagatggattttgagttctgtgagggaaccaccgtggtggtcacagaagactgcggcaatcgggggccctccctgagaaccacgacagccagcggaaagctgattaccgagtggtgctgtcggtcctgcacactgccccctctgcgctacagaggcgaggatggctgttggtatgggatggaaatccggccgcttaaagagaaggaagagaacctggtcaattctctcgttaccgccggacacggccaaattgacaactttagcctgggggtgctgggaatggctcttttcctcgaagagatgctgagaacacgcgtcggcaccaagcatgcgatcctgctcgtggccgttacgtttgtgaccctgattacagggaatatgtccttccgggatcttggaagagtcatggtgatggttggcgctaccatgacagacgatatcggcatgggggtgacctacctggccctcctggccgcttttaaagtccgccccacgttcgccgcgggactgcttctgagaaagctcacatctaaagagctgatgatggctaccatcggcattgtgctcctgagccagtccacaatccctgaaaccattcttgagctgaccgacgccctcgccctggggatgatggtgctgaagatcgtccggaacatggaaaaatatcagcttgctgttacaattatggccatcctgtgcgtgcccaatgcggtgatcctccaaaacgcttggcgcgtctcttgtacgaccctggccgtggttagcgtgtcccctctcctgcttacaagctctcagcagaaggccgattggattcccctggctctcaccatcaagggactgaatcctacagccatttttctgaccacgctttccagaacaagcaaaaagcggtcttggcccctgaacgaggctatcatggccgtcggcatggtgtccattctcgcgagctctctgctcaaaaatgacatcccgatgaccgggcctctggttgccggaggccttctgaccgtgtgctacgtcctgacaggccgctccgctgatctcgaactggagagagccgctgacgtgcggtgggaggaacaggccgagatcagcgggtccagccccattctttctatcaccattagcgaagacggatccatgtctatcaagaacgaggaggaagaacaaacactgacgattctcatccgcaccggcctgctcgtcattagcgggctgttccctgtgtccatccccatcacagccgctgcgtggtatctttgggaagttaaaaagcagagagccggagtgctgtgggatgtcccgtctcctccccctgtgggcaaagctgagctggaagacggggcctaccggattaagcagaagggaatcctcggctatagccagattggcgccggggtttacaaagagggaacctttcacacaatgtggcacgtgacccgcggcgctgtcctgatgcataaggggaaaagaatcgagccctcctgggccgatgtgaagaaagaccttatttcttacggaggcgggtggaagctggaaggagagtggaaggaaggcgaggaagtgcaagttctcgcgctggagcccggcaaaaaccctcgggctgtccagacgaagccgggactcttcaaaaccaatacaggaaccatcggcgccgtgagcctggatttttcccccgggacaagcggatctcctatcgtggacaagaaaggcaaggtcgtggggctttatggaaacggcgttgtgaccagatccggcacatacgtcagcgccattgctcagacggagaagtctatcgaagataatcccgagattgaagacgatatcttccgcaaaaagcggctgaccattatggacctgcaccctggggccggaaaaacaaagagatatctccccgcgatcgtgcgcgaggctatcaaacggggcctgagaacccttattctggcccctacccgcgttgtggccgctgaaatggaggaggccctccgggggctgccgatcagataccagacacccgctattcgcgccgaacatacgggacgggagatcgtcgatctcatgtgtcacgcgaccttcacaatgagactgctttcccctattcgggtgcccaactataatctgatcattatggacgaagcccattttaccgatcctgctagcatcgccgctcgcggctacatctccacaagagttgagatgggggaggccgccggcattttcatgaccgctacgcccccgggatctcgggacccttttccccaaagcaacgcgcccatcatggacgaagaacgcgaaattcctgagagatcctggaatagcggccacgaatgggtgacagatttcaaggggaagaccgtctggtttgtgccctctatcaaagccggaaacgacattgctgcctgcctgcggaagaatggcaaaaaggtgatccagctctccagaaaaaccttcgatagcgagtatatcaagacacgcaccaacgactgggattttgtcgttacaaccgacatttctgagatgggggccaatttcaaggctgaacgggtgatcgatcctagacgctgtatgaaaccggtgattctgacggacggagaggaacgggtcatccttgccggccccatgcctgtgacacacagctccgcggctcagagacgcgggcgggttggcagaaaccccaagaatgagaacgatcaatacatttacatgggagaacctctggagaatgacgaggattgcgcccattggaaagaagccaagatgctcctggacaacatcaacacccccgagggcatcattccgtctatgtttgaacctgagcgcgaaaaagtggacgctatcgatggggagtatagactgcggggagaggcccgcaagacattcgtcgacctcatgagacggggcgatcttcccgtgtggctggcgtaccgcgttgccgctgaagggattaattatgccgacagacggtggtgttttgatggagtgaaaaacaatcagatcctggaggaaaacgtcgaggtggagatttggaccaaggaaggcgagagaaagaaactcaagcctcgctggctggacgctcggatctacagcgatccccttgccctgaaagagttcaaggagttcgctgccgggagaaaatccctcacgctgaatctgattaccgaaatgggccgcctccctacatttatgacccagaaggcgcggaacgcccttgacaatctggctgtcctgcacacagccgaggctggaggcagagcctataaccatgccctctctgagctgcccgaaacccttgagacactgctcctgctgaccctccttgctacggtgacagggggaatcttcctgtttctgatgagcggcaaggggatcggaaaaatgaccctcggcatgtgctgcattatcaccgcgtccattctgctttggtacgcccagatccaaccgcactggattgctgccagcatcatcctggagttctttctcattgttctgctgatccctgagcccgaaaagcagcggacaccccaggataatcagctcacctatgtggtgattgccatccttacagtcgttgctgccacgatggcgaacgagatgggcttcctggagaaaaccaagaaagactttgggctgggatctattacaacccaacagcctgaatccaatatcctcgatatcgacctgcgcccggccagcgcttggacactttacgccgtggctaccacgttcattacccccatgctgagacactccatcgagaactctagcgtgaatgtctccctcacagccattgcgaaccaggccaccgtgctgatgggcctggggaagggatggcctctctctaagatggatatcggcgttccccttctggctattgggtgttacagccaggtgaatcctatcacactgaccgccgctctcctgcttctggtcgcccattatgctattatcggacccggcctccaagccaaagcgacgcgggaagcccagaagcgcgctgccgctggcatcatgaaaaaccctacagtggacgggattaccgtcatcgacctggatccgattccctacgaccctaagtttgagaaacagctgggacaggtgatgctccttgttctgtgcgtgacacaagtcctgatgatgagaaccacctgggccctctgtgaagccctgacacttgcgacgggccccatctccaccctgtgggaggggaatcctggacggttctggaacacaaccattgctgtgagcatggccaacatctttcgcggctcttatctcgctggggccggactgctgttctccatcatgaagaatacagccaacaccagacggggcacgggcaatacaggggagaccctcggagaaaagtggaaaaaccgccttaatgctctgggcaagagcgagtttcagatttacaaaaagtctgggatccaggaagttgatagaaccctggccaaagagggaattaagcggggcgagacagaccaccatgcggtgtccagagggagcgccaaactccgctggttcgtcgaacggaacctggtgacccccgagggaaaggtggttgatcttggctgcggcagagggggatggtcttattactgtggcgggctgaagaatgtcaaagaagtgaagggactcacaaaaggcgggccgggacacgaggaacctatccccatgagcacgtatggctggaacctggtgcgcctgcaatccggcgtcgacgttttctttacaccccctgagaagtgcgatacactcctttgtgacattggggagtctagccccaatcctaccgtggaagctggacggacactgagagtgctgaacctcgtcgagaattggctgaacaataacacccagttctgcatcaaagtgcttaatccgtacatgccctccgttatcgaaaagatggaggccctgcagcgcaagtacggcggggctctcgtgcggaaccctctgagcagaaactccacgcatgaaatgtattgggtctctaatgccagcggaaacattgtgtcctctgttaatatgatcagccgcatgctgattaaccggtttaccatgagacacaaaaaggcgacatacgagcccgatgtggacctcggctccgggacccgcaatatcggaattgagtctgaaacacctaaccttgatatcatcggcaaacggattgagaagatcaaacaggaacacgagaccagctggcattatgaccaagatcacccctacaagacatgggcctatcatggctcctacgaaaccaagcagacggggagcgcttcttccatggtcaatggagtggtgagactgctgacaaaaccgtgggacgtcattcctatggttacccagatggccatgaccgacacaacgcccttcggccagcaacgcgtgtttaaggagaaagtggataccagaacacaggagcctaaggaagggaccaaaaagctcatgaagatcacagctgagtggctgtggaaagaacttggacggaagaaaacaccccgcatgtgtacaagagaggagttcacccggaaggtcagaagcaacgccgctctgggcgccatttttacggacgaaaataaatggaagtctgcgcgggaggccgtggaagattccgggttctgggagctcgttgacaaagaacgcaacctgcacctggagggaaagtgcgagacctgtgtgtataatatgatgggcaagagagagaaaaagctcggcgaatttgggaaagctaagggaagccgggccatctggtacatgtggctgggcgctcgcttccttgaatttgaggccctggggttcctcaacgaagatcactggttttctagagaaaattccctgagcggagtcgagggcgaagggcttcataaactgggctacattctccgggacgtgtccaagaaggagggaggcgccatgtatgcggatgacacagctgggtgggatacccgcatcacactggaagacctgaaaaacgaggaaatggttaccaatcacatggagggagagcataagaaactcgccgaagccatcttcaagctgacgtaccagaacaaagtggtcagagtgcagcggcctacaccccgcggcaccgttatggatattatcagcagacgggaccaacgcgggtctggacaggtggtcacatatggccttaacaccttcacgaatatggaggctcagctgattagacaaatggaaggggagggcgtgtttaagagcatccagcagctcaccgtcacagaggaaattgccgtgaagaactggctggctcgggttggacgcgagagactttcccggatggccatctctggcgacgattgcgtggtcaaaccgctggacgatagattcgcgagcgccctcaccgctctgaatgacatggggaaggtgcgcaaagatatccagcaatgggaaccttcccggggatggaacgactggacacaggtgcccttttgctctcaccatttccacgagctgattatgaaggatggcagagttctcgtggtcccctgtcgcaatcaggacgaactgatcgggcgggccagaattagccagggagctggctggtcccttcgcgagaccgcctgcctggggaaatcttacgcgcaaatgtggagcctcatgtattttcaccggagagatctgcgccttgccgctaacgccatctgttccgctgtgcctagccattgggttccgacatctcggaccacgtggtccattcacgccacacatgagtggatgaccaccgaagacatgctgacagtgtggaatagagtctggatccaggagaacccctggatggaagataagacccctgtggagagctgggaagagatcccctacctcggcaagcgcgaggaccagtggtgcggatctctgattggcctgacatcccgggctacgtgggccaaaaatatccagaccgcgattaaccaagtcagaagcctcatcgggaatgaagagtatacagattacatgccttccatgaagcggttcagacgcgaagaggaagaggccggagtgctgtggtga

SEQ ID NO: 20273 - RNA, 9876 nt, synthetic construct
  misc_feature 1..9876: note = derived and/or modified CDS sequence (opt5) from DENV-2__GQ398258__SS-prME
  source 1..9876: mol_type = other RNA
accgccggaatgatcattatgctgatccccaccgtgatggctttccacctcacgaccagaaatggggaacctcatatgattgtcagccggcaggaaaagggaaaatccctgctttttaagaccgaagacggcgttaatatgtgcaccctgatggccatggatctcggggaactgtgtgaagacacgatcacctacaactgcccccttctgcgccaaaatgaacccgaagatattgactgttggtgcaactctacaagcacctgggtgacgtatggaacctgtacagcgaccggcgagcacagacgggaaaaacgctccgtggctctcgtccctcatgtggggatgggactggagacaagaaccgaaacgtggatgtctagcgagggcgcctggaagcacgcccagcggatcgagacatggatcctgcgccatcccggcttcaccattatggctgccatcctcgcttacacaattgggaccacctattttcagagagttctgatcttcattcttctgacagccgtggcgccttccatgacgatgcggtgcatcggaatttctaatcgcgattttgtcgaaggcgtgagcgggggatcctgggttgacatcgtgctcgagcacggcagctgtgtcaccacaatggccaaaaacaagcccaccctggatttcgaacttatcaagacagaggctaaacagcctgccaccctgagaaagtactgcattgaagctaaactcacgaatacaaccaccgcctctcggtgtccgacacaaggggagccctccctgaacgaggaacaggacaagcgctttgtgtgcaaacacagcatggtggatagaggatggggcaatggctgtgggctgttcggaaagggcgggatcgtgacctgcgcgatgtttacatgcaagaaaaacatggagggaaaggttgtgcagcctgaaaatctcgagtatacgattgtgatcacaccccattctggcgaagagaacgccgtcgggaatgacacaggaaaacacggcaaggagattaaaatcacccctcagtccagcatcacagaagctgagctgaccggctacgggacggtgaccatggaatgttctccccggacaggacttgatttcaacgagatggttctgctccaaatggaaaataaggcctggctggtgcatcgccagtggtttcttgacctgccgctcccttggctgcccggcgctgatacccaggggtccaactggattcagaaagagacactggtcaccttcaagaaccctcacgccaagaaacaagacgtggttgtgctcggaagccaggagggcgccatgcacacggctctgacaggggcgaccgaaatccagatgtcctctggcaatcttctgtttacaggacatctcaagtgcagactgcggatggacaaacttcaactgaagggcatgagctattccatgtgtaccgggaaattcaaggtcgtgaaggagattgccgaaacccagcacggaacaatcgtcattagagtgcagtacgagggcgatgggagcccctgcaaaatccccttcgagatcatggacctcgaaaagcgccatgttctgggacggctgattacggtgaaccctatcgtcaccgagaaagattctccggtgaatattgaagctgagcccccttttggcgactcctacatcattatcggggttgaacccggccagctcaagctgaactggttcaaaaagggaagctctattggccaaatgtttgagacaaccatgagaggggccaagcgcatggccatccttggagatacagcttgggacttcggcagcctcggcggggtgtttacctccatcgggaaagccctccaccaggtcttcggggcgatttatggcgctgccttttctggagtgagctggacgatgaagatcctgattggcgtggttatcacatggattgggatgaactcccggagcacctctctgtccgtcagccttgtgctcgtgggagtcgtgaccctgtacctgggcgttatggtgcaggccgattctgggtgtgtcgtgtcctggaaaaacaaggagctcaaatgcggaagcggcatcttcatcacagacaatgttcatacctggacagaacagtataagtttcaacctgagtccccctctaagctggctagcgccattcagaaagctcacgaagaggggatctgtggcattagatccgtgacgcgccttgaaaacctgatgtggaagcagatcaccccggagctcaatcacattctgtctgagaacgaagtcaaactgacaatcatgaccggagatatcaagggcattatgcaggccgggaaacggagccttagacctcaacccacagagctcaagtactcctggaaaacctggggaaaggcgaagatgctgagcacggaactgcataatcagaccttcctcatcgacggccctgagacagccgaatgccccaacaccaatcgcgcttggaactctctggaggtggaggattatgggtttggagttttcacaaccaatatttggcttaaactgaaggaacggcaggacgtgttttgtgaccctaaactcatgtccgccgctatcaaggataacagagccgtccacgcggacatgggctactggattgagagcgccctgaacgatacatggaaaatcgaaaaggcttctttcatcgaggtgaagtcctgccattggcccaaaagccacaccctgtggtctaatggcgtgcttgagagcgaaatgattatcccgaagaacttcgccgggcctgtctcccagcacaattatcgccccggataccatacgcaaacagctggcccctggcacctcgggaaactggagatggactttgatttctgtgaaggaaccaccgttgtggtgacagaggactgcggcaaccgggggcctagcctgagaaccacgacagcctctggaaagctcattaccgaatggtgctgtcggtcctgcacactgccgccccttcgctacaaaggcgaggatggctgttggtatgggatggagatcagacctctgaaggaaaaggaggaaaatctcgtcaacagcctggtgaccgccggacatggccagattgacaatttttccctgggggttcttggaatggctctcttcctggaggaaatgctgcggacaagagtgggcaccaaacacgcgatcctcctggtcgccgtgtcttttgttacgcttattaccgggaacatgagcttccgcgatctgggacgggtgatggtcatggtgggcgctacaatgaccgacgatatcggcatgggggttacatacctcgccctgctggccgcttttaaggtgagacccaccttcgccgcgggacttctgctccgcaaactgacgtccaaggagctcatgatgacaaccatcggcattgtcctgctttctcagagcacaatccctgagaccattctggaactcaccgacgctctggccctggggatgatggtgcttaaaatcgtgaagaatatggagaagtatcaactggccgtcacaattatggctatcctctgcgttcccaacgccgtgatcctgcagaatgcgtggaaagtgtcctgtacgattctcgctgtcgtgtctgttagccctctgcttctgacctccagccagcagaaggccgattggatccccctcgccctgacaattaaaggactgaacccgaccgctatctttcttacaaccctgtctagaacgtccaagaaacggagctggcctctcaatgaagccattatggctgtgggcatggtctctatcctggcctccagcctcctgaagaacgacatccccatgacagggcctcttgtggcgggaggcctgctgaccgtttgctacgtgctcaccggccgctctgccgacctggagcttgaaagagctgccgatgtccggtgggaggaccaagctgagatttccgggagctcccccatcctgagcattacaatctctgaagatggaagcatgtccattaaaaatgaggaagaggagcagaccctcacaatcctgattcgcacgggcctcctggtgatctctgggcttttcccggtcagcatccctattaccgccgccgcttggtatctgtgggaagtgaagaagcagagagcgggagttctgtgggacgtgccctcccctccgcccgtcggcaaagccgagctcgaagatggggcttaccggatcaagcagaaaggcattctgggctattctcaaatcggcgccggggtgtacaaggagggaacatttcataccatgtggcacgttacacgcggcgccgtgcttatgcacaaagggaagagaattgaacctagctgggctgacgtcaagaaagatctgatctcctacggaggcgggtggaagctcgagggagagtggaaagaaggcgaggaagtccaggtgctggccctcgagccgggcaagaacccccgggcggttcagaccaaacctgggctgttcaagacgaacaccggaacaatcggcgctgtctctcttgactttagccccgggacctccggaagccctattgtggataagaaaggcaaggtggtcgggctgtatggaaatggcgtggttacacgctctggcacctacgtgtccgccatcgcccagacagaaaagagcattgaggacaaccccgagatcgaggatgacattttcagaaagaaacggctgacgatcatggatctccatcctggggctggaaagaccaagagatatctgccggccatcgtccgcgaggcgattaaacggggccttagaacactgatcctcgctcccacccgcgtggttgccgccgaaatggaggaagctctgcgggggctccctattagataccaaacccccgccatccgcgctgagcacacaggacgggagattgtggacctgatgtgtcatgccacgttcaccatgagacttctgtctcctgtccgcgtgcccaattataacctgatcattatggacgaagcgcactttacagatccggcctccatcgctgcccggggctacatcagcaccagagttgagatgggggaagctgccggcattttcatgacagccacccctcccggatcccgggacccctttcctcagtctaatgctcccatcatggatgaggagcgcgaaattcctgagagaagctggaactccggccatgaatgggtgacggacttcaaggggaaaacagtctggtttgtgccgagcatcaaggcgggaaatgatattgccgcttgcctccggaaaaacggcaagaaggtgatccagctgtctcgcaaaaccttcgactccgagtatatcaagaccagaacaaatgattgggactttgtcgttaccacagatattagcgaaatgggggccaacttcaaagccgagcgggtgatcgaccccagacgctgtatgaagcctgtgattcttaccgatggagaggaacgggtcatcctggctggccccatgcctgtgacgcactctagcgccgcgcaaagacgcgggcggattggcagaaatcccaaaaacgagaatgaccagtacatctacatgggagaaccgctcgagaacgacgaagattgcgctcactggaaggaggccaaaatgctgctggacaatatcaacacacctgagggcattatcccctccatgtttgaacctgagcgcgaaaaggttgatgccattgacggggagtatcggctcagaggagaagctcgcaagaccttcgtggatcttatgagacggggcgacctgcccgtctggctggcctaccgcgtggcggccgaggggatcaactatgctgatagacggtggtgttttgacggaattaaaaataaccagatcctcgaggaaaatgttgaggtggaaatttggacaaaggagggcgagcgcaaaaagctgaaacctagatggcttgatgcccggatctactctgaccccctggctctcaaggagttcaaggagttcgccgctgggagaaaaagcctgaccctgaacctcatcacggaaatgggccgccttccgacctttatgacacagaaggcccggaatgcgctggataacctggccgtcctccataccgctgaggccggaggcagagcttataatcacgccctgtccgaacttcctgagacactggagaccctcctgctgctcacacttctggccaccgtgacagggggaattttcctgtttctcatgtctggcaaagggatcggaaagatgacactgggcatgtgctgcattatcaccgctagcattcttctgtggtacgcgcaaatccagccccattggatcgccgcttccattatcctcgagttctttctgattgtcctgctcatccccgagcctgaaaaacagcgcaccccgcaggacaaccaacttacatatgtggttattgccatcctgaccgtggtggccgctacaatggccaatgagatgggcttcctggaaaagacgaagaaagattttgggctcggaagcatcgcgacccaccagcccgagtctaacattctggacatcgaccttcggcctgcctccgcttggacactgtacgccgtcgctaccacattcattacccccatgctcagacacagcatcgaaaattcctctgttaacgtgagcctgacggccattgcgaatcaggccaccgtgctgatgggcctcgggaagggatggcctctttccaaaatggatatcggcgtccccctgctggctattgggtgttactctcaggtgaaccctatcacactcaccgccgctctgcttctgctcgttgcccattatgctatcattggaccgggcctgcaagccaaggcgacacgggaagcccagaaacgcgctgccgctggcatcatgaagaatcccaccgtggacgggattacggtcatcgatctggaccctattccctacgatcctaagtttgagaaacagctcggacaggtgatgcttctggtcctgtgcgtgacacaagttctcatgatgagaaccacatgggccctgtgtgaagcccttaccctggcgaccggccccatcagcacactctgggaggggaacccgggacggttctggaatacgaccatcgctgtgtccatggccaacatttttcgcggcagctatctggctggggccggactgctgttctctatcatgaagaacacagccaataccagacggggcacaggcaacaccggggaaacgcttggagagaaatggaagaatcgcctgaacgctctgggcaaatccgagtttcagatttacaagaaaagcgggatccaggaagtcgacagaacactcgccaaggagggaattaagcggggcgaaaccgatcaccatgcggtgtctcgcgggtccgccaaactgagatggttcgttgagcggaatcttgtgacccctgagggaaaggtcgtggacctgggctgcggcagagggggatggagctattactgtggcgggctcaaaaacgtgcgcgaagttaagggactgacaaaaggcgggcccggacacgaggaacccatccctatgtctacctatggctggaatctggtccggctccaaagcggcgtggatgtgttctttacaccccctgagaagtgcgacacgcttctgtgtgatatcggggaatcctctccgaaccccaccgtcgaggctggaagaacactgcgcgttctcaatctggtggagaactggcttaataacaatacccagttctgcattaaggtgctgaacccttacatgcccagcgtcatcgagaagatggaggccctccagcggaagtacggcggggctctggtgagaaatcctctgtcccgcaacagcacacatgaaatgtattgggtttccaacgcctctggaaatattgtgagctccgtcaacatgatctctcggatgctcattaatagatttaccatgcgccacaaaaaggcgacgtacgagcccgacgtggatcttggcagcgggacccggaacatcggaatcgaatccgagacaccgaatctggacattatcggcaaaagaattgagaagatcaagcaggaacacgagacctcttggcattatgaccaagatcacccttacaaaacatgggcctatcatggcagctacgaaaccaagcagacagggtccgctagctctatggttaacggagtggtccgcctgctcaccaaaccctgggacgtgattcctatggtgacgcagatggccatgacagataccacccccttcggccagcaacgggtctttaaggagaaagttgacacaagaacgcaggaacctaaggaggggaccaagaaactgatgaagatcacagctgagtggctttggaaagaactgggaaagaaaaagacaccccgcatgtgtacaagagaggagttcacccggaaagtgcgctccaatgccgctctcggcgccatttttacagatgagaacaagtggaaaagcgcgagagaggccgtggaagactctcggttctgggagctggtcgataaagaaagaaatctgcacctcgaggggaagtgcgaaacctgtgtgtataacatgatgggaaaacgggagaagaaactgggcgagtttggcaaggctaaggggtcccgcgccatctggtacatgtggcttggagctagattcctggaatttgaggccctcggcttcctgaatgaagaccactggtttagccgggagaactctctttccggggttgaaggagagggcctgcataaactcgggtacatcctgcgcgatgtgagcaagaaagagggcggagccatgtatgcggacgatacggctggctgggacaccagaattacactggaagacctcaagaatgaggaaatggtcaccaaccacatggagggggaacataaaaagctggccgaggccatcttcaaacttacataccagaataaagtggttcgggtgcagcgcccgacccctagaggaacggtcatggatattatctcccggcgcgaccaaagaggcagcggacaggtgggaacatatggcctgaacaccttcacaaacatggaggctcagctcattcggcaaatggaaggggagggcgtttttaagtctatccagcacctgaccgtgacggaagagatcgccgtccagaattggcttgctcgcgtgggaagagagcggctgagccgcatggccatttccggcgatgactgcgtcgtgaaacccctcgatgacagattcgcgtctgccctgaccgctctgaacgatatggggaaggttcggaaagacatccagcaatgggaacccagcagaggatggaatgattggacacaggtgcctttttgctcccatcacttccacgagctcattatgaaggacggccgcgtcctggtggtgccgtgtcggaaccaggatgaacttatcgggagagcccgcatttctcagggagctggctggagcctgcgggagaccgcctgcctcgggaagtcctacgcgcaaatgtggtctctgatgtattttcatagacgcgaccttcggctggccgctaatgccatctgtagcgctgttccctcccactgggtgcctacaagcagaaccacatggtctatccatgcccgccacgaatggatgaccacggaggatatgctcacagtctggaaccgggtgtgggttcaggagaatccctggatggaagacaaaacccctgtggagtcctgggaagagattccctacctgggcaagagagaagaccagtggtgcggaagcctgatcggcctcacctctcgcgctacatgggccaaaaacattcagaccgcgatcaatcaagtccggtccctgattgggaacgaggagtatacagattacatgcctagcatgaagagattccggagagaagaggaagaggccggagtgctttggtga

SEQ ID NO: 20274 - RNA, 9876 nt, synthetic construct
  misc_feature 1..9876: note = derived and/or modified CDS sequence (opt5) from DENV-2__GQ398259__SS-prME
  source 1..9876: mol_type = other RNA
accgccggaatgatcattatgctgatccccaccgtgatggctttccacctcacgaccagaaatggggaacctcatatgattgtgagccggcaggaaaagggaaaatccctgctttttaagacggaagacggcgttaatatgtgcaccctgatggccatggatctcggggaactgtgtgaagacacaatcacctacaactgcccgcttctgcgccaaaatgaacccgaggatattgactgttggtgcaactctacaagcacctgggtgacgtatggaacctgtacagcgaccggcgagcacagacgggaaaaacgctccgtggctctcgtccctcatgtggggatgggactggagacaagaaccgaaacgtggatgtctagcgagggcgcctggaagcacgcccagcggatcgagacatggatcctgcgccatcccggcttcaccattatggctgccatcctcgcttacacaattgggaccacctattttcagagagttctgatcttcattcttctgacagccgtggcgccttccatgacgatgcggtgcatcggaatttctaatcgcgattttgtcgaaggcgtgagcgggggatcctgggttgacatcgtgctcgagcacggcagctgtgtcaccacaatggccaaaaacaagcccaccctggatttcgaacttatcaagacagaggctaaacagcctgccaccctgagaaagtactgcattgaagctaaactcacgaatacaaccaccgcctctcggtgtccgacacaaggggagccctccctgaacgaggaacaggacaagcgctttgtgtgcaaacacagcatggtggatagaggatggggcaatggctgtgggctgttcggaaagggcgggatcgtgacctgcgcgatgtttacatgcaagaaaaacatggagggaaaggttgtgcagcctgaaaatctcgagtatacgattgtgatcacaccccattctggcgaagagaacgccgtcgggaatgacacaggaaaacacggcaaggagattaaaatcacccctcagtccagcatcacagaagctgagctgaccggctacgggacggtgaccatggaatgttctccccggacaggacttgatttcaacgagatggttctgctccaaatggaaaataaggcctggctggtgcatcgccagtggtttcttgacctgccgctcccttggctgcccggcgctgatacccaggggtccaactggattcagaaagagacactggtcaccttcaagaaccctcacgccaagaaacaagacgtggttgtgctcggaagccaggagggcgccatgcacacggctctgacaggggcgaccgaaatccagatgtcctctggcaatcttctgtttacaggacatctcaagtgcagactgcggatggacaaacttcaactgaagggcatgagctattccatgtgtaccgggaaattcaaggtcgtgaaggagattgccgaaacccagcacggaacaatcgtcattagagtgcagtacgagggcgatgggagcccctgcaaaatccccttcgagatcatggacctcgaaaagcgccatgttctgggacggctgattacggtgaaccctatcgtcaccgagaaagattctccggtgaatattgaagctgagcccccttttggcgactcctacatcattatcggggttgaacccggccagctcaagctgaactggttcaaaaagggaagctctattggccaaatgtttgagacaaccatgagaggggccaagcgcatggccatccttggagatacagcttgggacttcggcagcctcggcggggtgtttacctccatcgggaaagccctccaccaggtcttcggggcgatttatggcgctgccttttctggagtgagctggacgatgaagatcctgattggcgtggttatcacatggattgggatgaactcccggagcacctctctgtccgtcagccttgtgctcgtgggagtcgtgaccctgtacctgggcgttatggtgcaggccgattctgggtgtgtcgtgtcctggaaaaacaaggagctcaaatgcggaagcggcatcttcatcacagacaatgttcatacctggacagaacagtataagtttcaacctgagtccccctctaagctggctagcgccattcagaaagctcacgaagaggggatctgtggcattagatccgtgacgcgccttgaaaacctgatgtggaagcagatcaccccggagctcaatcacattctgtctgagaacgaagtcaaactgacaatcatgaccggagatatcaagggcattatgcaggccgggaaacggagccttagacctcaacccacagagctcaagtactcctggaaaacctggggaaaggcgaagatgctgagcacggaactgcataatcagaccttcctcatcgacggccctgagacagccgaatgccccaacaccaatcgcgcttggaactctctggaggtggaggattatgggtttggagttttcacaaccaatatttggcttaaactgaaggaacggcaggacgtgttttgtgactccaaactcatgagcgccgctatcaaggataacagagccgtccacgcggacatgggctactggattgagtctgccctgaacgatacatggaaaatcgaaaaggcttccttcatcgaggtcaagtcctgccattggcctaaatctcacaccctgtggagcaatggcgtgcttgagtccgaaatgattatccccaagaacttcgccgggccggtcagccagcacaattatcgccctggataccatacgcaaacagctggcccctggcacctcgggaaactggagatggactttgatttctgtgaaggaaccaccgttgtggtgacagaggactgcggcaaccgggggccctctctgagaaccacgacagcctccggaaagctcattaccgaatggtgctgtcggagctgcacactgcctccgcttcgctacaaaggcgaggatggctgttggtatgggatggagatcagacccctgaaggaaaaggaggaaaatctcgtcaactccctggtgaccgccggacatggccagattgacaatttttctctgggggttcttggaatggctctcttcctggaggaaatgctgcggacaagagtgggcaccaaacacgcgatcctcctggtcgccgtgagctttgttacgcttattaccgggaacatgtccttccgcgatctgggacgggtgatggtcatggtgggcgctacaatgaccgacgatatcggcatgggggttacatacctcgccctgctggccgcttttaaggtgagacctaccttcgccgcgggacttctgctccgcaaactgacgtctaaggagctcatgatgacaaccatcggcattgtcctgcttagccagtccacaatccccgagaccattctggaactcaccgacgctctggccctggggatgatggtgcttaaaatcgtgaagaatatggagaagtatcaactggccgtcacaattatggctatcctctgcgttcctaacgccgtgatcctgcagaatgcgtggaaagtgtcttgtacgattctcgctgtcgtgagcgttagccccctgcttctgaccagctctcagcagaaggccgattggatccctctcgccctgacaattaaaggactgaaccccaccgctatctttcttacaaccctgtccagaacgagcaagaaacggtcttggccgctcaatgaagccattatggctgtgggcatggtctccatcctggccagctctctcctgaagaacgacatccctatgacagggccccttgtggcgggaggcctgctgaccgtttgctacgtgctcaccggccgctccgccgacctggagcttgaaagagctgccgatgtccggtgggaggaccaagctgagattagcgggtccagccctatcctgtctattacaatcagcgaagatggatccatgtctattaaaaatgaggaagaggagcagaccctcacaatcctgattcgcacgggcctcctggtgatcagcgggcttttccccgtctccatcccgattaccgccgccgcttggtatctgtgggaagtgaagaagcagagagcgggagttctgtgggacgtgccttctccccctcccgtcggcaaagccgagctcgaagatggggcttaccggatcaagcagaaaggcattctgggctatagccaaatcggcgccggggtgtacaaggagggaacatttcataccatgtggcacgttacacgcggcgccgtgcttatgcacaaagggaagagaattgaaccctcctgggctgacgtcaagaaagatctgatctcttacggaggcgggtggaagctcgagggagagtggaaagaaggcgaggaagtccaggtgctggccctcgagcctggcaagaacccgcgggcggttcagaccaaacccgggctgttcaagacgaacaccggaacaatcggcgctgtcagccttgacttttcccctgggaccagcggatctcccattgtggataagaaaggcaaggtggtcgggctgtatggaaatggcgtggttacacgctccggcacctacgtgagcgccatcgcccagacagaaaaatctattgaggacaaccctgagatcgaagatgacattttcagaaagaaacggctgacgatcatggatctccatcccggggctggaaagaccaagagatatctgcctgccatcgtccgcgaggcgattaaacggggccttagaacactgatcctcgctccgacccgcgtggttgccgccgaaatggaggaagctctgcgggggctccccattagataccaaacccctgccatccgcgctgagcacacaggacgggagattgtggacctgatgtgtcatgccacgttcaccatgagacttctgtcccccgtccgcgtgcctaattataacctgatcattatggacgaagcgcactttacagatcccgccagcatcgctgcccggggctacatctccaccagagttgagatgggggaagctgccggcattttcatgacagccaccccgcctggatctcgggacccctttccccagagcaatgctcctatcatggatgaggagcgcgaaattcccgagagatcctggaacagcggccatgaatgggtgacggacttcaaggggaaaacagtctggtttgtgccttctatcaaggcgggaaatgatattgccgcttgcctccggaaaaacggcaagaaggtgatccagctgtcccgcaaaaccttcgacagcgagtatatcaagaccagaacaaatgattgggactttgtcgttaccacagatatttctgaaatgggggccaacttcaaagccgagcgggtgatcgacccgagacgctgtatgaagcccgtgattcttaccgatggagaggaacgggtcatcctggctggccctatgcccgtgacgcacagctccgccgcgcaaagacgcgggcggattggcagaaatcctaaaaacgagaatgaccagtacatctacatgggagaacccctcgagaacgacgaagattgcgctcactggaaggaggccaaaatgctgctggacaatatcaacacaccggagggcattatcccttctatgtttgaacccgagcgcgaaaaggttgatgccattgacggggagtatcggctcagaggagaagctcgcaagaccttcgtggatcttatgagacggggcgacctgcctgtctggctggcctaccgcgtggcggccgaggggatcaactatgctgatagacggtggtgttttgacggaattaaaaataaccagatcctcgaggaaaatgttgaggtggaaatttggacaaaggagggcgagcgcaaaaagctgaaacccagatggcttgatgcccggatctacagcgaccctctggctctcaaggagttcaaggagttcgccgctgggagaaaatccctgaccctgaacctcatcacggaaatgggccgccttcccacctttatgacacagaaggcccggaatgcgctggataacctggccgtcctccataccgctgaggccggaggcagagcttataatcacgccctgtctgaacttccggagacactggagaccctcctgctgctcacacttctggccaccgtgacagggggaattttcctgtttctcatgagcggcaaagggatcggaaagatgacactgggcatgtgctgcattatcaccgcttccattcttctgtggtacgcgcaaatccagcctcattggatcgccgctagcattatcctcgagttctttctgattgtcctgctcatccccgagcccgaaaaacagcgcacccctcaggacaaccaacttacatatgtggttattgccatcctgaccgtggtggccgctacaatggccaatgagatgggcttcctggaaaagacgaagaaagattttgggctcggatctatcgcgacccaccagccggagtccaacattctggacatcgaccttcggcccgccagcgcttggacactgtacgccgtcgctaccacattcattacccctatgctcagacactccatcgaaaattctagcgttaacgtgtccctgacggccattgcgaatcaggccaccgtgctgatgggcctcgggaagggatggcccctttctaaaatggatatcggcgtccctctgctggctattgggtgttacagccaggtgaaccccatcacactcaccgccgctctgcttctgctcgttgcccattatgctatcattggacctggcctgcaagccaaggcgacacgggaagcccagaaacgcgctgccgctggcatcatgaagaatccgaccgtggacgggattacggtcatcgatctggaccccattccttacgatcccaagtttgagaaacagctcggacaggtgatgcttctggtcctgtgcgtgacacaagttctcatgatgagaaccacatgggccctgtgtgaagcccttaccctggcgaccggccctatctccacactctgggaggggaaccccggacggttctggaatacgaccatcgctgtgagcatggccaacatttttcgcggctcttatctggctggggccggactgctgttctccatcatgaagaacacagccaataccagacggggcacaggcaacaccggggaaacgcttggagagaaatggaagaatcgcctgaacgctctgggcaaaagcgagtttcagatttacaagaaatctgggatccaggaagtcgacagaacactcgccaaggagggaattaagcggggcgaaaccgatcaccatgcggtgtcccgcgggagcgccaaactgagatggttcgttgagcggaatcttgtgaccccggagggaaaggtcgtggacctgggctgcggcagagggggatggtcttattactgtggcgggctcaaaaacgtgcgcgaagttaagggactgacaaaaggcgggcctggacacgaggaacccatccccatgagcacctatggctggaatctggtccggctccaatccggcgtggatgtgttctttacacctcccgagaagtgcgacacgcttctgtgtgatatcggggaatctagccctaacccgaccgtcgaggctggaagaacactgcgcgttctcaatctggtggagaactggcttaataacaatacccagttctgcattaaggtgctgaacccctacatgccttccgtcatcgagaagatggaggccctccagcggaagtacggcggggctctggtgagaaatcccctgagccgcaactccacacatgaaatgtattgggtttctaacgccagcggaaatattgtgtcctctgtcaacatgatcagccggatgctcattaatagatttaccatgcgccacaaaaaggcgacgtacgagcctgacgtggatcttggctccgggacccggaacatcggaatcgaatctgagacacccaatctggacattatcggcaaaagaattgagaagatcaagcaggaacacgagaccagctggcattatgaccaagatcacccgtacaaaacatgggcctatcatggctcctacgaaaccaagcagacagggagcgcttcttccatggttaacggagtggtccgcctgctcaccaaaccttgggacgtgattcccatggtgacgcagatggccatgacagataccacccctttcggccagcaacgggtctttaaggagaaagttgacacaagaacgcaggaacccaaggaggggaccaagaaactgatgaagatcacagctgagtggctttggaaagaactgggaaagaaaaagacccctcgcatgtgtacaagagaggagttcacccggaaagtgcgcagcaatgccgctctcggcgccatttttacagatgagaacaagtggaagtctgcgagagaggccgtggaagactcccggttctgggagctggtcgataaagaaagaaatctgcacctcgaggggaagtgcgaaacctgtgtgtataacatgatgggaaaacgggagaagaaactgggcgagtttggcaaggctaaggggagccgcgccatctggtacatgtggcttggagctagattcctggaatttgaggccctcggcttcctgaatgaagaccactggttttctcgggagaactcccttagcggggttgaaggagagggcctgcataaactcgggtacatcctgcgcgatgtgtccaagaaagagggcggagccatgtatgcggacgatacggctggctgggacaccagaattacactggaagacctcaagaatgaggaaatggtcaccaaccacatggagggggaacataaaaagctggccgaggccatcttcaaacttacataccagaataaagtggttcgggtgcagcgccccaccccgagaggaacggtcatggatattatcagccggcgcgaccaaagaggctctggacaggtgggaacatatggcctgaacaccttcacaaacatggaggctcagctcattcggcaaatggaaggggagggcgtttttaagagcatccagcacctgaccgtgacggaagagatcgccgtccagaattggcttgctcgcgtgggaagagagcggctgtcccgcatggccatttctggcgatgactgcgtcgtgaaacctctcgatgacagattcgcgagcgccctgaccgctctgaacgatatggggaaggttcggaaagacatccagcaatgggaaccctccagaggatggaatgattggacacaggtgcccttttgctctcatcacttccacgagctcattatgaaggacggccgcgtcctggtggtgccttgtcggaaccaggatgaacttatcgggagagcccgcattagccagggagctggctggtccctgcgggagaccgcctgcctcgggaagtcttacgcgcaaatgtggagcctgatgtattttcatagacgcgaccttcggctggccgctaatgccatctgttccgctgttccgagccactgggtgcccacatctagaaccacatggtccatccatgcccgccacgaatggatgaccacggaggatatgctcacagtctggaaccgggtgtgggttcaggagaatccttggatggaagacaaaacccccgtggagagctgggaagagattccttacctgggcaagagagaagaccagtggtgcggatctctgatcggcctcacctcccgcgctacatgggccaaaaacattcagaccgcgatcaatcaagtccggagcctgattgggaacgaggagtatacagattacatgccctccatgaagagattccggagagaagaggaagaggccggagtgctttggtga

SEQ ID NO: 20275 - RNA, 9876 nt, synthetic construct
  misc_feature 1..9876: note = derived and/or modified CDS sequence (opt5) from DENV-2__GQ398268__SS-prME
  source 1..9876: mol_type = other RNA
accgccggcatgatcattatgctgatccccacagtgatggctttccacctcacgaccagaaatggggaacctcatatgattgtcagccggcaggaaaagggaaagtccctgctttttaagacagaggacggcgttaatatgtgcaccctgatggccatggatctcggggaactgtgtgaggacacaatcacctacaagtgcccgcttctgcgccaaaacgaacccgaggatattgactgttggtgcaattctacaagcacctgggtgacgtatggaacctgtacaaccacaggcgagcaccggcgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacaattatggccgctatcctcgcctacaccattgggaccacacactttcagagagctctgatcttcattcttctgacggccgttgcgccttccatgaccatgcggtgcatcggaatttctaaccgcgattttgtggaaggcgtcagcgggggatcctgggtggacatcgttctcgagcacggcagctgtgtgacaaccatggccaagaataagcccacactggatttcgaacttatcaaaaccgaggctaagcagcctgccacgctgagaaaatattgcattgaagctaagctcacaaacaccaccacagagtctcggtgtccgacccaaggggagccctccctgaatgaagaacaggacaaacgctttgtctgcaagcatagcatggtggatagaggatggggcaacggctgtgggctgttcggaaagggcgggatcgtgacatgcgccatgtttacgtgcaaaaagaatatggaaggaaaagtcgttcagcctgagaacctcgaatacaccattgtgatcacaccccactctggcgaggagcatgcggtggggaatgacaccggaaagcacggcaaagaaattaagatcacacctcagtccagcatcaccgaggccgaactgacgggctatgggaccgtcacaatggagtgttctccccggaccggacttgatttcaacgaaatggtgctgctccaaatggagaataaggcttggctggttcaccgccagtggtttcttgacctgccgctcccttggctgcccggcgccgatacacaggggtccaactggattcagaaggagaccctggtgacgttcaagaatcctcatgctaaaaagcaagacgtcgtggttctcggaagccaggaaggcgccatgcacacagccctgaccggggctacagagatccagatgtcctctggcaaccttctgtttaccggacatctcaaatgcagactgcggatggacaaacttcaactgaaaggcatgagctactccatgtgtaccgggaagttcaaggtggtcaaagaaattgcggagacacagcacggaacgatcgtgattagagtccagtatgagggcgatgggagcccctgcaagatccccttcgaaatcatggacctcgagaaacgccatgtgctgggacggctgattaccgttaaccctatcgtgacagaaaaggattctccggtcaatattgaggccgaacccccttttggcgactcctacatcattatcggggtggagcccggccagctcaaactgaactggttcaagaagggaagctctattggccaaatgtttgagaccacaatgagaggggctaaacgcatggccatccttggagataccgcctgggacttcggcagcctcggaggggtttttacgtccatcggcaaggctctccaccaggtgttcggggccatttacggcgcggctttttctggagtcagctggacaatgaaaatcctgattggcgtgatcattacctggatcgggatgaactcccggagcacctctctgtccgtgagccttgttctcgtcggagtggtgacactgtatctgggcgtcatggtgcaggccgattctgggtgtgttgtgtcctggaagaacaaagaactcaagtgcggaagcggcatcttcattaccgacaatgtccacacatggacggagcagtacaagtttcaacctgaatccccctctaaactggccagcgctatccagaaggcccatgaggaagggatttgtggcatcagatccgtgacccgccttgagaacctgatgtggaaacagattacaccggagctcaatcacatcctgtctgaaaacgaggttaagctgaccatcatgacaggagatattaaaggcatcatgcaggctgggaagcggagccttagacctcaacccaccgaactcaaatattcctggaagacgtggggaaaggccaaaatgctgagcaccgagtctcataatcagacattcctgattgacggccctgaaaccgcggagtgccccaacacaaatcgcgcctggaactccctcgaggtggaagattacgggtttggagtcttcaccacaaatatctggctgaaacttcgggagaaacaggacgtgttttgtgacagcaagctgatgtctgctgccattaaagataacagagctgttcacgccgacatgggctattggatcgaatccgcgctcaatgatacctggaagatcgagaaggccagcttcattgaggtgaaatcttgccactggcctaagagccatacgctgtggtccaacggcgtcctggaaagcgagatgatcattcccaaaaacttcgctgggccggtgtctcagcacaattaccgccctggatatcatacacaaaccgccggcccctggcaccttgggaagctcgaaatggactttgatttctgtgagggaaccacagtggtcgttaccgaagactgcggcaaccgggggccctccctgagaacgacaaccgctagcggaaaactgatcacagagtggtgctgtcggtcctgcaccctccctccgctgcgctacagaggcgaggatggctgttggtacgggatggaaattcggccccttaaggagaaggaagagaatctggtgaactctctcgtgacagccggacatggccagatcgacaattttagcctgggggtcctgggaatggcccttttcctcgaagagatgctgagaacccgcgtgggcacgaaacacgctattctgctcgttgcggtgtcctttgtcaccctgatcacagggaacatgtctttccgggatcttggaagagtgatggttatggtgggcgccaccatgacagacgatatcggcatgggggtcacctatctggctctcctggccgcctttaaggtgcgccctacgttcgctgccggactgcttctgagaaaactcacaagcaaggagctgatgatgaccacaattggcatcgttctcctgtcccagtctaccattcccgaaaccatccttgagctgacagacgcgctcgctctggggatgatggtgctgaaaatggtccggaagatggaaaagtaccaacttgccgtgacgattatggccatcctgtgcgtgcctaatgctgtcatcctccagaacgcctggaaagttagctgtaccattctggcggtggtgtccgtcagccccctcctgcttacatcttcccagcagaaggctgattggatccctctggccctcaccattaaaggactgaatcccacagccatctttctgaccacgcttagccgcacaaacaagaaaagatcttggccgctgaatgaggctattatggccgtgggcatggtttccatcctcgctagctctctgctcaagaacgacatccctatgaccgggcccctggtggccggaggccttctgaccgtctgctatgtgctgacaggccggtccgcggacctcgaactggagcgcgccgctgatgttaaatgggaggaccaagccgaaattagcgggtccagccctatcctttctattaccatcagcgaggatggatccatgtctattaagaatgaagaggaggaacagacactgacgatcctcattagaaccggcctgctcgtgatcagcgggctgttccccgtctccatcccgattacagctgccgcctggtacctttgggaggtgaagaaacagcgggctggagtcctgtgggacgtgccttctccccctcccgttggcaaggcggaactggaggatggggcctatcgcatcaaacagaaggggattctcggctacagccaaatcggcgctggggtgtataaagaaggaacctttcacacaatgtggcatgtcaccagaggcgccgtgctgatgcacaaggggaagcggattgagccctcctgggccgacgttaaaaaggatcttatctcttacggaggcgggtggaaactggagggagaatggaaggagggcgaagaggtgcaggtcctcgctctggaacctggcaaaaacccgcgcgccgtgcagacgaagcccgggctgttcaagaccaatgcgggaacaatcggcgctgtgagcctggacttttcccctgggaccagcggatctcccattatcgataaaaagggcaaagttgtcgggctttacggaaacggcgtggtgacaagatccggcgcctatgtcagcgccattgctcagaccgagaagtctatcgaggacaaccctgaaattgaggatgacatcttccggaaaagaaagctgacaatcatggatctgcatcccggggccggaaagacgaaacgctacctccctgcgattgtgcgggaagctatcaagagaggcctgcgcacccttattctggccccgacacgggttgtggccgctgagatggaagaggccctcagagggctgcccatccgctatcaaacccctgctattcgggccgagcacaccggaagagaaatcgtcgacctcatgtgtcatgcgacattcacgatgcgcctgctttcccccgtgcgggttcctaattacaacctgattatcatggacgaggcccactttaccgatcccgctagcatcgccgctagaggctatatttccacacgggtggaaatgggggaggccgccggcatcttcatgaccgctacaccgcctggatctcgcgacccctttccccagagcaatgcgcctattatggatgaggaaagagagatccccgaacggtcctggagctctggccacgagtgggtcaccgacttcaaagggaagacggtgtggtttgttccttccattaaagccggaaacgatatcgctgcctgcctgcgcaagaatggcaagaaagtgatccagctcagcagaaagacattcgactctgaatacgtcaaaacccggaccaacgattgggactttgtggtgacaaccgatattagcgagatgggggccaatttcaaggctgagagagtcatcgacccgcgccggtgtatgaaacccgttattctgacagatggagaagagagagtgatccttgccggccctatgcccgtgacccattcctctgcggctcaacgccgggggagaattggccgcaaccctaagaatgaaaacgaccagtatatctacatgggagagcccctggaaaatgacgaggattgcgcccactggaaagaggccaagatgctcctggacaacatcaatacgccggaaggcattatccctagcatgtttgagcccgaacgggagaaggtcgatgctattgacggggaatacagactgcgcggagaggccagaaaaacattcgtggatctcatgcggcgcggcgaccttcctgtttggctggcgtatagagtggccgctgaggggatcaactacgccgatcggcgctggtgttttgacggaattaagaataaccagatcctggaagagaacgtcgaagtggagatttggaccaaagagggcgaaagaaagaaactcaagccccggtggctggatgctagaatctattccgaccctcttgccctgaaggagttcaaagagttcgctgccgggcgcaagtctctcacactgaatctgatcaccgagatgggccggctccccacgtttatgacccagaaagcgagagatgcccttgacaacctggctgttctgcatacagccgaagctggaggccgcgcctacaatcacgccctcagcgagctgccggagacccttgaaacactgctcctgctgaccctccttgctacagtgaccgggggaattttcctgtttctgatgtccggccgggggatcggaaagatgacgctcggcatgtgctgcattatcacagcgagcattctgctttggtatgcccaaatccagcctcactggatcgctgcctctattatcctggagttctttctcattgtcctgctgatccccgaacccgagaaacagagaacccctcaggataaccaactcacctacgtggtcattgccatccttacagtggttgctgccaccatggcgaatgaaatgggcttcctggagaagacaaagaaagacctggggctcggatccatcacgacccagcagccggagagcaacattctggacatcgatcttcggcccgcctccgcttggacactgtatgccgtggctaccacatttgtgacccctatgctccgccattctattgaaaatagctccgtcaacgtttctctgacggccatcgcgaatcaggccaccgtgctgatgggcctcgggaagggatggccccttagcaaaatggacattggcgtgcctctgctggctatcgggtgttactcccaagtcaaccccattacactcaccgccgctctgcttctgctcgtggcccactacgctatcatcggacctggcctgcaggccaaggcgacaagagaggcccagaaacgggctgccgctggcattatgaagaatccgaccgttgatgggatcacggtgattgacctggatcccatcccttatgaccccaagttcgaaaaacagctcggacaagtcatgcttctggtgctgtgcgtcacacaggtgctcatgatgcgcaccacatgggccctgtgtgaggcccttaccctggcgaccggccctattagcacactctgggaagggaaccccggaagattttggaatacgaccatcgctgtttctatggccaacatcttccggggctcctacctggctggggccggactgctctttagcattatgaagaatacaaccaacacacgcagaggcaccggcaatatcggggagacgcttggagagaaatggaagtctcggctgaacgccctgggcaaatccgagttccagatttataagaaaagcgggatccaagaggtggatcgcacactcgctaaggaaggaattaagagaggcgagaccgaccatcacgccgtctctcgggggagcgcgaaactgagatggtttgtggagcgcaacatggttaccccggaaggaaaggtggtcgatcttggctgcggcagagggggatggtcctactattgtggcgggctgaaaaatgtgagagaggtgaagggactcacaaaaggcgggcctggacatgaagaacccatccccatgtctacctacggctggaacctggttcgcctgcagagcggcgtcgacgtgttcttcacacctcccgaaaagtgcgatacgctcctttgtgacatcggggagtccagccctaatccgaccgtggaggccggacggacactgagagtcctgaacctcgttgaaaattggctgaacaataacacccagttttgcattaaggtgcttaatccctatatgccttccgtgatcgagaaaatggaagctctgcagcgcaagtacggcggggccctcgtccggaaccccctgtctagaaatagcacacacgagatgtactgggtgtccaacgcttctggaaatattgttagctccgtgaacatgatctctcgcatgctgattaatcggttcaccatgagacacaaaaaggccacgtatgaacctgatgtcgacctcggcagcgggacccgcaacatcggaatcgagtccgagattcccaaccttgacatcattggcaaacggatcgaaaagattaagcaagagcatgaaacaagctggcactacgatcaggaccatccgtataaaacctgggcgtaccacggctcttatgagacaaagcagaccgggtccgccagctctatggtgaatggagttgtgagactgctgacaaaaccttgggatgtcgtgcccatggtgacccagatggctatgacggacacaaccccttttggccaacagcgcgtcttcaaggaaaaagttgataccagaacacaggagcccaaggaggggacgaagaaactcatgaagatcaccgccgaatggctgtggaaagagcttggaaagaaaaagacacctcggatgtgtacccgcgaagagtttacaagaaaagtgcggtccaacgctgccctgggcgctattttcaccgacgagaataagtggaaaagcgccagagaagcggtggaggattctcggttttgggaactcgtcgacaaagagcgcaacctgcacctggaagggaagtgcgagacatgtgtgtacaatatgatgggaaaaagagagaagaaactcggcgagttcggcaaggccaaggggtcccgggctatctggtatatgtggctgggagcccgctttcttgagttcgaagctctgggctttctcaacgaggatcattggttcagcagagaaaattccctgagcggggttgagggagagggccttcacaaactggggtacatcctccgggacgtgtctaagaaagaaggcggagccatgtacgccgatgacaccgcgggctgggacacgcgcattaccctggaggatctgaagaacgaagagatggtcacaaatcatatggaaggggagcacaaaaagctcgctgaggccatctttaagctgacctatcagaacaaagtggttagagtgcaacggcccacaccgcgcggaaccgtcatggacattatcagcagacgggatcagcgcggctccggacaggtgggaacgtacggccttaatacattcaccaacatggaagcccaactgattagacagatggagggggaaggcgttttcaagtctatccagcatctcacagtgaccgaggagatcgctgtccagaattggctggcccgggtgggacgcgaaagacttagccggatggctatttccggcgacgattgcgtcgtgaaacctctggacgatagatttgcctctgcgctcacggccctgaacgacatggggaaggttcgcaaagatatccaacagtgggagcccagccggggatggaatgactggacccaggtgcccttctgctcccaccactttcatgaactgattatgaaggatggcagagtcctcgtggtgccttgtcgcaaccaggacgagctgatcgggcgggctagaatttctcaaggagccggctggagccttcgcgaaacagcttgcctggggaagtcctatgcccagatgtggagcctcatgtacttccaccggagagatctgcgccttgcggccaacgctatctgttctgccgttccgtcccattgggtgcccaccagccggacaacctggtctatccacgctaaacacgagtggatgacaaccgaggacatgctgacggtctggaatagagtgtggattcaggaaaacccttggatggaggacaagacacccgttgaatcctgggaggaaatcccttatctcggcaaacgcgaggatcagtggtgcggaagcctgattggcctgacctcccgggccacctgggctaagaatatccaaacagccattaaccaggtgagatctctcatcgggaatgaggaatacaccgactatatgcccagcatgaaacggtttagacgcgaggaagaggaagcgggagtcctgtggtga

SEQ ID NO: 20276 - RNA, 9876 nt, synthetic construct
  misc_feature 1..9876: note = derived and/or modified CDS sequence (opt5) from DENV-2__GQ398263__SS-prME
  source 1..9876: mol_type = other RNA
accgccggaatgatcattatgatgatccccacagtgatggctttccacctgacgaccagaaacggggagcctcatatgattgtcagccggcaggaaaagggaaaaagcctcctgtttaagacagaggacggcgttaatatgtgcacccttatggccatggatctgggggaactctgtgaggacacaatcacctacaactgcccgctgcttcgccaaaatgaacccgaggatattgactgttggtgcaactctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccatcatggctgccattctggcttacacaatcgggaccacctattttcagagagtgctcattttcatcctgcttacagccgtcgcgccttccatgacgatgcggtgcattggaatctctaatcgcgattttgtggaaggcgttagcgggggatcctgggtggacattgtcctggagcacggcagctgtgtgaccacaatggccaaaaacaagcccaccctcgatttcgaactgatcaagacagaggctaaacaccctgccacccttagaaagtactgcatcgaagctaaactgacgaatacaaccaccgcctctcggtgtccgacacagggggagccctccctcaacgaggaacaagacaagcgctttgtgtgcaaacatagcatggtcgatagaggatggggcaatggctgtgggctgttcggaaagggcgggattgttacctgcgcgatgtttacatgcaagaaaaacatggagggaaaggtggtgcagcctgaaaatctggagtatacgatcgtcattacaccccactctggcgaagagaacgccgtggggaatgacacaggaaaacatggcaaggagatcaaaattacccctcagtccagcatcacagaagctgagctcaccggctacgggacggttaccatggaatgttctccccggacaggactggatttcaacgagatggtgcttctgcagatggaaaataaggcctggctcgtccaccgccaatggtttctggaccttccgctgccttggctccccggcgctgatacccaggggtccaactggatccagaaagagacactggtgaccttcaagaaccctcacgccaagaaacaggacgttgtggtcctgggaagccaagagggcgccatgcatacggctctcacaggggcgaccgaaattcagatgtcctctggcaatctgctttttacaggacacctgaagtgcagactccggatggacaaactgcagcttaagggcatgagctattccatgtgtaccgggaaattcaaggtggtcaaggagatcgccgaaacccaacatggaacaattgtggttagagtgcagtacgagggcgatgggagcccctgcaaaatccccttcgagattatggacctggaaaagcgccacgtcctcggacggctgatcacggtgaaccctatcgttaccgagaaagattctccggtgaatattgaagctgagcccccttttggcgactcctacatcattatcggggtcgaacccggccagctgaagctcagctggttcaaaaagggatctagcattggccagatgtttgagacaaccatgagaggggccaagcgcatggccatcctgggagatacagcttgggacttcggctcccttgggggagtgtttacctctattggcaaagccctgcatcaagtgttcggggcgatctatggcgctgcctttagcggagtttcctggacgatgaagatcctcattggcgtcgtgatcacatggattgggatgaacagccggtctacctccctgagcgtgtctctggtccttgtgggagttgtgaccctctacctgggcgtcatggtgcaggccgattccgggtgtgttgtgagctggaaaaataaggagctgaaatgcggatccggcatcttcattacagacaacgtccacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagttaaactgacaatcatgaccggagatattaagggcatcatgcaggccgggaaacggtccctgagacctcagcccacagagcttaagtacagctggaaaacctggggaaaggcgaagatgctctctacggaactgcacaaccataccttcctgatcgacggccctgagacagccgaatgccccaccacaaatcgcgcttggaactccctcgaggtggaggattatgggtttggagtcttcaccacaaatatttggctgaaacttaaggaacggcaagacgtgctgtgtgacagcaaactcatgtctgccgctatcaaggataacagagccgtgcacgcggacatgggctactggattgagtccgccctgaatgatacctggaaaatcgaaaaggctagctttattgaggtcaagtcttgccactggcctaaaagccatacgctgtggtccaacggcgttcttgagagcgaaatgatcatccccaagaacttcgccgggccggtgtctcagcacaattatcgccctggataccatacacagaccgctggcccctggcacctcgggaaactggagatggacttcgatttttgtgaaggaaccacagtggtcgtgaccgaggactgcggcaaccgggggccctccctgagaacgacaaccgccagcggaaagctcattacagaatggtgctgtcggtcctgcaccctgcctccgcttcgctacagaggcgaggatggctgttggtatgggatggagatccggcccctgaaagacaaggaagagaatctcgttaactctctggtgacagccggacatggccagattgataatttcagcctgggggtccttggaatggctctctttctggaagagatgctgagaacccgcgtgggcacgaagcacgcgatcctcctggttgccgtgtccttcgtcacccttattacagggaacatgtcttttcgggacctgggaagagtgatggttatggtgggcgctaccatgacagatgacatcggcatgggggtcacctacctcgccctgctggccgctttcaaagtgcgccctacgtttgccgcgggacttctgctcagaaagctgacaagcaaagaactcatgatgaccacaattggcatcgtgctgctttcccaatctaccatccccgagaccattctggagctcacagatgctctggccctggggatgatggtccttaagatcgttcggaatatggaaaaatatcagctggccgtgacgattatggctatcctctgcgtgcctaacgccgtcattctgcagaatgcgtggaaggtgagctgtaccatcctcgctgttgtgtccgtcagccccctgcttctgacatcttcccaacagaaggccgactggatccctctcgccctgaccattaaaggactgaaccccacagctatcttccttaccacgctgagccgcacatctaagaaaagatcctggccgctcaatgaggccattatggctgtgggcatggttagcatcctggcctcttccctcctgaagaacgacattcctatgaccgggccccttgtggcgggaggcctgctgaccgtctgctacgtgctcacaggccggagcgccgatctggaacttgagcgcgctgccgacgtcagatgggaagatcaggctgagatctccgggagctctcctatcctgagcattaccatctccgaggacggatctatgagcattaaaaatgaagaggaagaacagacactcacgatcctgattcggaccggcctcctggtgatctccgggctttttcccgtttctattccgatcacagccgccgcttggtatctgtgggaggtgaagaaacaacgcgcgggagtcctgtgggatgtgccttctccccctcccgttggcaaggccgaactcgaggacggggcttacagaatcaagcagaaaggcattctgggctattcccagatcggcgccggggtgtacaaggaaggaaccttccacacaatgtggcatgtcacccggggcgccgtgcttatgcacaaagggaagcgcattgagccctcctgggctgatgtgagaaaagacctgatcagctacggaggcgggtggaagctcgaaggagagtggaaggagggcgaagaggttcaggtcctggccctcgaacctggcaaaaacccgcgggcggtgcaaacgaagcccgggctgtttaaaaccaatacaggaaccattggcgctgtgtcccttgatttcagccctgggacatctggatcccccatcgtcgacaagaaaggcaaggtggttgggctgtatggaaacggcgtggtcaccagaagcggcacatacgtgtctgccatcgcccagacggagaagtccattgaagataaccctgagatcgaggacgatatttttcgcaaaaagcggctgaccatcatggacctccatcccggggctggaaaaacaaagagatatctgcctgccattgttcgcgaagcgatcaaacggggccttagaaccctgatcctcgctccgacccgcgtggtcgccgccgagatggaagaggctctgcgggggctccccattagataccagacccctgccatccgcgctgaacacacgggacgggagattgtggacctgatgtgtcatgccaccttcacaatgagacttctgagccccgttcgggtgcctaattataacctgatcattatggatgaggcgcacttcaccgaccccgcctccatcgctgcccgcggctacatttctacaagagtcgaaatgggggaggctgccggcatctttatgaccgccacgccgcctggaagccgggatcccttcccccagtccaatgctcctatcatggacgaggaacgcgagattcccgaaagaagctggaactctggccacgagtgggtgacagattttaaggggaagaccgtgtggttcgtcccttccatcaaagcgggaaatgacattgccgcttgcctccggaagaacggcaaaaaggttatccaactgagcagaaaaacctttgattctgaatatattaagacacgcaccaatgactgggatttcgtggtgacaaccgacatcagcgagatgggggccaactttaaggccgaacgggtcatcgatccgagacgctgtatgaaacccgtgattcttacggacggagaggagcgggttatcctggctggccctatgcccgtgacacattcctctgccgcgcagagacgcgggcggattggcagaaatcctaagaacgaaaatgaccagtacatctacatgggagagcccctcgaaaacgatgaggactgcgctcactggaaagaagccaagatgctgctggataatattaacaccccggagggcatcatccctagcatgttcgagcccgaacgcgagaaagtcgacgccattgatggggaatatagactccggggagaggctcgcaagacatttgtggaccttatgagacggggcgatctgcctgtttggctggcctaccgcgtggcggccgaagggatcaattatgctgacagacggtggtgtttcgatggaattaaaaacaaccaaatcctcgaggagaatgtcgaagtggagatttggaccaaggaaggcgagagaaagaaactgaagccccgctggcttgacgcccggatctactccgatcctctggctctcaaagagtttaaggagttcgccgctgggagaaaatctctgacgctgaacctcattaccgagatgggccgccttcccacattcatgacccagaaggcccggaatgcgctggacaacctggccgtcctccatacagctgaagccggaggcagagcttataatcacgccctgagcgagcttccggaaaccctggagacactcctgctgctcacccttctggccacggtgacagggggaatctttctgttcctcatgtccggcaaggggatcggaaaaatgaccctgggcatgtgctgcattatcaccgctagcattcttctgtggtacgcgcagatccagcctcactggattgccgcttctatcatcctcgagtttttcctgattgttctgctcatccccgaacccgagaagcaacggacacctcaggataaccagcttacctatgtggtgattgccatcctgacagtcgttgccgctacgatggccaatgaaatgggctttctggagaaaaccaagaaagacttcgggctcggatccattgcgacacagcaaccggaaagcaacatcctggacatcgatcttcgccccgcctccgcttggaccctgtacgccgtggctacaacctttattacgcctatgctcagacattctatcgagaatagctccgtgaacgtctctctgaccgccattgcgaatcaggccacagtgctgatgggcctcgggaagggatggccccttagcaagatggacatcggcgttcctctgctggctattgggtgttactcccaggtgaaccccatcaccctcacagccgctctgcttctgctcgtcgcccactatgctattatcggacctggcctgcaggccaaagcgacccgggaggcccaaaagcgcgctgccgctggcatcatgaaaaatccgacggtggatgggattacagtcatcgacctggatcccattccttacgaccccaagttcgaaaaacagctcggacaggtgatgcttctggttctgtgcgtgacccaggtcctcatgatgagaacaacctgggccctgtgtgaggcccttaccctggcgacaggccctatcagcacgctctgggaagggaaccccggacggttttggaataccacaattgctgtgtctatggccaacatcttccgcggctcctatctggctggggccggactgctctttagcatcatgaagaataccgccaacacaagacggggcaccggcaacacgggggagacacttggagaaaagtggaaaaatcgcctgaacgctctgggcaagtctgagttccaaatttacaaaaagtccgggatccaggaggttgatagaaccctcgccaaagaaggaattaagcggggcgagaccgaccatcacgcggtgagcagagggtctgccaaactgcgctggtttgtcgaacggaatcttgtgacaccggagggaaaggtggttgatctgggctgcggcagagggggatggagctattactgtggcgggctcaagaacgtcaaagaggtgaagggactgaccaaaggcgggcctggacatgaggaacccatccccatgtccacatatggctggaatctggtgcgcctccagtctggcgtcgacgttttcttcacgcctcccgaaaagtgcgatacccttctgtgtgacattggggagagctcccctaacccgacagtggaagctggacggaccctgagagtgctcaatctggtcgagaactggcttaataacaatacacaattttgcatcaaagtgctgaacccctacatgcctagcgttatcgagaagatggaagccctccagcgcaagtacggcggggctctggtgcggaatcccctgtccagaaactctacccacgagatgtattgggtcagcaatgcctccggaaacattgtgtctagcgttaacatgatctcccgcatgctcattaatcggttcacgatgagacacaaaaaggcgacctacgaacctgatgtggaccttggctctgggacacgcaacatcggaattgagagcgaaatccccaatctggacgtcatcggcaaacggattgagaagatcaaacaggagcatgaaacctcctggcactatgatcaggaccatccgtacaagacatgggcctatcacggcagctacgagaccaagcaaacagggtctgcttccagcatggtgaacggagtggtcagactgctcaccaaaccttgggatgttattcccatggtgacgcagatggccatgacagacaccaccccttttggccagcagcgcgtgttcaaggaaaaagtcgatacaagaacgcaagagcccaaggaagggaccaaaaagctgatgaagatcacagctgagtggctttggaaagagctgggaaagaaaaagacccctcggatgtgtacacgcgaagagtttaccagaaaagtgcggtctaatgccgctctcggcgccatttatacagacgaaaacaagtggaaatccgcgagagaggccgttgaggatagccggttctgggaactggtggacaaggagcgcaatctgcacctcgaagggaagtgcgagacctgtgtctacaacatgatgggaaaaagagaaaagaaactgggcgagtttggcaaggctaaagggtctcgggccatctggtacatgtggcttggagctcgcttcctggagtttgaagccctcggcttcctgaatgaggatcattggttttccagagaaaacagcctttccggggtggagggagaaggcctgcacaagctcgggtatattctgcgggacgttagcaagaaagagggcggagccatgtacgcggatgacacggctggctgggacacccgcatcacactggaggatctcaagaatgaagagatggtgaccaaccatatggaaggggagcacaaaaagctggccgaagccatcttcaaacttacatatcagaataaggtcgtgagagttcagcggcccaccccgcgcggaacggtgatggacattatctctagacgggatcagcgcggcagcgggcaagtcgtgacatacggactgaacacctttacaaatatggaggctcagctcattagacagatggagggcgaaggggtcttcaagtccatccaacatctgaccgtgacggaggaaattgccgttaaaaactggcttgctcgggtgggccgcgagagactgtctcggatggccatcagcggagacgattgcgtcgtgaagcctctcgacgatagattcgcgtccgccctgaccgctctgaacgacatgggcaaagtgcgcaaggatatccagcagtgggagccctctcgggggtggaatgactggacacaggttcccttttgcagccaccacttccatgaactcattatgaaagatggaagagtgctggtcgtgccttgtcgcaaccaagacgagcttatcggccgggccagaatttcccagggggctggatggtctctgcgcgaaaccgcctgcctcggcaagagctatgcgcagatgtggtccctgatgtactttcaccggagagatcttcgcctggccgctaatgccatctgtagcgctgttccgtctcattgggtgcccacatcccggaccacatggagcattcacgccacccacgagtggatgacgacagaagacatgctcaccgtctggaacagagtgtggatccaggagaatccttggatggaggacaagacccccgtcgaatcttgggaggaaatcccttatctggggaaacgcgaggatcaatggtgcggctccctgattggactcacaagccgggctacctgggccaagaacatccagacagcgattaatcaggtgagatccctgatcggcaacgaagagtacacggactacatgccctctatgaaacggttcagacgcgaggaagaggaagccggggttctttggtga

SEQ ID NO: 20277 - RNA, 9876 nt, synthetic construct
  misc_feature 1..9876: note = derived and/or modified CDS sequence (opt5) from DENV-2__GQ398264__SS-prME
  source 1..9876: mol_type = other RNA
accgccggaatgatcattatgatgatccccacagtgatggctttccacctgacgaccagaaacggggaacctcatatgattgtcagccggcaggaaaaggggaaaagcctcctgtttaagacagaaaatggagttaacatgtgcacccttatggccatggacctgggggaactctgtgaagatacaatcacctacaattgcccgctgcttcgccaaaacgaacccgaagacattgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccatcatggctgccattctggcttacacaatcgggaccacctattttcagagagtgctcattttcatcctgcttacagccgtcgcgccttccatgacgatgcggtgcattggaatctctaaccgcgactttgtggaaggcgttagcgggggatcctgggtggatattgtcctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggattgttacctgcgcgatgtttacatgcaagaaaaatatggagggaaaggtggtgcagcctgaaaacctggagtatacgatcgtcattacaccccactctggcgaagagaatgccgtggggaacgatacaggaaaacatggcaaggagatcaaaattacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggatccagaaagagacactggtgaccttcaagaatcctcacgccaagaaacaggatgttgtggtcctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtggtcaaggagatcgccgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagctgagcccccttttggcgattcctacattatcattggggtggaacccggccagctgaagctcagctggttcaaaaagggatctagcatcggccagatgtttgagacaaccatgagaggggccaagcgcatggccattctgggagacacagcttgggatttcggctcccttgggggagtctttacctctatcggcaaagccctgcatcaagtgttcggggcgatctatggcgctgcctttagcggagtgtcctggacgatgaagattctcatcggcgttgtcattacatggatcgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcattttcatcacagataatgtgcacacctggacagaacagtataagtttcagcctgagtctcccagcaagctcgcttccgccatccaaaaagctcacgaagaggggatttgtggcatcagatctgtcacgcgcctggaaaaccttatgtggaagcagattaccccggagctgaatcatatcctcagcgagaacgaagtgaaactgacaattatgaccggagacatcaagggcatcatgcaggccgggaaacggtccctgagacctcagcccacagagcttaagtacagctggaaaacctggggaaaggcgaagatgctctctacggaactgcacaatcataccttcctgattgatggccctgagacagccgaatgccccaacaccaatcgcgcttggaactccctcgaggttgaggactatgggtttggagtgttcacaaccaatatctggctgaaacttaaggaacggcaagatgtcttttgtgacagcaaactgatgtctgccgctattaaggacaacagagccgtgcacgcggatatgggctactggatcgagtccgccctcaacgacacatggatgattgaaaaagctagcttcatcgaggtgaagtcttgccactggcctaagagccataccctgtggtccaatggcgtcctggagagcgaaatgatcattcccaaaaacttcgccgggccggtttctcagcacaattatcgccctggataccatacgcagacagctggcccctggcagcttgggaagctcgagatggattttgacttctgtgaaggaaccaccgtggtggtcacagaggattgcggcaaccgggggccctccctgagaaccacgacagccagcggaaaactgatcaccgaatggtgctgtcggtcctgcacactccctccgctgcgctacagaggcgaggacggctgttggtatgggatggagattcggccccttaaggaaaaagaggaaaatctggtgaactctctcgttaccgccggacacggccaaatcgataattttagcctgggggtgctgggaatggctcttttcctcgaggaaatgctgagaacacgcgtcggcaccaagcatgcgattctgctcgtggccgtttcctttgtgacgctgatcaccgggaacatgtctttccgggaccttggaagagtcatggtgatggttggcgctacaatgaccgatgacattggcatgggggtgacatacctggccctcctggccgcttttaaggtccgccctaccttcgccgcgggactgcttctgagaaaactcacgagcaaggagctgatgatgacaaccatcggcatcgtgctcctgtcccagtctacaattcccgagaccatccttgaactgaccgatgctctcgccctggggatgatggtgctgaaaattgtccggaatatggagaagtatcagcttgccgttacaatcatggctattctgtgcgtgcctaacgccgtgatcctccaaaatgcgtggaaagtcagctgtacgaccctggctgtggtttccgtgagccccctcctgcttacatcttcccagcagaaggccgactggatccctctggccctcaccattaagggactgaaccccacagctatctttctgaccacgcttagccgcacatctaaaaagagatcctggccgctgaatgaagccattatggctgtcggcatggtgagcatcctcgcctcttccctgctcaaaaacgatattcctatgaccgggcccctggttgcgggaggccttctgaccgtgtgctacgtcctgacaggccggagcgccgacctcgagctggaacgcgctgccgacgtgagatgggaggatcaggctgagatctccgggagctctcctatccttagcattaccatctccgaagacggatctatgagcattaagaatgaggaagaggagcaaacactgacgatcctcattcggaccggcctgctcgtcatctccgggctgttccccgtgtctattccgatcacagccgccgcttggtatctttgggaagttaaaaagcagcgcgcgggagtgctgtgggatgtcccttctccccctcccgtgggcaaagccgagctggaagacggggcttacagaatcaagcagaagggcattctcggctattcccagatcggcgccggggtttacaaagagggaacctttcacacaatgtggcacgtgacccggggcgccgtcctgatgcataaggggaaacgcattgaaccctcctgggctgatgtgagaaaggaccttatcagctacggaggcgggtggaaactggagggagagtggaaggaaggcgaggaagtgcaagttctcgccctggagcctggcaagaacccgcgggcggtccagacgaaacccggactcttcaagaccaacacaggaaccattggcgctgtgtccctggattttagccctgggacatctggatcccccatcgtggacaaaaagggcaaagtcgtggggctttatggaaatggcgttgtgaccagaagcggcacatacgtctctgccatcgcccagacggaaaagtccattgaggataaccctgagatcgaagacgatattttccgcaagaaacggctgaccatcatggacctgcaccccggggctggaaagacaaaaagatatctccctgccattgtgcgcgaggcgatcaagcggggcctgagaacccttatcctggctccgacccgcgttgtggccgccgaaatggaggaagctctccgggggctgcccattagataccagacccctgccatccgcgctgagcatacgggacgggagattgtcgatctcatgtgtcacgccaccttcacaatgagactgcttagccccgtgcgggttcctaattataacctgatcattatggacgaagcgcattttaccgaccccgcctccatcgctgcccgcggctacatttctacaagagtggagatgggggaagctgccggcatcttcatgaccgccacgccgcctggaagccgggatccctttccccaatccaatgctcctatcatggacgaggagcgcgaaattcccgagagaagctggaactctggccacgaatgggtcacagatttcaaagggaagaccgtgtggtttgtgccttccatcaaggcgggaaatgacattgccgcttgcctgcggaaaaacggcaagaaagtcatccagctcagcagaaagaccttcgattctgagtatattaaaacacgcaccaatgactgggattttgttgtgacaaccgacatcagcgaaatgggggccaacttcaaggccgagcgggtgatcgatccgagacgctgtatgaagcccgtcattctgacggacggagaggaacgggtgatccttgctggccctatgcccgttacacactcctctgccgcgcagagacgcgggcgggtgggcagaaatcctaaaaacgagaatgatcaatacatttacatgggagaacccctggagaacgacgaagactgcgctcattggaaggaggccaaaatgctcctggataatatcaacaccccggagggcattatccctagcatgtttgaacccgagcgcgaaaaggtcgacgccatcgatggggagtatagactgcggggagaagctcgcaaaacattcgtggacctcatgagacggggcgatcttcctgtttggctggcctaccgcgtggcggccgaggggattaactatgctgacagacggtggtgttttgatggagtcaagaataaccagatcctggaggaaaatgtggaggtcgaaatttggaccaaagagggcgagagaaagaagctcaaaccccgctggctggacgcccggatctactccgatcctcttgctctgaaggagttcaaagagttcgccgctgggagaaagtctctcacgctgaacctgattaccgaaatgggccgcctccccacatttatgacccagaaagcccggaatgcgcttgacaacctggccgtgctgcacacagctgaggccggaggcagagcttataatcatgccctcagcgaactgccggagacccttgagacactgctcctgctgaccctccttgccacggttacagggggaatcttcctgtttctgatgtccggcaaggggattggaaagatgaccctcggcatgtgctgcatcatcaccgctagcattctgctttggtacgcgcagatccaacctcactggattgccgcttctatcattctggagttctttctcatcgtgctgctgatccccgagcccgaaaaacagcggacacctcaggataaccagctcacctatgtggtcattgccatccttacagttgtggccgctacgatggccaatgagatgggcttcctggaaaagaccaaaaaggactttgggctgggatccacagcgacccaacagccggagagcaacattctcgatatcgacctgcgccccgcctccgcttggacactttacgccgtggctaccacgttcattacccctatgctgagacactctatcgagaatagctccgtcaacgtgtctctcacagccatcgcgaatcaggccaccgttctgatgggcctggggaaaggatggcccctcagcaagatggacattggcgtgcctcttctggctatcgggtgttactcccaggtcaaccccattacactgaccgccgctctcctgcttctggtggcccattatgctatcattggacctggcctccaagccaaggcgacgcgggaagcccagaaacgcgctgccgctggcatcatgaagaatccgacagtcgatgggattaccgtgatcgacctggatcccatcccttacgaccccaaatttgagaagcagctgggacaggttatgctccttgtgctgtgcgtcacacaagtgctgatgatgagaaccacctgggccctctgtgaagccctgacacttgcgacgggccctattagcaccctgtgggaggggaaccccggacggttctggaatacaaccatcgctgtttctatggccaacatttttcgcggctcctatctcgctggggccggactgctgttcagcatcatgaaaaacacagccaataccagacggggcacgggcaacacaggggaaaccctcggagagaagtggaagaatcgccttaacgctctgggcaaatctgagtttcagatttacaagaaatccgggatccaggaagtggatagaaccctggccaaggagggaatcaaacggggcgaaacagaccaccatgcggtcagcagagggtctgccaagctccgctggttcgtggagcggaatctggtgaccccggagggaaaagttgtcgatcttggctgcggcagagggggatggagctattactgtggcgggctgaagaacgtgaaggaagtgaaaggactcacaaagggcgggcctggacacgaggaacccattcccatgtccacgtatggctggaatctggtccgcctgcaatctggcgttgacgtgttctttacccctcccgagaaatgcgatacactcctttgtgacatcggggaaagctcccctaacccgaccgtggaggctggacggacactgagagtcctgaatctcgtggagaactggctgaataacaatacccagttctgcattaaggttcttaacccctacatgcctagcgtgatcgagaaaatggaggccctgcagcgcaagtacggcggggctctcgtccggaatcccctgtccagaaactctacgcatgaaatgtattgggtgagcaacgcctccggaaatattgtttctagcgtgaacatgatctcccgcatgctgatcaatcggtttaccatgagacacaagaaagcgacatacgagcctgatgtcgacctcggctctgggacccgcaacattggaatcgaaagcgagacacccaatcttgatattatcggcaagcggattgagaaaatcaagcaggaacacgagacctcctggcattatgaccaagaccacccgtacaaaacatgggcctatcatggcagctacgaaaccaagcagacggggtctgcttccagcatggtgaacggagtggtcagactgctgacaaagccttgggatgttatccccatggtgacccagatggccatgaccgacacaacgcctttcggccagcaacgcgtgtttaaagagaaggtcgataccagaacacaggaacccaaagaggggaccaagaaactcatgaagattacagctgagtggctgtggaaggaacttggcaaaaagaaaacccctcggatgtgtacacgcgaggagttcaccagaaaggtgcggtctaatgccgctctgggcgccatctttacggacgagaacaaatggaagtccgcgagagaggccgttgaagatagcgggttctgggagctcgtggacaaagaacggaatctgcacctggagggaaagtgcgaaacctgtgtctataacatgatgggcaagcgcgagaaaaagctcggcgagtttgggaaagctaagggatctagagccatttggtacatgtggctgggcgctcggttccttgaatttgaggccctggggttcctcaatgaagatcactggttttcccgcgagaacagcctgtccggagtggaaggcgaggggcttcataaactgggctacatcctcagagacgttagcaagaaggagggaggcgccatgtatgcggatgacacagctgggtgggatacccggattacactggaagacctgaaaaatgaggaaatggtgaccaaccacatggagggagaacataagaaactcgccgaggccatcttcaagctgacgtaccagaataaagtcgtgcgcgttcagagacccacaccgcggggcaccgtgatggacattatctctcgcagagatcaacgggggagcggacaggtcgtgacatatggccttaacaccttcacgaacatggaggctcagctgatccgccaaatggaaggggagggcgtctttaagtccattcagcacctcaccgtgacagaagagatcgccgttaagaattggctggctagagtgggacgggagcgcctttctagaatggccattagcggcgacgattgcgtcgtgaaacctctggacgatcggttcgcgtccgccctcaccgctctgaacgacatggggaaggtgagaaaagatatccagcagtgggaaccctctcgcggatggaatgactggacacaagttcccttttgcagccatcacttccacgagctgattatgaaggatggccgggtgctcgtcgtgccttgtagaaaccaggacgaactgatcgggcgcgcccggatctcccagggagctggctggtctcttagagagaccgcctgcctggggaaaagctacgcgcagatgtggtccctcatgtattttcatcgccgggatctgagacttgccgctaatgccatttgtagcgctgttccgtctcactgggtgcccacatcccgcaccacgtggagcatccatgccacacacgaatggatgaccaccgaggacatgctgacagtctggaaccgggtgtggattcaagagaatccttggatggaagataagacccccgtcgagtcttgggaagagatcccttacctcggcaagagagaagaccagtggtgcggatccctgattggcctgacaagccgcgctacgtgggccaaaaacatccagaccgcgatcaatcaggtgcggtccctcattgggaacgaggagtatacagactacatgccctctatgaagagattccggagagaagaggaagaggccggagttctgtggtga

SEQ ID NO: 20278 - RNA, 9876 nt, synthetic construct
  misc_feature 1..9876: note = derived and/or modified CDS sequence (opt5) from DENV-2__GQ398260__SS-prME
  source 1..9876: mol_type = other RNA
accgccggaatgatcattatgctgatccccaccgtgatggctttccacctcacgaccagaaatggggaacctcatatgattgtcagccggcaggaaaagggaaaatccctgctttttaagacggaagacggcgttaatatgtgcaccctgatggccatggatctcggggaactgtgtgaggacacaatcacctacaactgcccgcttctgagacaaaatgaacccgaggatattgactgttggtgcaactctacaagcacctgggtgacgtatggaacctgtacagcgaccggcgagcaccggcgggaaaaacgctccgtggctctcgtccctcatgtggggatgggactggagacaagaaccgaaacgtggatgtctagcgagggcgcctggaagcacgcccagcggatcgagacatggatcctgcgccatcccggcttcaccattatggctgccatcctcgcttacacaattgggaccacctattttcagagagttctgatcttcattcttctgacagccgtggcgccttccatgacgatgcggtgcatcggaatttctaatcgcgattttgtcgaaggcgtgagcgggggatcctgggttgacatcgtgctcgagcacggcagctgtgtcaccacaatggccaaaaacaagcccaccctggatttcgaacttatcaagacagaggctaaacagcctgccaccctgagaaagtactgcattgaagctaaactcacgaatacaaccaccgcctctcggtgtccgacacaaggggagccctccctgaacgaggaacaggacaagcgctttgtgtgcaaacacagcatggtggatagaggatggggcaatggctgtgggctgttcggaaagggcgggatcgtgacatgcgcgatgtttacatgcaagaaaaacatggagggaaaggttgtgcagcctgaaaatctcgagtatacgattgtgatcacaccccattctggcgaagagaacgccgtcgggaatgacacaggaaaacacggcaaggagattaaaatcacccctcagtccagcatcacagaagctgagctgattggctacgggaccgtgacgatggaatgttctccccggaccggacttgatttcaacgagatggttctgctccaaatggaaaataaggcctggctggtgcatcgccagtggtttcttgacctgccgctcccttggctgcccggcgctgatacacaggggtccaactggatccagaaagagaccctggtcacattcaagaaccctcacgccaagaaacaagacgtggttgtgctcggaagccaggagggcgccatgcacaccgctctgacgggggcgacagaaattcagatgtcctctggcaatcttctgtttaccggacatctcaagtgcagactgcggatggacaaacttcaactgaagggcatgagctattccatgtgtacagggaaattcaaggtcgtgaaggagatcgccgaaacccagcacggaaccattgtcatcagagtgcagtacgagggcgatgggagcccctgcaaaatccccttcgagattatggacctcgaaaagcgccatgttctgggacggctgatcacagtgaaccctattgtcacggagaaagattctccggtgaatatcgaagctgagcccccttttggcgactcctacattatcattggggttgaacccggccagctcaagctgaactggttcaaaaagggaagctctatcggccaaatgtttgagaccacaatgagaggggccaagcgcatggccatccttggagataccgcttgggacttcggcagcctcggcggggtgtttacatccattgggaaagccctccaccaggtcttcggggcgatctatggcgctgccttttctggagtgagctggaccatgaagattctgatcggcgtggttattacgtggatcgggatgaactcccggagcacatctctgtccgtcagccttgtgctcgtgggagtcgtgaccctgtacctgggcgttatggtgcaggccgattctgggtgtgtcgtgtcctggaaaaacaaggagctcaaatgcggaagcggcatcttcgttaccgacaatgtgcatacatggaccgaacagtataagtttcaacctgagtccccctctaagctggctagcgccattcagaaagctcacgaagaggggatctgtggcattagatccgtcacacgccttgaaaacctgatgtggaagcagatcacgccggagctcaatcacattctgtctgagaacgaagtgaaactgaccatcatgacaggagatatcaagggcattatgcaggccgggaaacggagccttagacctcaacccaccgagctcaagtactcctggaaaacatggggaaaggcgaagatgctgagcaccgaactgcataatcagacgttcctcatcgacggccctgagaccgccgaatgccccaacacaaatcgcgcttggaactctctggaggttgaggattatgggtttggagtgttcaccacaaatatttggcttaaactgaaggaacggcaggacgtcttttgtgactccaaactcatgagcgccgctatcaaggataacagagccgtgcacgcggacatgggctactggattgagtctgccctgaacgatacctggaaaatcgaaaaggcttccttcatcgaggtgaagtcctgccattggcctaaatctcacacactgtggagcaatggcgtccttgagtccgaaatgattatccccaagaacttcgccgggccggttagccagcacaattatcgccctggataccatacccaaacggctggcccctggcacctcgggaaactggagatggactttaacttctgtgaaggaacaaccgtggtggtcaccgaggattgcggcaatcgggggccctctctgagaacaaccacggcctccggaaagctcattacagaatggtgctgtcggagctgcaccctgcctccgcttcgctacagaggcgaggacggctgttggtatgggatggagatccggcccctgaaagaaaaggaggaaaacctcgtcaattccctggttacagccggacatggccagattgataacttttctctgggggtgcttggaatggctctcttcctggaggaaatgctgagaacccgcgtcggcacaaagcacgcgatcctcctggtggccgttagctttgtgacccttattacggggaatatgtccttccgggacctgggaagagtcatggtgatggttggcgctaccatgacagatgacatcggcatgggggtgacctacctcgccctgctggccgcttttaaagtccgccctacattcgccgcgggacttctgctcagaaagctgacctctaaagagctcatgatgacgacaatcggcattgtgctgcttagccagtccaccatccccgagacaattctggaactcaccgatgctctggccctggggatgatggtgcttaagatcgtccggaacatggagaaatatcaactggccgttaccattatggctatcctctgcgtgcctaatgccgtgatcctgcagaacgcgtggaaggtctcttgtacaattctcgctgtggttagcgtgagccccctgcttctgacgagctctcagcagaaggccgactggatccctctcgccctgaccattaaaggactgaatcccacagctatctttcttaccacactgtcccgcaccagcaagaaaagatcttggccgctcaacgaagccattatggctgtcggcatggtgtccatcctggccagctctctcctgaagaatgatatccctatgacggggccccttgttgcgggaggcctgctgacagtgtgctacgtcctcaccggccggtccgccgacctggagcttgaacgcgctgccgacgtgagatgggaggatcaagctgagattagcgggtccagccctatcctgtctattaccatcagcgaagacggatccatgtctattaaaaacgaggaagaggagcagacactcaccatcctgattcggacaggcctcctggtcatcagcgggcttttccccgtgtccatcccgattacggccgccgcttggtatctgtgggaagttaagaaacagcgcgcgggagtgctgtgggatgtcccttctccccctcccgtgggcaaggccgagctcgaagacggggcttacagaatcaagcagaaaggcattctgggctatagccaaatcggcgccggggtttacaaggagggaacctttcatacaatgtggcacgtgacccggggcgccgtccttatgcacaaagggaagcgcattgaaccctcctgggctgatgtgaaaaaggacctgatctcttacggaggcgggtggaagctcgagggagagtggaaagaaggcgaggaagtgcaggttctggccctcgagcctggcaagaacccgagagcggtccagacaaaacccgggctgttcaagaccaatacgggaaccatcggcgctgtgagccttgatttttcccctgggacaagcggatctcccattgtggacaaaaagggcaaggtcgtggggctgtatggaaacggcgttgtgacccggtccggcacatacgtcagcgccatcgcccagaccgaaaaatctattgaggataatcctgagatcgaagacgatattttcagaaagaaacgcctgacaatcatggacctccatcccggggctggaaagacgaaacggtatctgcctgccatcgtgagagaggcgattaagcgcggccttcggaccctgatcctcgctccgacaagagttgtggccgccgaaatggaggaagctctgcgcgggctccccattcggtaccaaacccctgccatcagagctgagcacaccggacgcgagattgtcgatctgatgtgtcatgccacattcacgatgcggcttctgtcccccgtgagagttcctaactataatctgatcattatggacgaagcgcactttaccgaccccgccagcatcgctgcccggggctacatctccacacgcgtggagatgggggaagctgccggcattttcatgaccgccacaccgcctggatctagagatccctttccccagagcaacgctcctatcatggacgaggagcgggaaattcccgagcgctcctggaatagcggccatgaatgggtcaccgatttcaaggggaaaacggtgtggtttgtgccttctatcaaggcgggaaacgacattgccgcttgcctccgcaaaaatggcaagaaagtcatccagctgtcccggaagacattcgatagcgagtatatcaagaccagaaccaacgactgggattttgttgtgacaaccgacatttctgaaatgggggccaatttcaaagccgagcgcgtgatcgatccgcggagatgtatgaagcccgtcattcttacagacggagaggaacgcgtgatcctggctggccctatgcccgttacccacagctccgccgcgcaacggagagggcgcattggccggaaccctaaaaatgagaacgatcagtacatctacatgggagaacccctcgagaatgacgaagactgcgctcactggaaggaggccaaaatgctgctggataacatcaacacgccggagggcattatcccttctatgtttgaacccgagagagaaaaggtggacgccattgatggggagtatcgcctcagaggagaagctcggaaaacattcgtcgaccttatgcgcagaggcgatctgcctgtgtggctggcctaccgggttgcggccgaggggatcaattatgctgaccgcagatggtgttttgatggaattaagaacaatcagatcctcgaggaaaacgtggaggtcgaaatttggaccaaggagggcgagcggaaaaagctgaaacccagatggcttgacgcccgcatctacagcgatcctctggctctcaaggagttcaaagagttcgccgctgggcggaagtccctgacactgaatctcatcaccgaaattggcagacttcccacgtttatgacccagaaggcccgcaacgcgctggacaatctggccgtgctccatacagctgaggccggaggccgggcttataaccacgccctgtctgaacttccggagaccctggagacactcctgctgctcacccttctggccacagtcaccgggggaatcttcctgtttctcatgagcggcaaagggattggaaagatgacgctgggcatgtgctgcatcattacagcttccatccttctgtggtacgcgcaaatccagcctcattggattgccgctagcatcattctcgagttctttctgatcgtgctgctcattcccgagcccgaaaaacagagaacccctcaggataatcaacttacctatgttgtgatcgccatcctgacagtggtcgccgctaccatggccaacgagatgggcttcctggaaaagaccaaaaaggactttgggctcggatctattgcgacgcagcagccggagtccaatatcctggatattgaccttcggcccgccagcgcttggaccctgtacgccgttgctacaaccttcatcacacctatgctccgccactccattgagaactctagcgtgaatgtgtccctgaccgccatcgcgaaccaggccacggtcctgatgggcctcgggaagggatggcccctttctaaaatggacattggcgtgcctctgctggctatcgggtgttacagccaagttaatcccatcaccctcacagccgctctgcttctgctcgtggcccactatgctattatcggacctggcctgcaggccaaggcgaccagagaagcccagaaacgggctgccgctggcattatgaagaacccgacagtcgatgggatcaccgtgattgacctggatcccatcccttacgaccccaaatttgagaagcagctcggacaagtcatgcttctggtgctgtgcgttacacaggtgctcatgatgcgcacaacctgggccctgtgtgaagcccttacactggcgaccggccctatctccaccctctgggaggggaatcccggaagattctggaacacaacgattgctgtcagcatggccaacatctttcggggctcttatctggctggggccggactgctgttctccattatgaagaataccgccaacacacgcagaggcaccggcaatacaggggaaacccttggagagaaatggaagaaccggctgaatgctctgggcaaaagcgagtttcagatctacaagaaatctgggattcaagaagtggatcgcacgctcgccaaggagggaatcaaaagaggcgaaacagaccatcacgcggtttcccgggggagcgccaagctgagatggttcgtggagcgcaaccttgtcaccccggagggaaaggtggtggatctgggctgcggcagagggggatggtcttattactgtggcgggctcaaaaatgttagagaagtcaagggactgaccaaaggcgggcctggacatgaggaacccatccccatgagcacatatggctggaacctggtgcgcctccagtccggcgtggacgtcttctttacccctcccgagaagtgcgatacacttctgtgtgacattggggaatctagccctaatccgacgatcgaggctggacggaccctgagagttctcaacctggtggagaattggcttaacaataacacacagttctgcattaaagtgctgaatccctacatgccttccgtcatcgaaaagatggaggccctccagcgcaagtacggcggggctctggtgcggaaccccctgagcagaaactccacccacgaaatgtattgggtttctaatgccagcggaaacattgtgtcctctgtcaatatgatcagccgcatgctcatcaaccggtttacaatgagacataaaaaggcgacctacgagcctgatgtggaccttggctccgggacgcgcaatattggaatcgaatctgagacccccaacctggatattatcggcaaacggattgagaagatcaaacaagaacacgagacaagctggcactatgaccaggaccatccgtacaagacctgggcctatcacggctcctacgaaacaaagcagaccgggagcgcttcttccatggttaatggagtggtcagactgctcacaaaaccttgggatgtgattcccaccgtgacgcagatggccatgacagacaccacccctttcggccaacagcgcgtctttaaggagaaagttgatacaagaacgcaggaacccaaggaggggaccaaaaagctgatgaagatcacagctgagtggctttggaaagaactgggaaagaaaaagacccctcggatgtgtacacgcgaggagttcaccagaaaagtgcggagcaacgccgctctcggcgccatctttacagacgagaataagtggaaatctgcgagagaggccgtggaagattcccggttctgggagctggtcgacaaggaacgcaacctgcatctcgaggggaagtgcgaaacctgtgtgtataatatgatgggaaaaagagagaagaaactgggcgagtttggcaaggctaaagggagccgggccatttggtacatgtggcttggagctcgcttcctggaatttgaggccctcggcttcctgaacgaagatcactggttttctagagaaaattcccttagcggggttgaaggagagggcctgcacaagctcgggtacatcctgcgggacgtgtccaagaaagagggcggagccatgtatgcggatgacacggctggctgggatacccgcattacactggaagacctcaagaacgaggaaatggtcaccaatcatatggagggggaacacaaaaagctggccgaggccatcttcaaacttacataccagaacaaggtggttagagtgcaacggcccaccccgcgcggaacggtcatggacattatcagcagacgggatcagcgcggctctggacaggtgggaacatatggcctgaacaccttcacaaatatggaggctcaactcatcagacagatggaaggggagggcgtttttaagagcattcagcatctgaccgtgacggaagagatcgccgtccagaactggcttgctcgggtgggacgcgagagactgtcccggatggccatttctggcgacgattgcgtcgtgaaacctctcgacgatagattcgcgagcgccctgaccgctctgaatgacatggggaaggttcgcaaagatatccaacagtgggaaccctcccggggatggaacgactggacacaggtgcccttttgctctcaccatttccacgagctcattatgaaggatggcagagtcctggtggtgccttgtcgcaatcaggacgaacttatcgggcgggccagaatcagccaaggagctggctggtccctgcgcgagaccgcctgcctcgggaaatcttacgcgcagatgtggagcctgatgtattttcaccggagagatcttcgcctggccgctaacgccatttgttccgctgttccgagccattgggtgcccacatctcggaccacatggtccatccacgccagacatgaatggatgaccacggaggacatgctcacagtctggaatcgcgtgtggattcaggagaacccttggatggaagataagacccccgttgagagctgggaagagatcccttacctgggcaagcgggaagaccagtggtgcggatctctgattggcctcacctccagagctacatgggccaaaaatatccaaaccgcgattaaccaggtgcggagcctgatcgggaatgaggagtatacagactacatgccctccatgaagagattccgccgggaagaggaagaggccggagtcctttggtga

SEQ ID NO: 20279 - RNA, 9876 nt, synthetic construct
  misc_feature 1..9876: note = derived and/or modified CDS sequence (opt5) from DENV-2__GQ398262__SS-prME
  source 1..9876: mol_type = other RNA
accgccggaatgatcattatgctgatccccaccgtgatggctttccacctcacgaccagaaatggggaacctcatatgattgtgagccggcaggaaaagggaaaatccctgctttttaagacggaagacggagttaatatgtgcaccctgatggccatggatctcggggaactgtgtgaagacacaatcacctacaactgcccgcttctgcgccaaaatgaacccgaagatattgactgttggtgcaactctacaagcacctgggtgacgtatggaacctgtacagcgaccggcgagcacagacgggaaaaacgctccgtggctctcgtccctcatgtggggatgggactggagacaagaaccgaaacgtggatgtctagcgagggcgcctggaagcacgcccagcggatcgagacatggatcctgcgccatcccggcttcaccattatggctgccatcctcgcttacacaattgggaccacctattttcagagagttctgatcttcattcttctgacagccgtggcgccttccatgacgatgcggtgcatcggaatttctaatcgcgattttgtcgaaggcgtgagcgggggatcctgggttgacatcgtgctcgagcacggcagctgtgtcaccacaatggccaaaaacaagcccaccctggatttcgaacttatcaagacagaggctaaacagcctgccaccctgagaaagtactgcattgaagctaaactcacgaatacaaccaccgcctctcggtgtccgacacaaggggagccctccctgaacgaggaacaggacaagcgctttgtgtgcaaacacagcatggtggatagaggatggggcaatggctgtgggctgttcggaaagggcgggatcgtgacctgcgcgatgtttacatgcaagaaaaacatggagggaaaggttgtgcagcctgaaaatctcgagtatacgattgtgatcacaccccattctggcgaagagaacgccgtcgggaatgacacaggaaaacacggcaaggagattaaaatcacccctcagtccagcatcacagaagctgagctgaccggctacgggacggtgaccatggaatgttctccccggacaggacttgatttcaacgagatggttctgctccaaatggaaaataaggcctggctggtgcatcgccagtggtttcttgacctgccgctcccttggctgcccggcgctgatacccaggggtccaactggattcagaaagagacactggtcaccttcaagaaccctcacgccaagaaacaagacgtggttgtgctcggaagccaggagggcgccatgcacacggctctgacaggggcgaccgaaatccagatgtcctctggcaatcttctgtttacaggacatctcaagtgcagactgcggatggacaaacttcaactgaagggcatgagctattccatgtgtaccgggaaattcaaggtcgtgaaggagattgccgaaacccagcacggaacaatcgtcattagagtgcagtacgagggcgatgggagcccctgcaaaatccccttcgagatcatggacctcgaaaagcgccatgttctgggacggctgattacggtgaaccctatcgtcaccgagaaagattctccggtgaatattgaagctgagcccccttttggcgactcctacatcattatcggggttgaacccggccagctcaagctgaactggttcaaaaagggaagctctattggccaaatgtttgagacaaccatgagaggggccaagcgcatggccatccttggagatacagcttgggacttcggcagcctcggcggggtgtttacctccatcgggaaagccctccaccaggtcttcggggcgatttatggcgctgccttttctggagtgagctggacgatgaagatcctgattggcgtggttatcacatggattgggatgaactcccggagcacctctctgtccgtcagccttgtgctcgtgggagtcgtgaccctgtacctgggcgttatggtgcaggccgattctgggtgtgtcgtgtcctggaaaaacaaggagctcaaatgcggaagcggcatcttcatcacagacaatgttcatacctggacagaacagtataagtttcaacctgagtccccctctaagctggctagcgccattcagaaagctcacgaagaggggatctgtggcattagatccgtgacgcgccttgaaaacctgatgtggaagcagatcaccccggagctcaatcacattctgtctgagaacgaagtccggctgacaatcatgaccggagatatcaaaggcattatgcaggccgggaagagaagccttcgccctcaacccacagagctcaaatactcctggaagacctggggaaaagcgaagatgctgagcacggaactgcataatcagaccttcctcatcgacggccctgagacagccgaatgccccaacaccaatcgggcttggaactctctggaggtggaggattatgggtttggagttttcacaaccaatatttggcttaagctgaaagaaagacaggacgtgttttgtgactccaagctcatgagcgccgctatcaaagataaccgcgccgtccacgcggacatgggctactggattgagtctgccctgaacgatacatggaagatcgaaaaggcttccttcatcgaggtcaaatcctgccattggcctaagtctcacaccctgtggagcaatggcgtgcttgagtccgaaatgattatccccaaaaacttcgccgggccggtcagccagcacaattatcggcctggataccatacgcaaacagctggcccctggcacctcgggaagctggagatggactttaacttctgtgaaggaaccaccgttgtggtgacagaggattgcggcaatagagggccctctctgcggaccacgacagcctccggaaaactcattaccgaatggtgctgtcgcagctgcacactgcctccgcttagataccggggcgaggacggctgttggtatgggatggagatcagacccctgaaggaaaaagaggaaaacctcgtcaattccctggtgaccgccggacatggccagattgataacttttctctgggggttcttggaatggctctcttcctggaggaaatgctgcgcacacgggtgggcaccaagcacgcgatcctcctggtcgccgtgagctttgttacgcttattaccgggaatatgtccttcagagacctgggacgcgtgatggtcatggtgggcgctacaatgaccgatgacatcggcatgggggttacatacctcgccctgctggccgcttttaaggtgagacctaccttcgccgcgggacttctgctccggaaactgacgtctaaggagctcatgatgacaaccatcggcattgtcctgcttagccagtccacaatccccgagaccattctggaactcaccgatgctctggccctggggatgatggtgcttaaaatcgtgcgcaacatggagaagtatcaactggccgtcacaattatggctatcctctgcgttcctaatgccgtgatcctgcagaacgcgtggaaagtgtcttgtacgattctcgctgtcgtgagcgttagccccctgcttctgaccagctctcagcagaaggccgactggatccctctcgccctgacaattaagggactgaatcccaccgctatctttcttacaaccctgtccagaacgagcaaaaagcggtcttggccgctcaacgaagccattatggctgtgggcatggtctccatcctggccagctctctcctgaaaaatgatatccctatgacagggccccttgtggcgggaggcctgctgaccgtttgctacgtgctcaccggccgctccgccgacctggagcttgaaagagctgccgacgtccggtgggaggatcaagctgagattagcgggtccagccctatcctgtctattacaatcagcgaagacggatccatgtctattaagaacgaggaagaggagcagaccctcacaatcctgattcgcacgggcctcctggtgatcagcgggcttttccccgtctccatcccgattaccgccgccgcttggtatctgtgggaagtgaaaaagcagagagcgggagttctgtgggatgtgccttctccccctcccgtcggcaaagccgagctcgaagacggggcttaccggatcaagcagaagggcattctgggctatagccaaatcggcgccggggtgtacaaagagggaacatttcataccatgtggcacgttacacgcggcgccgtgcttatgcacaaggggaaaagaattgaaccctcctgggctgatgtcaagaaagacctgatctcttacggaggcgggtggaagctcgagggagagtggaaggaaggcgaggaagtccaggtgctggccctcgagcctggcaaaaacccgcgggcggttcagaccaagcccgggctgttcaaaacgaataccggaacaatcggcgctgtcagccttgatttttcccctgggaccagcggatctcccattgtggacaagaaaggcaaggtggtcgggctgtatggaaacggcgtggttacaagatccggcacctacgtgagcgccatcgcccagacagaaaagtctattgaggataatcctgagatcgaagacgatattttccgcaaaaagcggctgacgatcatggacctccatcccggggctggaaaaaccaagagatatctgcctgccatcgtccgcgaggcgattaaacggggccttagaacactgatcctcgctccgacccgcgtggttgccgccgaaatggaggaagctctgcgggggctccccattagataccaaacccctgccatccgcgctgagcacacaggacgggagattgtggatctgatgtgtcatgccacgttcaccatgagacttctgtcccccgtccgggtgcctaactataatctgatcattatggacgaagcgcactttacagaccccgccagcatcgctgcccgcggctacatctccaccagagttgagatgggggaagctgccggcattttcatgacagccaccccgcctggatctcgggatccctttccccagagcaacgctcctatcatggacgaggagcgcgaaattcccgagagatcctggaatagcggccatgaatgggtgacggatttcaaggggaagacagtctggtttgtgccttctatcaaagcgggaaacgacattgccgcttgcctccggaagaatggcaaaaaggtgatccagctgtccagaaaaaccttcgatagcgagtatatcaagacccgcacaaacgactgggattttgtcgttaccacagacatttctgaaatgggggccaatttcaaggccgagcgggtgatcgatccgagacgctgtatgaaacccgtgattcttaccgacggagaggaacgggtcatcctggctggccctatgcccgtgacgcacagctccgccgcgcaaagacgcgggcggattggcagaaaccctaagaatgagaacgatcagtacatctacatgggagaacccctcgagaatgacgaagactgcgctcactggaaagaggccaagatgctgctggataacatcaacacaccggagggcattatcccttctatgtttgaacccgagcgcgaaaaagttgacgccattgatggggagtatagactccggggagaagctcgcaagaccttcgtggaccttatgagacggggcgatctgcctgtctggctggcctaccgcgtggcggccgaggggatcaattatgctgacagacggtggtgttttgatggaattaaaaacaatcagatcctcgaggaaaacgttgaggtggaaatttggacaaaggagggcgagagaaagaaactgaagccccgctggcttgacgcccggatctacagcgatcctctggctctcaaagagttcaaggagttcgccgctgggagaaaatccctgaccctgaatctcatcacggaaatgggccgccttcccacctttatgacacagaaggcccggaacgcgctggacaatctggccgtcctccataccgctgaggccggaggcagagcttataaccacgccctgtctgaacttccggagacactggagaccctcctgctgctcacacttctggccaccgtgacagggggaattttcctgtttctcatgagcggcaaggggatcggaaaaatgacactgggcatgtgctgcattatcaccgcttccattcttctgtggtacgcgcaaatccagcctcattggatcgccgctagcattatcctcgagttctttctgattgtcctgctcatccccgagcccgaaaagcagcggacccctcaggataatcaacttacatatgtggttattgccatcctgaccgtggtggccgctacaatggccaacgagatgggcttcctggagaagacgaagaaagactttgggctcggatctatcgcgacccagcagccggagtccaatattctggatatcgaccttcgccccgccagcgcttggacactgtacgccgtcgctaccacattcattacccctatgctcagacactccatcgagaactctagcgttaatgtgtccctgacggccattgcgaaccaggccaccgtgctgatgggcctcgggaagggatggcccctttctaagatggacatcggcgtccctctgctggctattgggtgttacagccaagtgaatcccatcacactcaccgccgctctgcttctgctcgttgcccactatgctatcattggacctggcctgcaggccaaagcgacacgggaagcccagaagcgcgctgccgctggcatcatgaaaaacccgaccgtggatgggattacggtcatcgacctggatcccattccttacgaccccaagtttgagaaacagctcggacaagtgatgcttctggtcctgtgcgtgacacaggttctcatgatgagaaccacatgggccctgtgtgaagcccttaccctggcgaccggccctatctccacactctgggaggggaatcccggacggttctggaacacgaccatcgctgtgagcatggccaacatttttcgcggctcttatctggctggggccggactgctgttctccatcatgaagaatacagccaacaccagacggggcacaggcaataccggggaaacgcttggagagaagtggaaaaaccgcctgaatgctctgggcaagagcgagtttcagatttacaaaaagtctgggatccaagaagtcgatagaacactcgccaaagagggaattaagcggggcgaaaccgaccatcacgcggtgtccagagggagcgccaaactgcgctggttcgttgagcggaaccttgtgaccccggagggaaaggtcgtggatctgggctgcggcagagggggatggtcttattactgtggcgggctcaagaatgtgcgcgaagttaaaggactgacaaagggcgggcctggacatgaggaacccatccccatgagcacctatggctggaacctggtccggctccagtccggcgtggacgtgttctttacacctcccgagaaatgcgatacgcttctgtgtgacatcggggaatctagccctaatccgaccgtcgaggctggaagaacactgcgcgttctcaacctggtggagaattggcttaacaataacacccagttctgcattaaggtgctgaatccctacatgccttccgtcatcgagaaaatggaggccctccagcggaagtacggcggggctctggtgagaaaccccctgagccgcaactccacacacgaaatgtattgggtttctaatgccagcggaaacattgtgtcctctgtcaatatgatcagccggatgctcattaacagatttaccatgcgccataagaaagcgacgtacgagcctgatgtggaccttggctccgggacccggaatatcggaatcgaatctgagacacccaacctggatattatcggcaagagaattgagaaaatcaagcaagaacacgagaccagctggcactatgaccaggaccatccgtacaaaacatgggcctatcacggctcctacgaaaccaagcagacagggagcgcttcttccatggttaatggagtggtccgcctgctcaccaagccttgggatgtgattcccatggtgacgcagatggccatgacagacaccacccctttcggccaacagagagtctttaaagagaaggttgatacacggacgcaggaacccaaagaggggaccaagaaactgatgaagatcacagctgagtggctttggaaggaactgggcaaaaagaaaacccctcgcatgtgtacaagagaggagttcacccggaaggtgagaagcaacgccgctctcggcgccatttttacagacgagaataaatggaagtctgcgcgggaggccgtggaagattcccgcttctgggagctggtcgacaaagaaagaaacctgcatctcgaggggaagtgcgaaacctgtgtgtataatatgatgggaaagcgggagaaaaagctgggcgagtttggcaaagctaaggggagccgcgccatctggtacatgtggcttggagctagattcctggaatttgaggccctcggcttcctgaacgaagatcactggttttctcgggaaaattcccttagcggggttgaaggagagggcctgcacaaactcgggtacatcctgcgcgacgtgtccaagaaggagggcggagccatgtatgcggatgacacggctggctgggataccagaattacactggaagacctcaaaaacgaggaaatggtcaccaatcatatggagggggaacacaagaaactggccgaggccatcttcaaacttacataccagaacaaagtggttcgggtgcaacgccccaccccgagaggaacggtcatggacattatcagccggcgcgatcagagaggctctggacaggtgggaacatatggcctgaacaccttcacaaatatggaggctcaactcattcggcagatggaaggggagggcgtttttaagagcatccagcatctgaccgtgacggaagagatcgccgtccagaactggcttgctcgcgtgggaagagagcggctgtccagaatggccatttctggcgacgattgcgtcgtgaagcctctcgacgatcgcttcgcgagcgccctgaccgctctgaatgacatggggaaagttcggaaggatatccaacagtgggaaccctccagaggatggaacgactggacacaggtgcccttttgctctcaccatttccacgagctcattatgaaagatggccgcgtcctggtggtgccttgtcggaatcaggacgaacttatcgggagagcccgcattagccaaggagctggctggtccctgcgggagaccgcctgcctcgggaagtcttacgcgcagatgtggagcctgatgtattttcacagacgcgatcttcggctggccgctaacgccatctgttccgctgttccgagccattgggtgcccacatctagaaccacatggtccatccacgcccgccatgaatggatgaccacggaggacatgctcacagtctggaatcgggtgtggattcaggagaacccttggatggaagataaaacccccgttgagagctgggaagagatcccttacctgggcaagagagaagaccagtggtgcggatctctgattggcctcacctcccgggctacatgggccaagaatatccaaaccgcgattaaccaggtgagaagcctgatcgggaatgaggagtatacagactacatgccctccatgaaacgcttccggagagaagaggaagaggccggagtcctttggtga

SEQ ID NO: 20280 - RNA, 9876 nt, synthetic construct
  misc_feature 1..9876: note = derived and/or modified CDS sequence (opt5) from DENV-2__GQ398261__SS-prME
  source 1..9876: mol_type = other RNA
accgccggcatgatcattatgctgatccccacagtgatggctttccacctcacgacccggaatggggagcctcatatgattgtcagccggcaggaaaagggaaaatccctgctttttaagacagaggacggcgttaatatgtgcaccctgatggccatggatctcggggaactgtgtgaggacacaatcacctacaattgcccgcttctgagacaaaatgaacccgaggatattgactgttggtgcaactctacaagcacctggatcacgtatggaacctgtacagcgaccggcgagcacagacgggaaaaacgctccgtggctctcgtgcctcatgtcgggatgggactggagacaagaaccgaaacgtggatgtctagcgagggcgcctggaagcacgcccagcggatcgagacatggattctgcgccatcccggcttcaccatcatggctgccattctcgcttacacaatcgggaccacctattttcagagagtgctgattttcatccttctgacagccgttgcgccttccatgacgatgcggtgcattggaatctctaatcgcgattttgtggaaggcgtcagcgggggatcctgggtggacatcgttctcgagcacggcagctgtgtgaccacaatggccaaaaacaagcccaccctggatttcgaacttattaagacagaggctaaacagcctgccaccctgagaaagtactgcatcgaagctaaactcacgaatacaaccaccgcctctcggtgtccgacacaaggggagccctccctgaacgaggaacaggacaagcgctttgtctgcaaacacagcatggtggatagaggatggggcaatggctgtgggctgttcggaaagggcgggattgtgacctgcgcgatgtttacatgcaagaaaaacatggagggaaaggtcgttcagcctgaaaatctcgagtatacgatcgtgattacaccccattctggcgaagagaacgccgtggggaatgacacaggaaaacacggcaaggagatcaaaatcacccctcagtccagcattacagaagctgagctgaccggctacgggacggtcaccatggaatgttctccccggacaggacttgatttcaacgagatggtgctgctccaaatggaaaataaggcctggctggttcatcgccagtggtttcttgacctgccgctcccttggctgcccggcgctgatacccaggggtccaactggatccagaaagagacactggtgaccttcaagaaccctcacgccaagaaacaagacgtcgtggttctcggaagccaggagggcgccatgcacacggctctgacaggggcgaccgaaattcagatgtcctctggcaatcttctgtttacaggacatctcaagtgcagactgcggatggacaaacttcaactgaagggcatgagctattccatgtgtaccgggaaattcaaggtggtcaaggagatcgccgaaacccagcacggaacaattgtggtcagagtgcagtacgagggcgatgggagcccctgcaaaatccccttcgagatcatggacctcgaaaagcgccatgttctgggacggctgattacggtgaaccctatcgtcaccgagaaagattctccggtgaatattgaagctgagcccccttttggcgactcctacatcattatcggggttgaacccggccagctcaagctgaactggttcaaaaagggaagctctattggccaaatgtttgagacaaccatgagaggggccaagcgcatggccatccttggagatacagcttgggacttcggcagcctcgggggagtgtttacctccatcggcaaagccctccaccaggtcttcggggcgatttatggcgctgccttttctggagtgagctggacgatgaagatcctgattggcgtggttatcacatggattgggatgaactcccggagcacctctctgtccgtcagccttgtgctcgtgggagtcgtgaccctgtacctgggcgttatggtgcaggccgattctgggtgtgtcgtgtcctggaaaaacaaggagctcaaatgcggaagcggcatcttcgttacagacaatgtgcatacctggacagaacagtataagtttcaacctgagtccccctctaagctggctagcgccatccagaaagctcacgaagaggggatttgtggcatcagatccgtcacgcgccttgaaaacctgatgtggaagcagattaccccggagctcaatcacatcctgtctgagaacgaagtgaaactgacaattatgaccggagatatcaagggcatcatgcaggccgggaaacggagccttagacctcaacccacagagctcaagtactcctggaaaacctggggaaaggcgaagatgctgagcacggaactgcataatcagaccttcctcattgacggccctgagacagccgaatgccccaacaccaatcgcgcttggaactctctggaggttgaggattatgggtttggagtgttcacaaccaatatctggcttaaactgaaggaacggcaggacgtcttttgtgactccaaactcatgagcgccgctattaaggataacagagccgtgcacgcggacatgggctactggatcgagtctgccctgaacgatacatggaaaattgaaaaggcttccttcatcgaggtcaagagctgccattggcctaaatctcacaccctgtggagcaatggcgtgcttgagtccgaaatgatcattcccaagaacttcgccgggccggttagccagcacaattatcgccctggataccatacgcaaacagctggcccctggcacctcgggaaactggagatggactttaacttctgtgaaggaaccaccgtggtggtcacaggcgattgcgggaatcggggacccgccctgagaaccacgacagcctctggcaagctcatcaccgagtggtgctgtcggtcctgcacactgcctccgcttcgctacagaggcgaagacgggtgttggtatggaatggagattcggcccctgaaagagaaggaagagaacctcgtgaatagcctggttaccgctggccatgggcagatcgataacttttccctgggagtgcttggcatggcgctgttcctggaagagatgctgagaacacgcgtcgggaccaagcacgccattctcctggtggctgtttcttttgtgacgcttatcaccggaaatatgagcttccgggacctgggcagagtcatggtgatggttggcgccacaatgaccgatgacattgggatgggagtgacatacctcgccctgctggctgcctttaaagtccgccctaccttcgcggctggccttctgctcagaaagctgacgtccaaagaactcatgatgacaaccatcgggatcgtgctgctttctcagagcacaattcccgagaccatcctggagctcaccgatgccctggccctgggaatgatggtgcttaagattgtccggaacatggaaaaatatcaactggctgttacaatcatggccattctctgcgtgcctaatgcggtgatcctgcagaacgcttggaaggtctcctgtacgatcctcgccgtggtttctgtgagccccctgcttctgacctccagccagcagaaggccgactggattcctctcgctctgacaatcaaaggcctgaatcccaccgccatttttcttacaaccctgtctcgcacgtccaagaaaagaagctggccgctcaacgaggctatcatggccgtcgggatggtgtctattctggcgtccagcctcctgaagaatgatatccctatgacaggaccccttgttgccggcggcctgctgaccgtgtgctacgtcctcaccgggcggtctgctgacctggaacttgagcgcgccgctgacgtgagatgggaagatcaagccgagatctccggaagctcccctattctgagcatcacaatttctgaggacggcagcatgtccatcaaaaacgaagaggaagaacagaccctcacaattctgatccggacggggctcctggtcatttctggacttttccccgtgagcatcccgatcaccgccgctgcgtggtatctgtgggaggttaagaaacagcgcgccggcgtgctgtgggatgtcccttctccccctcccgtggggaaggctgaactcgaggacggagcctacagaattaagcagaaaggcatcctgggctatagccaaattggggccggagtttacaaggaaggcacatttcataccatgtggcacgtgacaagaggggctgtccttatgcacaaaggaaagcgcatcgagcccagctgggccgatgtgaaaaaggacctgatttcctacggcgggggatggaagctcgaaggcgagtggaaagagggcgaagaggtgcaggttctggcgctcgaacctgggaagaacccgagagctgtccagaccaaacccggactgttcaagacgaataccggcacaatcggggccgtgtctcttgattttagccctggaacctccggcagccccatcgtggacaaaaaggggaaggtcgtgggactgtatggcaacggcgttgtgacacggtctgggacctacgtctccgccattgctcagacagagaaaagcatcgaagataatcctgagattgaggacgatatcttcagaaagaaacgcctgacgattatggacctccatcccggagccggcaagaccaaacggtatctgcctgcgatcgtgagagaagctatcaagcgcgggcttcggacactgattctcgccccgaccagagttgtggccgctgagatggaagaggccctgcgcggactccccatccggtaccaaacccctgctattagagccgaacacacaggccgcgagatcgtcgatctgatgtgtcatgcgacgttcaccatgcggcttctgtctcccgtgagagttcctaactataatctgattatcatggacgaggcccactttacagaccccgcttccattgccgctcgggggtacatcagcacccgcgtggaaatgggcgaggccgccggaatcttcatgacagctaccccgcctggctccagagatccctttccccagtctaacgcgcctattatggacgaggaacgggagatccccgaacgcagctggaactccgggcatgagtgggtcacggatttcaagggaaaaacagtgtggtttgtgcctagcattaaggccggcaacgacatcgctgcctgcctccgcaaaaatgggaagaaagtcattcagctgtctcggaagaccttcgattccgaatatatcaagaccagaacaaacgactgggattttgttgtgaccacagacatcagcgagatgggagccaatttcaaagctgaacgcgtgattgatccgcggagatgtatgaagcccgtcatccttaccgacggcgaggagcgcgtgattctggccgggcctatgcccgttacgcactctagcgcggctcaacggagaggccgcatcggacggaaccctaaaaatgaaaacgatcagtacatttacatgggcgagcccctcgaaaatgacgaggactgcgcccactggaaggaagccaaaatgctgctggataacatcaacacaccggaggggatcattccttccatgtttgagcccgaaagagagaaggtggacgctatcgatggagaatatcgcctcagaggcgaggcccggaaaaccttcgtcgaccttatgcgcagaggggatctgcctgtgtggctggcgtaccgggttgccgctgaaggaattaattatgccgaccgcagatggtgttttgatggcatcaagaacaatcagattctcgaggagaacgtggaagtcgagatctggacaaaggaaggggagcggaaaaagctgaaacccagatggcttgacgctcgcatttactctgatcctctggccctcaaggagttcaaagagttcgctgccggccggaagtccctgaccctgaatctcatcacggagatcggaagacttcccacctttatgacacagaaggcgcgcaacgccctggacaatctggctgtgctccataccgccgaagctggcgggcgggcctataaccacgccctgtccgagcttccggaaacactggagaccctcctgctgctcacacttctggctaccgtcacgggaggcattttcctgtttctcatgtctgggaaaggaatcggcaagatgacactgggcatgtgctgcattatcaccgcgagcattcttctgtggtacgcccaaatccagcctcattggatcgctgcctccattatcctcgagttctttctgattgtgctgctcatccccgaacccgagaaacagagaacccctcaggataatcaacttacatatgttgtgattgccatcctgaccgtggtcgctgccacaatggcgaacgaaatggggttcctggagaagacgaaaaaggactttggactcggcagcatcgccacccagcagccggaatctaatattctggatatcgaccttcggcccgcttccgcctggacactgtacgctgttgccaccacattcattacccctatgctccgccacagcatcgagaactcctctgtgaatgtgagcctgacggcgattgccaaccaggctaccgtcctgatggggctcggaaagggctggcccctttccaaaatggacatcggggtgcctctgctggccattggatgttactctcaagttaatcccatcacactcaccgctgccctgcttctgctcgtggctcactatgccatcattggccctggcctgcaggcgaaggccacaagagaggctcagaaacgggccgctgccgggatcatgaagaacccgaccgtcgatggaattacggtgatcgacctggatcccattccttacgaccccaaatttgaaaagcagctcggccaagtcatgcttctggtgctgtgcgttacacaggtgctcatgatgcgcaccacatgggccctgtgtgaggcgcttaccctggctaccgggcctatcagcacactctgggaaggaaatcccggcagattctggaacacgaccatcgccgtctccatggctaacatttttcgggggagctatctggccggagccggcctcctgttctctatcatgaagaatacagctaacacccgcagaggcacagggaataccggagagacgcttggcgaaaaatggaagaaccggctgaatgccctggggaaatccgagtttcagatttacaagaaaagcggaatccaagaggtggatcgcacactcgcgaaggaaggcattaaaagaggggagaccgaccatcacgccgtttctcggggatccgctaagctgagatggttcgtggaacgcaaccttgtcaccccggagggcaaggtggtggatctgggctgcgggcggggaggctggagctattactgtgggggactcaaaaatgttagagaggtcaagggcctgacaaaagggggacctggccatgaggaacccatccccatgtctacctatggctggaacctggtgcgcctccagagcggggtggacgtcttctttacacctcccgaaaagtgcgatacgcttctgtgtgacatcggagagtcctctcctaatccgaccattgaagccggccggacactgagagttctcaacctggtggagaattggcttaacaataacacccagttctgcatcaaagtgctgaatccctacatgcctagcgtcattgagaagatggaagctctccagcgcaagtacgggggagccctggtgcggaaccccctgtccagaaacagcacacacgagatgtattgggtttccaatgcgtctggcaacatcgtgagctccgtcaatatgatttctcgcatgctcatcaaccggtttaccatgagacataaaaaggccacgtacgaacctgatgtggaccttgggagcggaacccgcaatatcggcattgagtccgaaacacccaacctggatatcattggcaaacggatcgagaagattaaacaagagcacgaaacctcttggcactatgaccaggaccatccgtacaagacatgggcttatcacgggagctacgagaccaagcagacaggatccgccagctctatggttaatggcgtggtcagactgctcaccaaaccttgggatgtgatccccacggtgacacagatggctatgaccgacaccacacctttcgggcaacagcgcgtctttaaggaaaaagttgatacgagaacccaggagcccaaggaaggaaccaaaaagctgatgaagattaccgccgagtggctttggaaagagctgggcaagaaaaagacacctcggatgtgtacccgcgaagagttcacaagaaaagtgcggtccaacgctgccctcggggcgatctttaccgacgaaaataagtggaaaagcgccagagaggctgtggaggattctcggttctgggaactggtcgacaaggagcgcaacctgcatctcgaaggaaagtgcgagacgtgtgtgtataatatgatgggcaaaagagaaaagaaactgggcgagtttgggaaggccaaaggatcccgggctatctggtacatgtggcttggcgcccgcttcctggagtttgaagccctcgggttcctgaacgaggatcactggtttagcagagaaaattctctttccggagttgagggcgaagggctgcacaagctcggctacattctgcgggacgtgagcaagaaagagggaggcgcgatgtatgctgatgacaccgccgggtgggatacacgcatcaccctggaggacctcaagaacgaagagatggtcacaaatcatatggaaggagagcacaaaaagctggccgaagctattttcaaacttacctaccagaacaaggtggttagagtgcaacggcccacgccgcgcggcacagtcatggacatcatttccagacgggatcagcgcgggagcggacaggtgggcacctatgggctgaacacattcaccaatatggaggcccaactcatcagacagatggagggcgaaggagtttttaagtctatccagcatctgacggtgaccgaggaaattgctgtccagaactggcttgcccgggtgggccgcgagagactgagccggatggcgatctccggggacgattgcgtcgtgaaacctctcgacgatagattcgcctctgctctgacagccctgaatgacatgggaaaggttcgcaaagatattcaacagtgggagcccagccggggctggaacgactggacccaggtgcccttttgctcccaccatttccacgaactcatcatgaaggatgggagagtcctggtggtgccttgtcgcaatcaggacgagcttattggacgggctagaatctctcaaggcgccgggtggagcctgcgcgaaacagcgtgcctcggcaaatcctacgcccagatgtggtctctgatgtattttcaccggagagatcttcgcctggctgccaacgctatctgtagcgccgttccgtcccattgggtgcccaccagccggacaacctggtctattcacgctagacatgagtggatgacgacagaagacatgctcaccgtctggaatcgcgtgtggatccaggagaacccttggatggaggataagacccccgttgaatcctgggaggaaattccttacctgggaaagcgggaggaccagtggtgcggcagcctgatcgggctcacatctagagccacctgggcgaaaaatattcaaacagccatcaaccaggtgcggtccctgattggaaatgaagagtatacggactacatgcccagcatgaagagattccgccgggaggaagaggaagctggcgtcctttggtga

SEQ ID NO: 20281 - RNA, 9876 nt, synthetic construct
  misc_feature 1..9876: note = derived and/or modified CDS sequence (opt5) from DENV-2__GQ398313__SS-prME
  source 1..9876: mol_type = other RNA
accgcgggagtgatcattatgctgatccccaccgctatggccttccacctcacgacccggaacggggagcctcatatgattgtcggacggcaggaaaagggcaagtccctgctttttaagaccgaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggccctcttcctggaagagatgctgagaacacgcgtcgggaccaaacacgccatgctcctggtggctgtttcctttgtgacgcttatcaccggaaacatgtctttccgggacctgggcagagtcatggtgatggttggcgccacaatgaccgatgacatcgggatgggaattacatatctcgccctgctggctgcctttaaggtgcgccctaccttcgcggctggccttctgctcagaaaactgacgagcaaggagctcatgatggccacaatcgggattgccctgctttcccagtctaccatccccgaaacaattctggagctcaccgatgctctggccctgggaatgatggtccttaaaatcgtgcggaatatggaaaagtaccagctggcggttaccatcatggctattagctgcgtgcctaacgccgtcatcctccaaaatgcctggaaggtgtcctgtacaattctggctgccgtgagcgtctctcccctcctgcttacgtccagccagcagaaagctgactggatccctctggccctcaccattaagggcctgaaccccacagcgatctttctgaccacactttctcgcacctccaaaaagagaagctggccgctgaatgaggccgttatggctgtggggatggtgtctatcctcgcctccagcctgctcaaaaacgacattcctatgacgggacccctggtcgctggcggccttctgacagtgtgctatgttctgaccgggcggtccgccgatctcgaactggagcgcgccgctgacgtgaagtgggaggatcaggcggaaatcagcggatctagccctattctttccatcaccatttctgaggacggcagcatgtccatcaaaaatgaagaggaggaacaaacactgaccattctcatcagaacagggctgctcgtcatctctggagtgttccccgttagcattccgatcacggccgctgcctggtacctgtgggaggtgaagaagcagcgggccggcgtcctttgggatgtgccttctccccctcccgtcgggaaagctgaactggaggacggagcctatcgcattaagcagagaggcatcctgggctacagccagattggggcgggagtgtataaagaaggcacctttcacacaatgtggcatgttaccagaggggctgtgctcatgcaccgcggaaagagaatcgagcccagctgggccgatgtcaaaaaggacctgatctcctacggcgggggatggaaacttgagggcgaatggaaagagggcgaagaggtgcaagttctggccctcgaacctgggaagaacccgcgggctgtgcagacaaaacccggactgttcaagaccaatacgggcaccattggggccgtcagcctcgatttttctcctggaacatccggcagccccatcgtggacagaaaagggaaggtggttggactgtacggcaacggcgtcgtgacccgctctggggcgtatgtgtccgctattgcccagacagaaaagagcatcgaggataatcctgaaattgaggacgatatcttccggaaaaagagacttaccatcatggacctgcatcccggagccggcaaaacaaagcgctacctgcctgctattgtccgggaagccatcaaaagagggctccgcacgctgattcttgctccgacccgggtggttgccgcggagatggaagaggccctgagaggactccccatccgctatcagacccctgctattcgggccgagcacaccggcagagaaatcgtggacctgatgtgtcatgctaccttcacaatgcggctcctgtcccccgtccgcgtgcctaactacaaccttattatcatggatgaggcccactttacggaccccgcctctatcgctgcgagagggtatattagcacccgggttgaaatgggcgaggccgctggaatcttcatgacagccaccccgcctggctcccgcgatccctttccccaaagcaatgcccctattatggacgaggaaagagagatccccgaacggtcttggaactccgggcacgagtgggtgacagatttcaagggaaagaccgtctggtttgtgcctagcattaaagctggcaatgacatcgccgcgtgcctgagaaagaacgggaaaaaggttatccagctgtctcgcaaaacgttcgatagcgaatacgtgaagacacgggctaatgactgggattttgtcgtgaccaccgacatttccgagatgggagccaacttcaaggccgagagagtgatcgatccgcgccggtgtatgaaacccgtcattctcacagacggcgaagagagagttatcctggctgggcctatgcccgtgacccattctagcgccgcgcagcgccggggcagaattggacgcaatcctaagaacgaaaatgaccaatatatctacatgggcgagccccttgaaaacgatgaggactgcgcccactggaaagaggctaagatgctgctcgataatatcaacacaccggaagggattatcccttccatgtttgagcccgaaagagagaaagtggacgccattgatggagaataccggctgcgcggcgaggctagaaagaccttcgtcgacctgatgcggcgcggggatctccctgtgtggcttgcctatagagttgctgccgagggaatcaattacgcggaccggagatggtgttttgatggcattaaaaacaatcagatcctggaagagaacgtggaagtcgagatttggacgaaggagggggaacgcaagaaactgaagccccggtggctcgacgccagaatctattctgatcctctggctcttaaagagttcaaggagttcgccgctggccgcaaaagcctgacactcaacctgatcaccgagatgggacggctgcccacatttatgacccagaaggccagagacgccctcgataatcttgctgtgctgcatacggcggaagccggcgggcgggcttacaaccacgccctgtccgagctcccggagaccctggaaacacttctgctcctgaccctgctcgccacagttaccggaggcattttcctttttctgatgagcgggaagggaatcggcaaaatgacactgggcatgtgctgcattatcaccgcttctattctcctgtggtatgcccagatccaacctcactggatcgcggcctccattatccttgagttctttctgattgtgctcctgatccccgaacccgagaagcagcgcacgcctcaggacaatcagctgacatacgtcgtgattgctatcctcaccgtcgtggccgctaccatggccaacgaaatggggttccttgagaaaacaaagaaagacctgggactgggcagcatcgcgacccaagagtccgaatctaatattctcgatatcgacctgagaccggccagcgcttggacactttatgccgttgctacgacctttgtgacacccatgctgcggcattccattgagaactctagcgtgaatgtctccctcaccgccatcgctaaccaggccacagttctgatggggctgggaaagggctggcctctcagcaagatggatattggggtgccccttctggcgatcggatgttactctcaggtgaatcctattaccctgacggccgctctcctgcttctggtcgcccactacgctatcatcggccccggcctccaggccaaagccacccgcgaagcgcaaaagagagctgccgctgggattatgaaaaaccctacagtggacggaatcaccgttattgatctggagccgatcccctatgaccctaagttcgaaaaacagctgggccaggtgatgctccttattctgtgcgtcacacaggtgctgatgatgcggaccacgtgggccctctgtgaggccctgacacttgctaccgggcccatctccacactgtgggagggaaatcctggccgcttttggaacaccaccatcgccgtcagcatggcgaatattttcagagggtcttacctcgccggagctggcctgctgttttccatcatgaagaacacaacgaatacccggcgcggcacagggaacattggagaaaccctcggcgagaagtggaaaagcagacttaatgccctggggaagtctgagttccaaatctataaaaagagcggcattcaggaggtggatcggacactggctaaagagggcatcaagagaggggaaaccgaccatcacgccgtttcccgcggatctgcgaaactccggtggtttgtggagagaaacatggtcacgcccgaaggcaaggtggttgatctgggctgcgggcgcggaggctggagctactattgtgggggacttaagaacgtgcgggaggtcaaaggcctgacaaaagggggaccgggccatgaagaacctatccccatgtccacctacggctggaatctcgtgagactgcagagcggggtggacgttttcttcacaccccctgagaaatgcgatacactgctctgtgacattggagaatcctctcccaaccctaccatcgaggccggccgcacacttcgggtcctgaatctggtggaaaactggctcaataacaatacgcaattttgcattaaggtgctgaacccgtatatgcccagcgtcatcgagaaaatggaaacccttcagagaaagtacgggggagctctggttcgcaatcctctctcccggaactctacacacgagatgtactgggtgagcaatgccaccggcaacattgtgtcctctgtcaatatgatcagcagaatgctgatcaaccgcttcacaatgaagcacaaaaaggctacctatgagcccgatgtggacctggggtccggaacgcggaatattggcatcgaaagcgagattcctaacctcgacatcattggcaaaagaatcgaaaagattaaacaggagcatgaaacctcttggcactacgatcaggaccatccctataagacatgggcctaccacgggtcctatgagaccaagcaaacaggaagcgcttcttccatggttaacggcgtggtccgccttctgaccaaaccgtgggatgtggttcctatggtgacacagatggccatgaccgacacgacaccctttgggcagcagagagtcttcaaggagaaagtggatacccggacccaagaacctaaggagggaaccaagaagctgatgaagatcacggcggaatggctctggaaagagctgggcaagaaaaagacaccccgcatgtgtacaagagaggaatttacccggaaagtgagaagcaatgccgctcttggggccatcttcacagacgagaacaagtggaaatctgctcgggaagccgtcgaggattcccgcttttgggaactgattgacagagagcggaatctccacctggagggaaagtgcgaaacctgtgtttacaacatgatgggcaagcgcgagaaaaagctgggcgagttcgggaaagccaagggaagcagagcgatctggtatatgtggctcggcgctcggtttctggagttcgaagcccttgggtttctgaatgaggatcattggttctcccgcggaaacagcctctctggcgtggagggggaaggcctgcacagacttggatacattctgcgggacgtgagcaaaaaggagggcggggccatgtacgctgatgacacagccggatgggacacccgcatcacgctcgaagatctgaagaatgaggaaatggtcaccaaccatatgaaaggcgagcacaagaaactggctgaggccatttttaagctcacatatcagaataaagtggttagagtgcagcggcctacaccccgcgggacagtcatggacatcatctccagacgggatcagcgcggatctggccaagtggggacctacggcctgaacacgttcacaaatatggaagcgcagcttattagacagatggagggagaaggcatcttcaagagcattcaacatctgaccgttacagaggagatcgccgtgcagaactggctcgctcgggtcgggagagaacgcctgtcccggatggccatttctggagacgattgcgtggttaagccgcttgacgatagatttgctagcgccctgaccgcgctcaatgacatgggcaaagtgcgcaaggatatccagcagtgggagccttcccgggggtggaacgactggacgcaagtccccttctgctctcaccactttcatgaactggtgatgaaagatggaagagtcctggtggttccctgtcgcaatcaggacgagctcatcggccgggccagaattagccagggggctggctggtccctgaaggaaaccgcctgccttggaaaaagctatgctcagatgtggacactgatgtacttccaccgccgggatctcagactggccgctaacgccatctgttctgcggtgccttcccattgggtcccgaccagccgcacaacctggtctattcacgccaagcacgagtggatgacaaccgaggacatgcttgctgtgtggaaccgggtgtggatccaagaaaatccctggatggaggacaagacgcctgttgaatcctgggaggaagtgccctatctgggcaaaagagaggatcagtggtgcgggagcctcattggactgacatcccgggccacctgggccaagaacatccagaccgctattaatcaggtcagatctctgatcggcaacgaggaatacacagactatatgcctagcatgaaacgctttcggagagaggaagaggaagccggggtgctctggtga

SEQ ID NO: 20282 - RNA, 9876 nt, synthetic construct
  misc_feature 1..9876: note = derived and/or modified CDS sequence (opt5) from DENV-2__GQ398285__SS-prME
  source 1..9876: mol_type = other RNA
accgctggagtgatcattatgctgatccccaccgctatggccttccacctcacgacccggaacggggagcctcatatgattgtcggacggcaggaaaagggcaaatccctgctttttaagaccgaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggatgggcctggatttcaacgaaatggttctcctgcagatggaggacaaggcttggcttgtgcaccgccaatggtttctggatctcccgctgccttggctgcccggggccgacacccagggatctaattggatccagaaggagacactcgtcaccttcaagaaccctcatgctaaaaagcaggacgtggttgtgctgggctcccaagaaggggccatgcacacggcccttacaggcgctaccgagattcagatgagctccggaaatctgctctttacaggccatctgaaatgcagacttcggatggataagctgcagctcaaagggatgtcttacagcatgtgtaccggaaagttcaagatcgtcaaagaaattgcggagacccaacacggcacaatcgtgatcagagtccagtatgagggggacggatccccctgcaagattcccttcgaaatcatggatctggagaaacgccatgtgctgggccggctcattacggttaaccctatcgtgaccgaaaaggacagcccggtcaacattgaggccgaacccccttttggggattcttacatcattatcggcgtggagcccggacagctgaaacttaattggttcaagaagggctccagcatcgggcagatgtttgagacaaccatgagaggagctaaacgcatggccattctgggcgacacagcctgggatttcgggtctctcggaggcgtttttaccagcatcgggaaggctctgcaccaagtgttcggcacgatttacggagccgcgttttccggcgtctcttggacaatgaaaatcctgattggggtgatcatcacctggattggaatgaacagccggtccaccagcctttctgtgtccctcgttctggtcggcgtggtgacactgtatctcggggctatggtccaggccgacagcggatgtgtggtttcttggaagtccaaagaactgaagtgcggcagcgggatcttcattaccgataatgtgcacacatggacggagcagtacaagtttcagcctgaatccccctctaaacttgccagcgctatccaaaaggcccatgaggaaggcatttgtggaatcagatccgtcacccgcctggagaacctcatgtggaaacagatcacaccggagctgaatcacattctgtctgaaaacgaggtgaaacttaccatcatgacaggcgggattaaaggaatcatgcaggctggcaagcggagcctcagacctcagcccaccgaactgaaatattcctggaagacgtgggggaaggccaaaatgctgagcaccgagtctcataatcaaacattcctcattgacggacctgaaaccgcggagtgccccaacacaaatcgcgcctggaactccctggaggttgaagattacggctttggcgtgttcaccacaaatatctggcttaagctgcgggagaaacaggacgtcttttgtgacagcaagctcatgtctgctgccatcaaagataacagagctgtgcacgccgacatggggtattggattgaatccgcgctgaatgatacctggaagatggagaaggccagcttcatcgaggttaaatcttgccactggcctaagagccatacgctgtggtccaacggagtgcttgaaagcgagatgattatccccaaaaatctcgctggcccggtctctcagcacaactaccgccctgggtatcatacacagaccgccggaccctggcacctgggcaagctggaaatggacttcgatttttgtgaggggaccacagtggtggtcaccgaagactgcggaaaccggggcccctccctcagaacgacaaccgctagcggcaaactggttacagagtggtgctgtcggtcctgcacccttcctccgctgcgctacagaggggaggatggatgttggtacggcatggaaattcggcccctcaaggagaaggaagagaatctggtgaactctctggtgacagccgggcatggacaaatcgacaatttcagccttggcgtcctcgggatggccctgtttctggaagagatgctcagaacccgcgtgggaacgaaacacgctattctgcttgttgcggtgtccttcgtcaccctgatcacaggcaacatgtcttttcgggatctcggcagagtgatggttatggtgggggccaccatgacagacgatatcggaatgggcgtcacctatctggctctgcttgccgccttcaaggtgcgccctacgtttgctgccgggctgctcctgagaaaactcacaagcaaggagctgatgatggcgaccattggaatcgcccttctgtcccagtctacaattcccgaaaccatcctcgagctgaccgacgccctggcccttggcatgatggttctgaaaattgtgcggaatatggaaaagtaccagctcgctgtcacaatcatggccatcagctgcgtgcctaacgcggtgattctgcaaaatgcttggaaggtctcctgtacgatcctcgccgccgttagcgtgtctcccctgcttctgacctccagccagcagaaagctgattggattcctctcgccctgacaatcaaggggctgaaccccaccgctattttccttacaaccctgtctcgcacgtccaaaaagagaagctggccgctcaatgaggccatcatggcggtgggaatggtctctatcctggcctccagcctcctgaaaaacgacattcctatgacaggcccccttgtggctggcgggctgctgaccgtttgctatgtgctcaccggacggtccgccgacctggaacttgagcgcgctgccgatgtcaagtgggaggaccaggccgaaatcagcggctctagccctattctgtccatcacaatttctgaggatgggagcatgtccatcaaaaatgaagaggaggaacaaaccctcacaattctgatcagaacgggactcctggtgatctctggcgtttttcccgtgagcattccgatcaccgctgcggcctggtacctttgggaggtcaagaagcagcgggctggggtgctgtgggacgtcccttctccccctcccgtgggaaaagccgaactggaggatggcgcctatcgcattaagcagagaggcatcctcgggtacagccagattggagctggcgtttataaagaagggacattccacaccatgtggcatgtgacacggggagccgtcctgatgcaccgcggcaagagaatcgagcccagctgggcggacgtgaaaaaggatcttatctcctacgggggaggctggaagctggagggcgaatggaaagagggggaagaggttcaagtgctcgctctggaacctggaaagaacccgcgggccgtccagaccaaacccggcctctttaagacgaataccgggacaattggagccgtgagcctggacttctctcctggcacctccgggagccccatcgtggatagaaaaggaaaggttgtcggcctttacggcaacggggtggtgacacgctctggagcttatgtctccgccattgcgcagaccgaaaagagcatcgaggacaatcctgaaattgaggatgacatctttcggaaaaagagactgacaatcatggatctgcatcccggcgctgggaaaacgaagcgctacctccctgccattgtgcgggaagccatcaaaagaggactgcgcacccttattctggctccgacacgggttgtggccgctgagatggaagaggccctcagaggcctgcccatccgctatcagacccctgcgattcgggccgagcacaccgggagagaaatcgtcgacctcatgtgtcatgctacattcacgatgcggctgctttcccccgtgcgcgttcctaactacaacctgattatcatggacgaggcccacttcaccgatcccgcttctatcgccgccagaggctatattagcacacgggtggaaatgggagaggctgcgggcatctttatgaccgccacaccgcctgggtcccgcgaccccttcccccaaagcaatgctcctattatggatgaggaaagagagatccccgaacggtcttggaactccggacacgagtgggtcaccgactttaagggcaagacggtgtggttcgttcctagcattaaagccgggaatgatatcgccgcttgcctgagaaagaacggcaagaaggtgatccagctctctcgcaaaacatttgacagcgaatacgtcaagacccgggccaatgattgggacttcgtggtgaccacagatatttccgagatgggcgcgaactttaaggctgagagagtcatcgacccgcgccggtgtatgaaacccgttattctgaccgatggggaagagagagtgatccttgccggccctatgcccgtgacacattctagcgccgctcagcgccggggaagaattggccgcaatcctaagaacgaaaatgaccaatatatctacatgggggagcccctggaaaacgacgaggattgcgcccactggaaagaggcgaagatgctcctggacaatatcaacaccccggaaggaattatcccttccatgttcgagcccgaaagagagaaagtcgatgccattgacggcgaataccggctgcgcggggaggctagaaagacgtttgtggatctcatgcggcgcggagaccttcctgtttggctggcctatagagtggctgccgagggcatcaattacgctgatcggagatggtgtttcgacgggattaaaaacaatcagatcctggaagagaacgtcgaagtggagatttggacaaaggagggcgaacgcaagaaactcaagccccggtggctggatgccagaatctattctgaccctcttgcgctgaaagagtttaaggagttcgccgctggacgcaaaagcctcaccctgaacctgatcacagagatgggccggctccccaccttcatgacgcagaaggccagaaatgctcttgataacctggccgttctgcataccgccgaagctgggggacgggcgtacaatcacgccctctccgagctgccggagacacttgaaaccctgctcctgctgacactccttgctaccgtgacaggcgggatttttctgttcctgatgagcggaaagggcatcggcaaaatgaccctcgggatgtgctgcattatcacggcctctattctgctttggtatgcccagatccaacctcactggatcgctgcctccattatcctggagtttttcctcattgtcctgctgatccccgaacccgagaagcagcgcacacctcaggacaaccagctcacctacgtggtcattgcgatccttaccgtggttgccgctacaatggccaatgaaatgggatttctggagaaaaccaagaaagatctgggcctcgggagcatcacaacgcaagagtccgaatctaacattctggacatcgaccttagaccggctagcgcctggaccctgtatgcggtggccacaaccttcgtgacacccatgctccggcattccattgaaaattctagcgtcaacgtttccctgaccgctatcgccaatcaggctacggtgctgatgggactcggcaaggggtggcctcttagcaagatggatattggagtgcccctgctggccatcggctgttactctcaggtcaaccctattaccctcacagctgccctgcttctgctcgtggcgcactacgccatcatcggccccgggctgcaggctaaagccacccgcgaagctcaaaagagagccgccgcgggaattatgaaaaatcctacagttgacggcatcaccgtgattgatctggagccgatcccctatgaccctaagtttgaaaaacagctcgggcaggtcatgcttctgattctgtgcgtgacgcaggtcctcatgatgcggacaacctgggctctgtgtgaggcccttacactggctaccggacccatctccaccctctgggagggcaaccctgggcgcttctggaatacaacgatcgccgtgagcatggccaacatttttagaggatcttacctggctggcgccggcctcctgttctccatcatgaagaataccacaaacacccggcgcgggacaggaaatattggcgaaacccttggggagaagtggaaaagcagactgaacgcgctgggaaagtctgaatttcaaatctataaaaagagcggcattcaggaggttgatcggacgctcgccaaagaggggatcaagagaggagaaacagaccatcacgctgtgtcccgcggctctgccaaactgcggtggttcgtcgagagaaacatggtgacccccgaaggcaaggttgtggatcttgggtgcggacgcggcgggtggagctactattgtggaggcctgaagaatgtccgggaggtgaaagggctcaccaagggaggcccgggccatgaggagcctatccccatgtccacatacgggtggaacctggtgagactgcagagcggagttgacgtctttttcacaccccctgagaaatgcgatacactcctttgtgacattggcgaatcctctcccaatcctacgatcgaggctgggcgcaccctgcgggtgctgaacctcgtggaaaattggctgaacaataacacacaattctgcattaaggtccttaatccgtatatgcccagcgttatcgagaaaatggaaaccctgcagagaaagtacggaggcgccctcgtgcgcaaccctctgtccagaaattctacacacgagatgtactgggtgagcaacgcgaccgggaatattgtctcctctgtgaacatgatcagcagaatgctgatcaatcgctttacgatgaagcacaaaaaggccacctatgagcccgatgttgacctcggatccggcacacggaacattggcatcgaaagcgagattcctaaccttgatatcattgggaaaagaatcgaaaagattaaacaggagcatgaaacctcttggcactacgaccaggaccatccctataagacatgggcttaccacggatcctatgagaccaagcaaacaggcagcgcctcttccatggtgaatggggtcgtgcgcctgctgaccaaaccgtgggatgttgtgcctatggtcacgcagatggctatgacagacaccacccccttcggacagcagagagtgtttaaggagaaagtggatacacggacgcaagaacctaaggagggcaccaaaaagctcatgaagatcacagccgaatggctgtggaaagagcttgggaaggagaaaacaccccgcatgtgtacaagagaagagttcgctcggaaggtcagaagcaacgccgcgctgggagccatctttaccgacgaaaataaatggaagtctgctcgggaggccgttgaagattcccgcttctgggagctcattgacagagagcggaacctgcacctggaaggcaaatgcgagacatgtgtgtacaatatgatgggcaagcgcgaaaagaaactcggggagtttggaaaggctaaaggcagcagagccatctggtatatgtggctgggggcccggttccttgaatttgaggcgctgggattcctcaacgaggatcattggttttcccgcgaaaatagcctgtctggcgtggagggggaaggccttcacagactgggatacattctccgggacgtcagcaagaaagagggcggggctatgtacgccgatgacaccgccggatgggatacgcgcatcaccctggaagacctgaagaacgaggagatggtgacaaatcatatgaagggcgaacacaaaaagctcgctgaggccattttcaaactgacctatcagaacaaggttgtgagagtccagcggcctacaccccgcgggaccgtgatggacatcatctccagacgggatcagcgcggatctggccaagttgggacgtacggccttaatacatttaccaacatggaagctcagctgattagacagatggagggagagggcatcttcaaaagcattcaacatctcacagccaccgaagagatcgcggtgcagaattggctggcccgggtcgggagagaacgcctttcccggatggctatttctggagacgattgcgtggttaagccgctggacgatagattcgccagcgctctcacggccctgaacgacatgggcaaggtgcgcaaagatatccagcagtgggagccttcccgggggtggaatgactggacccaagtccccttttgctctcaccacttccatgaactggtgatgaaggatggaagagtcctcgtggttccctgtcgcaaccaggacgagctgatcggccgggcgagaattagccagggggccggctggtcccttaaagagacagcttgcctgggaaagagctatgcccagatgtggaccctcatgtactttcaccgccgggatctgagacttgctgccaacgctatctgttctgccgtgccttcccattgggtcccgacaagccgcaccacatggtctattcacgcgaaacacgaatggatgaccacggaggacatgctggccgtgtggaatcgggtgtggatccaagaaaacccctggatggaggataagacacctgttgaatcctgggaggaggtgccctatctcggcaagagagaagaccagtggtgcgggagcctgattggactgacctcccgggctacctgggccaaaaatatccagacagccattaaccaggtcagatctctcatcggcaatgaggaatacaccgactatatgcctagcatgaagcgcttccggagagaggaagaggaggctggggtgctgtggtga

SEQ ID NO: 20283 - RNA, 9876 nt, synthetic construct
  misc_feature 1..9876: note = derived and/or modified CDS sequence (opt5) from DENV-2__GQ398298__SS-prME
  source 1..9876: mol_type = other RNA
accgccggcgtgatcattatgctgatccccacagctatggccttccacctcacgacccggaacggggaacctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggacttctcggcatggcgctgttcctggaagagatgctcagaacacgcgtggggaccaaacacgccatgctgcttgtcgtggtttcctttgtgacgctgatcaccggaaacatgtctttccgggacctcggcagagtcatggtgatggttggcgctacaatgaccgatgacatcgggatgggaattacatatctggccctgcttgccgcttttaaggtgcgccctaccttcgccgcgggcctgctcctgagaaaactcacgagcaaggagctgatgatggctacaatcgggattgcccttctgtcccagtctaccatccccgaaacaattctcgagctgaccgatgccctggctcttggaatgatggtcctgaaaatcgtgcggaatatggaaaagtaccagctcgccgttaccatcatggcgattagctgcgtgcctaacgctgtcatcctgcaaaatgcctggaaggtgtcctgtacaattctcgccgctgtgagcgtctctcccctgcttctgacgtccagccagcagaaagccgactggatccctctcgctctgaccattaagggcctgaaccccacagccatctttcttaccacactgtctcgcacctccaaaaagagaagctggccgctcaatgaggcgatcatggccgttgggatggtgtctattctggcttccagcctcctgaaaaacgacatccctatgacgggaccccttgtggccggcggcctgctgacagtctgctatgtgctcaccgggcggtccgctgatctggaacttgagcgcgccgccgacgttaagtgggaggatcaggctgaaattagcggatctagccctatcctgtccattaccatctctgaggacggcagcatgtccattaaaaatgaagaggaggaacaaacactcaccatcctgatcagaacagggctcctggtgatttctggagtcttccccgtgagcatcccgattacggcggccgcttggtacctttgggaggttaagaagcagcgggccggcgtgctgtgggatgtcccttctccccctcccgtggggaaagccgaactggaggacggagcttatcgcatcaagcagagaggcattctcggctacagccagatcggggccggagtctataaagaaggcacctttcacacaatgtggcatgtgaccagaggggcggttctgatgcaccgcggaaagagaatcgagcccagctgggctgatattaaaaaggaccttatctcctacggcgggggatggaagctggagggcgaatggaaagagggcgaagaggtgcaagtcctcgccctggaacctgggaagaacccgcgggccgtgcagacaaaacccggactcttcaagaccaatacgggcaccattggggctgttagcctggatttttctcctggaacatccggcagccccatcgtggacagaaaagggaaggtcgtgggactttacggcaacggcgtggttacccgctctggggcctatgtctccgcgattgctcagacagaaaagagcatcgaggataatcctgaaatcgaggacgatattttccggaaaaagagactgaccatcatggacctgcatcccggagccggcaaaacaaagcgctacctccctgccattgtgcgggaagctatcaaaagagggctgcgcacgcttattctggccccgacccgggtggtcgctgccgagatggaagaggcgctcagaggactgcccatccgctatcagacccctgccattcgggctgagcacaccggcagagaaatcgtggacctcatgtgtcatgccaccttcacaatgcggctgctttcccccgttcgcgtgcctaactacaacctgatcattatggatgaggctcactttacggaccccgcctctatcgccgctagagggtatattagcacccgggtcgaaatgggcgaggcggccggaatcttcatgacagctaccccgcctggctcccgcgatccctttccccaaagcaatgcccctattatggacgaggaaagagagatccccgaacggtcttggaactccgggcacgagtgggtgacagatttcaagggaaagaccgtttggtttgtgcctagcatcaaagccggcaatgacattgctgcctgcctgagaaagaacgggaaaaaggtcatccagctctctcgcaaaacgttcgatagcgaatacgtgaagacacgggcgaatgactgggattttgttgtgaccaccgacatttccgagatgggagctaacttcaaggccgagagagtcatcgatccgcgccggtgtatgaaacccgtgattctgacagacggcgaagagagagtgatccttgccgggcctatgcccgtcacccattctagcgctgcccagcgccggggcagaatcggacgcaatcctaagaacgaaaatgaccaatatatttacatgggcgagcccctggaaaacgatgaggactgcgcgcactggaaagaggccaagatgctcctggataatatcaacacaccggaagggattatcccttccatgtttgagcccgaaagagagaaagttgacgctattgatggagaataccggctgcgcggcgaggccagaaagaccttcgtggacctcatgcggcgcggggatcttcctgtgtggctggcttatagagtcgccgctgagggaatcaattacgccgaccggagatggtgttttgatggcattcgcaacaatcagatcctggaagagaacgtggaagttgagatctggacgaaagagggggaacggaagaagctcaaacccagatggctggacgcgcgcatttattctgatcctcttgccctgaaggagttcaaagagttcgctgccggccggaagtccctcacactgaacctgatcaccgagatgggaagactccccacatttatgacccagaaagctcgggacgcccttgataatctggccgtgctgcatacggctgaagcgggcgggcgcgcctacaaccacgctctctccgagctgccggagacccttgaaacactgctcctgctgaccctccttgccacagtcaccggaggcattttcctgtttctgatgagcgggaagggaatcggcaagatgacactcggcatgtgctgcattatcaccgcctctatcctgctttggtatgctcagattcaacctcactggatcgccgcgtccattatcctggagttctttctcattgtgctgctgatccccgaacccgagaaacagagaacgcctcaggacaatcagctcacatacgttgtgatcgccattcttaccgtcgtggctgccaccatggctaacgaaatggggttcctggagaagaccaagaaggacctgggactcggcagcatcgccacccaagagtccgaatctaatattctggatatcgaccttcggccggcgagcgcctggacactgtatgctgtcgccacgacctttgtgacacccatgctccgccattccattgagaactctagcgttaatgtgtccctgaccgctatcgccaaccaggctacagtgctgatggggctcggaaaaggctggcctcttagcaagatggatattggggtccccctgctggccatcggatgttactctcaggttaatcctatcaccctcacggcggccctgcttctgctcgtggctcactacgccattatcggccccggcctgcaggctaaggccaccagagaagcccaaaaacgggcggctgccgggattatgaagaaccctacagtggacggaatcaccgtcattgatctggagccgatcccctatgaccctaaattcgaaaagcagctcggccaggtgatgcttctgatcctgtgcgttacacaggtgctcatgatgcgcaccacgtgggctctgtgtgaggcccttacactggccaccgggcccatttccacactctgggagggaaatcctggcagattttggaacaccaccatcgctgtcagcatggccaatattttccgggggtcttacctggcgggagccggcctgctcttttccatcatgaaaaacacaacgaatacccgcagaggcacagggaacattggagaaacccttggcgagaagtggaaaagccggctgaatgctctggggaaatctgagttccaaatctataagaaaagcggaatccaggaggtggatagaacactcgccaaggagggcattaaacgcggggaaaccgaccatcacgctgtctcccggggatctgccaagctgagatggtttgtggagcgcaacatggttacgcccgaaggcaaagtggtcgatcttggctgcgggcggggaggctggagctactattgtgggggactgaagaacgtgagagaggttaagggcctcacaaaagggggaccgggccatgaagaacctatccccatgtccacctacggctggaatctggtgcgcctgcagagcggggtcgacgtgttcttcacaccccctgagaagtgcgatacactcctttgtgacattggagaatcctctcccaaccctaccatcgaggcgggccggacactgagagtgctgaatctcgttgaaaactggctgaataacaatacgcaattttgcattaaagtccttaacccgtatatgcccagcgtgatcgagaagatggaaaccctgcagcgcaaatacgggggagccctcgtgcggaatcctctgtccagaaactctacacacgagatgtactgggtcagcaatgctaccggcaacatcgtttcctctgtgaatatgattagccgcatgctgatcaaccggttcacaatgaagcacaagaaagccacctatgagcccgatgtggacctcgggtccggaacgagaaatattggcatcgaaagcgagattcctaaccttgacatcattggcaagcgcatcgagaagatcaagcaggagcatgaaacctcttggcactacgatcaggaccatccctataaaacatgggcttaccacgggtcctatgagaccaagcaaacaggaagcgcctcttccatggtcaacggcgtggttagactgctgaccaagccgtgggatgtggtccctatggtgacacagatggctatgaccgacacgacaccctttgggcagcagcgggttttcaaagagaaggtggatacccgcacccaagaacctaaagagggaacaaagaaactcatgaagattacggccgaatggctgtggaaggagcttggcaaaaagaaaacccccagaatgtgtacacgggaggaatttaccagaaaggtccggagcaatgcggccctgggggctatcttcacagacgagaacaaatggaagtctgcccgcgaagctgtggaggattccagattttgggaactcattgaccgggagcgcaatctgcacctggagggaaaatgcgaaacctgtgtgtacaacatgatgggcaagagagagaagaaactcggcgagttcgggaaggccaaaggaagccgggccatctggtatatgtggctgggcgcgcgctttcttgagttcgaagctctggggtttctcaatgaggatcattggttctccagaggaaacagcctgtctggcgtcgagggggaaggccttcaccggctgggatacattctccgcgacgttagcaagaaagagggcggggccatgtacgccgatgacacagctggatgggacaccagaatcacgctggaagatctgaagaatgaggaaatggtgaccaaccatatgaagggcgagcacaaaaagctcgccgaggctatctttaaactgacatatcagaataaggtggtccgggtgcagcgccctacccccagagggacagttatggacattatctcccggcgcgatcagagaggatctggccaagtggggacctacggccttaacacgttcacaaatatggaagcccagctgattcggcagatggagggagaaggcatcttcaaaagcattcaacatctcaccgtcacagaggagatcgcggtgcagaactggctggccagagttgggcgcgaacggctttccagaatggctatctctggagacgattgcgtggtcaagccgctggacgatcgctttgccagcgctctcaccgccctgaatgacatgggcaaggtgcggaaagatattcagcagtgggagccttccagagggtggaacgactggacgcaagttcccttctgctctcaccactttcatgaactggtgatgaaggatggacgcgtcctcgtggtcccctgtcggaatcaggacgagctgatcggcagagcgcgcattagccagggggccggctggtcccttaaagaaaccgcttgcctgggaaagagctatgcccagatgtggacactcatgtacttccaccggagagatctgcgccttgctgccaacgctatctgttctgccgtgccttcccattgggttccgaccagccggacaacctggtctattcacgcgaaacacgagtggatgacaaccgaggacatgctggccgtgtggaacagagtctggatccaagaaaatccctggatggaggacaagacgcctgtggaatcctgggaggaagtgccctatctcggcaagcgggaggatcagtggtgcgggagcctgattggactgacatccagagctacctgggccaaaaacatccagaccgccatcaatcaggttcgctctctcattggcaacgaggaatacacagactatatgcctagcatgaagcggtttagacgcgaggaagaggaagctggggtgctgtggtga

SEQ ID NO: 20284 - RNA, 9876 nt, synthetic construct
  misc_feature 1..9876: note = derived and/or modified CDS sequence (opt5) from DENV-2__GQ398301__SS-prME
  source 1..9876: mol_type = other RNA
accgccggcgtgatcattatgctgatccccaccgctatggccttccacctcacgacccggaacggggagcctcatatgattgtcggacggcaggaaaagggcaagtccctgctttttaagaccgaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggccctcttcctggaagagatgctgagaacacgcgtcgggaccaaacacgccatgctcctggtggctgcctcctttgttacgcttatcaccggaaacatgtctttccgggacctgggcagagtgatggtcatggtgggcgccacaatgaccgatgacatcgggatgggaattacatatctcgctctgctggccgcgtttaaggttcgccctaccttcgctgccggccttctgctcagaaaactgacgagcaaggagctcatgatggccacaatcgggattgctctgctttcccagtctaccatccccgaaacaattctggagctcaccgatgccctggcgctgggaatgatggtgcttaaaatcgtccggaatatggaaaagtaccagctggctgtgaccatcatggccattagctgcgttcctaacgccgtgatcctccaaaatgcttggaaggtctcctgtacaattctggccgctgtgagcgtgtctcccctcctgcttacgtccagccagcagaaagccgactggatccctctggcgctcaccattaagggcctgaaccccacagccatctttctgaccacactttctcgcacctccaaaaagagaagctggccgctgaatgaggctatcatggccgtcgggatggtttctattctcgcttccagcctgctcaaaaacgacatccctatgacgggacccctggtggccggcggccttctgacagtgtgctatgtcctgaccgggcggtccgccgatctcgaactggagcgcgctgcggacgtgaagtgggaggatcaggccgaaattagcggatctagccctatcctttccattaccatctctgaggacggcagcatgtccattaaaaatgaagaggaggaacaaacactgaccatcctcatcagaacagggctgctcgttatttctggagtgttccccgtcagcatcccgattacggctgccgcctggtacctgtgggaggtgaagaagcagcgggctggcgttctttgggatgtgccttctccccctcccgtcgggaaagccgaactggaggacggagcgtatcgcatcaagcagagaggcattctgggctacagccagatcggggctggagtgtataaagaaggcacctttcacacaatgtggcatgtcaccagaggggcggtgctcatgcaccgcggaaagagaatcgagcccagctgggccgatgttaaaaaggacctgatttcctacggcgggggatggaaacttgagggcgaatggaaagagggcgaagaggtgcaagtcctggctctcgaacctgggaagaacccgcgggccgtgcagacaaaacccggactgttcaagaccaatacgggcaccatcggggcggttagcctcgatttttctcctggaacatccggcagccccattgtggacagaaaagggaaggtcgtgggactgtacggcaacggcgtggttacccgctctggggcttatgtctccgccatcgcccagacagaaaagagcattgaggataatcctgaaatcgaggacgatatcttccggaaaaagagacttaccattatggacctgcatcccggagctggcaaaacaaagcgctacctgcctgccatcgtgcgggaagctattaaaagagggctccgcacgctgatccttgccccgacccgggtggtcgcggccgagatggaagaggctctgagaggactccccattcgctatcagacccctgccatccgggctgagcacaccggcagagaaattgtggacctgatgtgtcatgccaccttcacaatgcggctcctgtcccccgttcgcgtgcctaactacaaccttatcatcatggatgaggcccactttacggaccccgcttctattgcggccagagggtatatcagcacccgggtcgaaatgggcgaggctgccggaattttcatgacagccaccccgcctggctcccgcgatccctttccccaaagcaatgctcctatcatggacgaggaaagagagattcccgaacggtcttggaactccgggcacgagtgggtgacagatttcaagggaaagaccgtttggtttgtgcctagcatcaaagccggcaatgacatcgcggcttgcctgagaaagaacgggaaaaaggtcattcagctgtctcgcaaaacgttcgatagcgaatacgtgaagacacgggccaatgactgggattttgttgtgaccaccgacatctccgagatgggagccaacttcaaggctgagagagtcattgatccgcgccggtgtatgaaacccgtgatcctcacagacggcgaagagagagtgattctggccgggcctatgcccgtcacccattctagcgcggcccagcgccggggcagaatcggacgcaatcctaagaacgaaaatgaccaatatatctacatgggcgagccccttgaaaacgatgaggactgcgctcactggaaagaggccaagatgctgctcgataatattaacacaccggaagggatcattccttccatgtttgagcccgaaagagagaaagttgacgctatcgatggagaataccggctgcgcggcgaggccagaaagaccttcgtggacctgatgcggcgcggggatctccctgtgtggcttgcttatagagtcgccgcggagggaattaattacgccgaccggagatggtgttttgatggcatcaaaaacaatcagattctggaagagaacgtggaagttgagatctggacgaaggagggggaacgcaagaaactgaagccccggtggctcgacgctagaatctattctgatcctctggcccttaaagagttcaaggagttcgctgccggccgcaaaagcctgacactcaacctgattaccgagatgggacggctgcccacatttatgacccagaaggccagagacgctctcgataatcttgcggtgctgcatacggccgaagctggcgggcgggcctacaaccacgccctgtccgagctcccggagaccctggaaacacttctgctcctgaccctgctcgctacagtcaccggaggcatcttcctttttctgatgagcgggaagggaattggcaaaatgacactgggcatgtgctgcatcattaccgcctctatcctcctgtggtatgcgcagatccaacctcactggattgccgcttccatcattcttgagttctttctgatcgtgctcctgattcccgaacccgagaagcagcgcacgcctcaggacaatcagctgacatacgttgtgatcgccatcctcaccgtcgtggctgccaccatggcgaacgaaatggggttccttgagaaaacaaagaaagacctgggactgggcagcattgccacccaagagtccgaatctaatatcctcgatattgacctgagaccggctagcgcctggacactttatgctgtcgccacgacctttgtgacacccatgctgcggcattccatcgagaactctagcgttaatgtgtccctcaccgctattgccaaccaggcgacagtgctgatggggctgggaaagggctggcctctcagcaagatggatatcggggtcccccttctggccattggatgttactctcaggttaatcctatcaccctgacggctgccctcctgcttctggtggctcactacgccatcattggccccggcctccaggccaaagcgacccgcgaagctcaaaagagagccgctgccgggatcatgaaaaaccctacagtggacggaattaccgtcatcgatctggagccgattccctatgaccctaagttcgaaaaacagctgggccaggtgatgctccttatcctgtgcgttacacaggtgctgatgatgcggaccacgtgggccctctgtgaggctctgacacttgccaccgggcccatctccacactgtgggagggaaatcctggccgcttttggaacaccaccattgcggtcagcatggccaatatcttcagagggtcttacctcgctggagccggcctgctgttttccattatgaagaacacaacgaatacccggcgcggcacagggaacatcggagaaaccctcggcgagaagtggaaaagcagacttaatgctctggggaagtctgagttccaaatttataaaaagagcggaatccaggaggtggatcggacactggccaaagagggcatcaagagaggggaaaccgaccatcacgcggtctcccgcggatctgccaaactccggtggtttgtggagagaaacatggttacgcccgaaggcaaggtggtcgatctgggctgcgggcgcggaggctggagctactattgtgggggacttaagaacgtgcgggaggttaaaggcctgacaaaagggggaccgggccatgaagaacctattcccatgtccacctacggctggaatctcgtgagactgcagagcggggtcgacgtgttcttcacaccccctgagaaatgcgatacactgctctgtgacatcggagaatcctctcccaaccctaccattgaggctggccgcacacttcgggtgctgaatctggttgaaaactggctcaataacaatacgcaattttgcatcaaggtcctgaacccgtatatgcccagcgtgattgagaaaatggaaacccttcagagaaagtacgggggagccctggtgcgcaatcctctctcccggaactctacacacgagatgtactgggtcagcaatgctaccggcaacatcgtttcctctgtgaatatgatcagcagaatgctgattaaccgcttcacaatgaagcacaaaaaggccacctatgagcccgatgtggacctggggtccggaacgcggaatatcggcattgaaagcgagatccctaacctcgacattatcggcaaaagaattgaaaagatcaaacaggagcatgaaacctcttggcactacgatcaggaccatccctataagacatgggcttaccacgggtcctatgagaccaagcaaacaggaagcgcctcttccatggtcaacggcgtggttcgccttctgaccaaaccgtgggatgtggtccctatggtgacacagatggcgatgaccgacacgacaccctttgggcagcagagagttttcaaggagaaagtggatacccggacccaagaacctaaggagggaaccaagaagctgatgaagatcacggccgaatggctctggaaagagctgggcaaggagaaaacaccccgcatgtgtacaagagaagagtttacccggaaggtcagaagcaatgctgcccttggggctattttcacagacgaaaacaaatggaagtctgcccgggaggccgtggaagattcccgcttttgggagctgatcgacagagagcggaatctccacctggaaggaaaatgcgagacctgtgtgtacaacatgatgggcaagcgcgaaaagaaactgggcgagttcgggaaggcgaaaggaagcagagctatttggtatatgtggctcggcgcccggtttctggagttcgaggcccttgggtttctgaatgaggatcattggttctcccgcggaaacagcctctctggcgtcgaaggggagggcctgcacagacttggatacatcctgcgggacgttagcaagaaagaaggcggggctatgtacgccgatgacacagctggatgggacacccgcattacgctcgaggatctgaagaatgaagagatggtgaccaaccatatgaagggcgagcacaaaaagctggccgaagcgatctttaaactcacatatcagaataaggtggtcagagtgcagcggcctacaccccgcgggacagttatggacatcatttccagacgggatcagcgcggatctggccaagtggggacctacggcctgaacacgttcacaaatatggaggcccagcttatcagacagatggaaggagagggcattttcaaaagcatccaacatctgaccgtcacagaggaaattgctgtgcagaactggctcgcccgggttgggagagagcgcctgtcccggatggctatctctggagacgattgcgtggtcaagccgcttgacgatagatttgccagcgcgctgaccgccctcaatgacatgggcaaggtgcgcaaagatatccagcagtgggaaccttcccgggggtggaacgactggacgcaagttcccttctgctctcaccactttcatgagctggtgatgaaggatggaagagtcctggtggtcccctgtcgcaatcaggacgaactcattggccgggctagaatcagccagggggccggctggtccctgaaagagaccgcttgccttggaaagagctatgcccagatgtggacactgatgtacttccaccgccgggatctcagactggctgccaacgcgatttgttctgccgtgccttcccattgggttccgaccagccgcacaacctggtctatccacgctaaacacgagtggatgacaaccgaagacatgcttgccgtgtggaaccgggtctggattcaagagaatccctggatggaagacaagacgcctgtggagtcctgggaagaggtgccctatctgggcaagagagaggatcagtggtgcgggagcctcatcggactgacatcccgggccacctgggctaaaaacattcagaccgccatcaatcaggttagatctctgatcggcaacgaagagtacacagactatatgcctagcatgaagcgctttcggagagaagaggaagaggcgggggtgctctggtga

SEQ ID NO: 20285 - RNA, 9876 nt, synthetic construct
  misc_feature 1..9876: note = derived and/or modified CDS sequence (opt5) from DENV-2__GQ398312__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagagcaggacaaacgctttgtgtgcaagcattccatggtggatagaggctggggcaacgggtgtggactgttcggcaaggggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaagcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaagcttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcagcacaaatatctggcttaagctgcgggagaaacaggacgtcttttgtgattctaagctcatgtccgctgccatcaaagacaacagagcggtgcacgccgatatgggctattggattgaaagcgctctgaatgacacctggaagatggagaaggcctctttcatcgaggttaaaagctgccactggcctaagtcccatacactgtggagcaacggggtgcttgaatctgagatgattatccccaaaaatttcgctggaccggtctcccagcacaactaccgccctggctatcatacccagacggccgggccctggcacctcggaaagctggaaatggattttgacttctgtgagggcacaaccgtggtggtcaccgaagattgcgggaaccggggacccagcctgagaacaaccacggcctccggcaaactcattacagagtggtgctgtcggtcttgcaccctgcctccgcttcgctacagaggcgaggacgggtgttggtacggaatggaaatccggcccctgaaggagaaggaagagaatctcgttaacagcctggtgacagctggccatgggcaaattgataatttttccctgggagtgcttggcatggcgctcttcctggaagagatgctgagaacccgcgtcgggacaaaacacgccatgctcctggtggctgtttcttttgtgacccttatcacgggaaacatgagcttccgggacctgggcagagtcatggtgatggttggcgccaccatgacagatgacatcgggatgggaattacctatctcgccctgctggctgcctttaaggtgcgccctacattcgcggctggccttctgctcagaaaactgacctccaaggagctcatgatggccacgatcgggattgccctgctttctcagagcacaatccccgaaaccattctggagctcacagatgctctggccctgggaatgatggtccttaaaatcgtgcggaatatggaaaagtaccagctggcggttaccatcatggctatttcctgcgtgcctaacgccgtcatcctccaaaatgcctggaaggtgagctgtaccattctggctgccgtgtctgtctcccccctcctgcttacaagctctcagcagaaagctgactggatccctctggccctcacgattaagggcctgaaccccaccgcgatctttctgacaaccctttcccgcacaagcaaaaagagatcttggccgctgaatgaggccatcatggctgttgggatggtgtccattctcgccagctccctgctcaaaaacgacatccctatgaccggacccctggtggctggcggccttctgacggtctgctatgtgctgacagggcggagcgccgatctcgaactggagcgcgccgctgacgttaagtgggaggatcaggcggaaatttctggaagctcccctatcctttctattaccatcagcgaggacggctccatgtctattaaaaatgaagaggaggaacaaaccctgacaatcctcatcagaaccgggctgctcgtgattagcggagtcttccccgtgtccatcccgattacagccgctgcctggtacctgtgggaggttaagaagcagcgggccggcgtgctttgggatgtcccttctccccctcccgtggggaaagctgaactggaggacggagcctatcgcatcaagcagagaggcattctgggctacagccagatcggggcgggagtctataaagaaggcacgtttcacaccatgtggcatgtgacacggggggctgttctcatgcaccgcggaaagagaatcgagccctcctgggccgatgtgaaaaaggacctgattagctacggcgggggatggaagcttgagggcgaatggaaagagggcgaagaggtccaagtgctggccctcgaacctgggaagaacccgcgggctgttcagaccaaacccggactgttcaagacaaataccggcacgatcggggccgtgtctctcgatttttcccctggaaccagcggctctcccattgtcgacagaaaagggaaggtggtgggactgtacggcaacggcgttgtcacacgctccggggcgtatgtgagcgctatcgcccagaccgagaagtccattgaggataatcctgaaatcgaggacgatatcttccggaaaaagagacttacaattatggacctgcatcccggagccggcaaaaccaagcgctacctgcctgctatcgtgcgggaagccattaaaagagggctccgcacactgatccttgctccgacgcgggtcgtggccgcggagatggaagaggccctgagaggactccccattcgctatcagacccctgctatccgggccgagcacacaggcagagaaattgttgacctgatgtgtcatgctaccttcaccatgcggctcctgtctcccgtgcgcgtccctaactacaaccttatcatcatggatgaggcccactttacagaccccgccagcattgctgcgagagggtatatctccacgcgggtggaaatgggcgaggccgctggaattttcatgaccgccacaccgcctggcagccgcgatccctttccccaatctaatgcccctatcatggacgaggaaagagagattcccgaacggtcctggaacagcgggcacgagtgggttaccgatttcaagggaaagacagtgtggtttgtcccttctatcaaagctggcaatgacatcgccgcgtgcctgagaaagaacgggaaaaaggtgattcagctgagccgcaaaaccttcgattccgaatacgttaagacgcgggctaatgactgggattttgtggtcacaaccgacatctctgagatgggagccaacttcaaggccgagagagtgattgatccgcgccggtgtatgaaacccgtgatcctcaccgacggcgaagagagagtcattctggctgggcctatgcccgttacacatagctccgccgcgcagcgccggggcagaatcggacgcaatcctaagaacgaaaatgaccaatatatctacatgggcgagccccttgaaaacgatgaggactgcgcccactggaaagaggctaagatgctgctcgataatattaacaccccggaagggatcattccttctatgtttgagcccgaaagagagaaagtggacgccatcgatggagaataccggctgcgcggcgaggctagaaagacattcgtggacctgatgcggcgcggggatctccctgtctggcttgcctatagagtggctgccgagggaattaattacgcggaccggagatggtgttttgatggcatcaaaaacaatcagattctggaagagaacgttgaagtggagatctggaccaaggagggggaacgcaagaaactgaagccccggtggctcgacgccagaatctatagcgatcctctggctcttaaagagttcaaggaattcgccgctggccgcaaatccctgacgctcaacctgattacagagatgggacggctgcccacctttatgacacagaaggccagagacgccctcgataatcttgctgtcctgcataccgcggaagccggcgggcgggcttacaaccacgccctgagcgagctcccggagacgctggaaacccttctgctcctgacactgctcgccaccgtgacaggaggcatcttcctttttctgatgtctgggaagggaattggcaaaatgaccctgggcatgtgctgcatcattacagcttccatcctcctgtggtatgcccagatccaacctcactggattgcggccagcatcattcttgagttctttctgatcgttctcctgattcccgaacccgagaagcagcgcacccctcaggacaatcagctgacgtacgtggtcatcgctatcctcacagtggtcgccgctaccatggccaacgaaatggggttccttgagaaaaccaagaaagacctgggactgggctccattgcgacacaagagtctgaaagcaatatcctcgatattgacctgagaccggcctccgcttggaccctttatgccgtggctacaacgtttgttacccccatgctgcggcattctatcgagaacagctccgtgaatgtgagcctcacagccattgctaaccaggccaccgtcctgatggggctgggaaagggctggcctctctctaagatggatatcggggttccccttctggcgattggatgttactcccaggtgaatcctatcacactgatcgccgctctcctgcttctggtggcccactacgctattatcggccccggcctccaggccaaagccacccgcgaagcgcaaaagagagctgccgctgggattatgaaaaaccctacggtcgacggaatcaccgtgattgatctggagccgatcccctatgaccctaagttcgaaaaacagctgggccaggttatgctccttatcctgtgcgtgacacaggtcctgatgatgcggaccacatgggccctctgtgaggccctgacccttgctacggggcccattagcacactgtgggagggaaatcctggccgcttttggaacaccacaatcgccgtgtctatggcgaatattttcagagggtcctacctcgccggagctggcctgctgtttagcatcatgaagaacaccaccaatacacggcgcggcacggggaacattggagaaaccctcggcgagaagtggaaatctagacttaatgccctggggaagagcgaattccaaatctataaaaagtccggaatccaggaggtcgatcggacactggctaaagagggcattaagagaggggaaaccgaccatcacgccgtgtctcgcggaagcgcgaaactccggtggtttgttgagagaaacatggtgacacccgaaggcaaggtcgtggatctgggctgcgggcgcggaggctggtcctactattgtgggggacttaagaacgttcgggaggtgaaaggcctgaccaaggggggaccgggccatgaagagcctatccccatgagcacgtacggctggaatctcgtcagactgcagtccggggtggacgtgttcttcacaccccctgagaaatgcgataccctgctctgtgacattggagaatctagccccaaccctaccatcgaggccggccgcacacttcgggttctgaatctggtcgaaaactggctcaataacaatacccaattttgcattaaggtgctgaacccgtatatgccctccgtgatcgagaaaatggaaacacttcagagaaagtacgggggagctctggtccgcaatcctctctctcggaacagcacgcacgagatgtactgggtttccaatgccaccggcaacatcgtgtctagcgtgaatatgatttccagaatgctgatcaaccgcttcacaatgaagcacaaaaaggctacctatgagcccgatgtcgacctggggagcggaacacggaatattggcatcgaatctgagattcctaacctcgacatcattggcaaaagaatcgaaaagatcaaacaggagcatgaaacctcctggcactacgatcaggaccatccctataagacgtgggcctaccacgggagctatgagaccaagcaaacaggatctgcttccagcatggtgaacggcgttgtgcgccttctgaccaaaccgtgggatgtcgtgcctatggttacacagatggccatgaccgacacaaccccctttgggcagcagagagtgttcaaggagaaagtcgatacgcggacacaagaacctaaggagggaaccaaaaagctgatgaagattaccgcggaatggctctggaaagagctgggcaagaaaaagacaccccgcatgtgtacgagagaggaatttacccggaaagtgagatctaatgccgctcttggggccatcttcacagacgagaacaagtggaaatccgctcgggaagccgtggaggatagccgcttttgggaactgattgacagagagcggaatctccacctggagggaaagtgcgaaacctgtgtctacaacatgatgggcaagcgcgagaaaaagctgggcgaattcgggaaagccaagggatccagagcgatctggtatatgtggctcggcgctcggtttctggagttcgaagcccttgggtttctgaatgaggatcattggttcagccgcggaaactctctcagcggcgttgagggggaaggcctgcacagacttggatacattctgcgggacgtgtccaaaaaggagggcggggccatgtacgctgatgacacagccggatgggacacccgcatcacactcgaagatctgaagaatgaggaaatggtgaccaaccatatgaaaggcgagcacaagaaactggctgaggccatctttaagctcacgtatcagaataaagtcgtgagagttcagcggcctaccccccgcgggacagtgatggacattatctctagacgggatcagcgcggaagcggccaagtcgggacctacggcctgaacacattcaccaatatggaagcgcagcttattagacagatggagggagaaggcatcttcaagtccattcaacatctgacggtgacagaggagatcgccgttcagaactggctcgctcgggtggggagagaacgcctgtctcggatggccatcagcggagacgattgcgtcgtgaagccgcttgacgatagatttgcttccgccctgaccgcgctcaatgacatgggcaaagttcgcaaggatattcagcagtgggagccttctcgggggtggaacgactggacacaagtgcccttctgcagccaccactttcatgaactggtcatgaaagatggaagagtgctggtcgtgccctgtcgcaatcaggacgagctcatcggccgggccagaatttcccagggggctggctggagcctgaaggaaaccgcctgccttggaaaatcttatgctcagatgtggacgctgatgtacttccaccgccgggatctcagactggccgctaacgccatctgttccgcggttcctagccattgggtgccgacctctcgcacaacctggtccattcacgccaagcacgagtggatgacaaccgaggacatgcttgctgtctggaaccgggtgtggatccaagaaaatccctggatggaggacaagacacctgtggaaagctgggaggaagttccctatctgggcaaaagagaggatcagtggtgcgggtccctcattggactgacctctcgggccacgtgggccaagaacatccagacagctatcaatcaggtgagaagcctgattggcaacgaggaatacaccgactatatgccttccatgaaacgctttcggagagaggaagaggaagccggggtcctctggtga

SEQ ID NO: 20286 - RNA, 9876 nt, synthetic construct
  misc_feature 1..9876: note = derived and/or modified CDS sequence (opt5) from DENV-2__GQ398289__SS-prME
  source 1..9876: mol_type = other RNA
accgcgggcgtcatcattatgctgatccccaccgctatggccttccacctcacgacccggaacggggaacctcatatgattgtcggacggcaggaaaagggcaagagcctgctttttaagaccgaggacggggttaatatgtgcaccctgatggcgatcgatctcggagaactgtgtgaggacaccattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggaattgtgacctgcgcgatgtttacatgcaaaaagaatatggaaggcaaagttgtgctccctgagaacctggaatacacgatcgtgattacaccccacagcggggaggagcatgccgtcggaaatgacacaggcaagcacggcaaagaaatcaagatcacccctcagtcttccattacagaggctgaacttaccgggtatggaacggtgaccatggagtgtagcccccggacaggcctggatttcaacgaaatggttctcctgcagatggaggacaaagcctggcttgtgcaccgccaatggtttctggatctcccgctgccttggctgcccggggctgacacccagggatctaattggatccagaaggagacactcgtcaccttcaagaaccctcatgccaaaaagcaggacgtggttgtgctgggctcccaagaaggggccatgcacacggctcttacaggcgcgaccgagattcagatgagctccggaaatctgctctttacaggccatctgaaatgcagacttcggatggataagctgcagctcaaagggatgtcttacagcatgtgtaccggaaagttcaagatcgtcaaagaaattgccgagacccaacacggcacaatcgtgatcagagtccagtatgagggggacggatccccctgcaagattcccttcgaaatcatggatctggagaaacgccatgtgctgggccggctcattacggttaaccctatcgtgaccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacacaaaagggattatgcaggcgggaaagcggagcctcagacctcagcccaccgaactgaaatattcctggaagacgtggggcaaggccaaaatgctgagcaccgagtctcataatcaaacattcctcatcgatgggcctgaaaccgctgagtgccccaacacaaatcgcgcctggaactccctggaggttgaagactacggatttggcgtgttcaccacaaatatttggcttaagctgcgggagaaacaggacgtcttttgtgatagcaagctcatgtctgctgccatcaaagacaacagagcggtgcacgccgatatgggctattggatcgaatccgctctgaatgacacctggaagatggagaaggccagcttcattgaggttaaatcttgccactggcctaagagccatacgctgtggtccaacggggtgcttgaaagcgagatgatcattcccaaaaatttcgctggaccggtctctcagcacaactaccgccctggctatcatacacagaccgccgggccctggcacctcggaaagctggaaatggattttgacttctgtgagggcaccacagtggtggtcaccgaagattgcgggaaccggggaccctccctgagaacgacaaccgccagcggcaaactcatcacagagtggtgctgtcggtcctgcaccctgcctccgcttcgctacagaggcgaggacgggtgttggtacggaatggaaattcggcccctgaaggagaaggaagagaatctcgttaactctctggtgacagctggccatgggcaaatcgataattttagcctgggagtgcttggcatggccctcttcctggaagagatgctgagaacccgcgtcgggacgaaacacgccattctcctgatcgctgtgtcctttgttacccttatcacaggaaacatgtctttccgggacctgggcagagtgatggtcatggtgggcgccaccatgacagatgacattgggatgggagttacctatctcgccctgctggctgcctttaaggtgcgccctacgttcgcggctggccttctgctcagaaaactgacaagcaaggagctcatgatggccaccatcgggattgccctgctttcccagtctacaatccccgaaaccattctggagctcaccgatgctctggccctgggaatgatggtccttaaaatcgtgcggaatatggaaaagtaccagctggcggttacaatcatggctattagctgcgtgcctaacgccgtcatcctccaaaatgcctggaaggtgtcctgtacgattctggctgccgtgagcgtctctcccctcctgcttacctccagccagcagaaagctgactggatccctctggccctcacaattaagggcctgaaccccaccgcgatctttctgacaaccctttctcgcacgtccaaaaagagaagctggccgctgaatgaggccatcatggctgttgggatggtgtctattctcgcctccagcctgctcaaaaacgacatccctatgacaggacccctggtggctggcggccttctgaccgtctgctatgtgctgaccgggcggtccgccgatctcgaactggagcgcgccgctgacgttaagtgggaggatcaggcggaaattagcggatctagccctatcctttccattacaatctctgaggacggcagcatgtccattaaaaatgaagaggaggaacaaaccctgacaatcctcatcagaacggggctgctcgtgatttctggagtcttccccgtgagcatcccgattaccgccgctgcctggtacctgtgggaggttaagaagcagcgggccggcgtgctttgggatgtcccttctccccctcccgtggggaaagctgaactggaggacggagcctatcgcatcaagcagagaggcattctgggctacagccagatcggggcgggagtctataaagaaggcacatttcacaccatgtggcatgtgacaagaggggctgttctcatgcaccgcggaaagagaatcgagcccagctgggccgatgtgaaaaaggacctgatttcctacggcgggggatggaaacttgagggcgaatggaaagagggcgaagaggtccaagtgctggccctcgaacctgggaagaacccgcgggctgttcagaccaaacccggactgttcaagacgaataccggcacaatcggggccgtgagcctcgatttttctcctggaacctccggcagccccattgtcgacagaaaagggaaggtggtgggactgtacggcaacggcgttgtcacacgctctggggcgtatgtgtccgctatcgcccagaccgaaaagagcattgaggataatcctgaaatcgaggacgatatcttccggaaaaagagacttacaattatggacctgcatcccggagccggcaaaacgaagcgctacctgcctgctatcgtgcgggaagccattaaaagagggctccgcaccctgatccttgctccgacacgggtcgtggccgcggagatggaagaggccctgagaggactccccattcgctatcagacccctgctatccgggccgagcacaccggcagagaaattgttgacctgatgtgtcatgctacattcacgatgcggctcctgtcccccgtgcgcgtccctaactacaaccttatcatcatggatgaggcccactttaccgaccccgcctctattgctgcgagagggtatatcagcacacgggtggaaatgggcgaggccgctggaattttcatgaccgccacaccgcctggctcccgcgatccctttccccaaagcaatgcccctatcatggacgaggaaagagagattcccgaacggtcttggaactccgggcacgagtgggttaccgatttcaagggaaagacggtgtggtttgtccctagcatcaaagctggcaatgacatcgccgcgtgcctgagaaagaacgggaaaaaggtgattcagctgtctcgcaaaacattcgatagcgaatacgttaagacccgggctaatgactgggattttgtggtcaccacagacatctccgagatgggagccaacttcaaggccgagagagtgattgatccgcgccggtgtatgaaacccgtgatcctcaccgacggcgaagagagagtcattctggctgggcctatgcccgttacacattctagcgccgcgcagcgccggggcagaatcggacgcaatcctaagaacgaaaatgaccaatatatctacatgggcgagccccttgaaaacgatgaggactgcgcccactggaaagaggctaagatgctgctcgataatattaacaccccggaagggatcattccttccctgtttgagcccgaaagagagaaagtggacgccatcgatggagaataccggctgcgcggcgaggctagaaagacgttcgtggacctcatgcggcgcggggatcttcctgtctggctggcctatagagtggctgccgagggaattaattacgcggaccggagatggtgttttgatggcatcaaaaacaatcagattctggaagagaacgttgaagtggagatctggacaaaggagggggaacgcaagaaactcaagccccggtggctggacgccagaatctattctgatcctcttgctctgaaagagttcaaggagttcgccgctggccgcaaaagcctcaccctgaacctgattacagagatgggacggctccccacctttatgacgcagaaggccagagacgcccttgataatctggctgtcctgcataccgcggaagccggcgggcgggcttacaaccacgccctctccgagctgccggagacacttgaaaccctgctcctgctgacactccttgccaccgtgacaggaggcatcttcctgtttctgatgagcgggcgcggaattggcaagatgaccctcggcatgtgctgcatcattacggcttctatcctgctttggtatgcccagatccaacctcactggattgcggcctccatcattctggagttctttctcatcgttctgctgattcccgaacccgagaaacagagaacacctcaggacaatcagctcacctacgtggtcatcgctatccttaccgtggtcgccgctacaatggccaacgaaatggggttcctggagaagaccaaaaaggacctgggactcggcagcattacaacgcaagagtccgaatctaatatcctggatattgaccttcggccggcgagcgcctggaccctgtatgctgtggccacaacctttgttacacccatgctccgccattccatcgagaactctagcgtgaatgtgtccctgaccgctattgccaaccaggctacggtcctgatggggctcggaaaaggctggcctcttagcaagatggatatcggggttcccctgctggccattggatgttactctcaggtgaatcctatcaccctcacagcggccctgcttctgctcgtggctcactacgccatcattggccccggcctgcaggctaaggccaccagagaagcccaaaaacgggcggctgccgggatcatgaagaaccctacagtcgacggaattaccgtgatcgatctggagccgattccctatgaccctaaattcgaaaagcagctcggccaggttatgcttctgatcctgtgcgtgacgcaggtcctcatgatgcgcacaacctgggctctgtgtgaggcccttacactggccaccgggcccatctccaccctctgggagggaaatcctggcagattttggaacacaacgattgctgtgagcatggccaatatcttccgggggtcttacctggcgggagccggcctgctcttttccattatgaaaaacaccacaaatacccgcagaggcacagggaacatcggagaaacccttggcgagaagtggaagtcccggctgaatgctctggggaaatctgagttccaaatttataagaaaagcggaatccaggaggtcgatagaacgctcgccaaggagggcatcaaacgcggggaaacagaccatcacgctgtgtcccggggatctgccaagctgagatggtttgttgagcgcaacatggtgacccccgaaggcaaagtcgtggatcttggctgcgggcggggaggctggagctactattgtgggggactgaagaacgttagagaggtgaagggcctcaccaaagggggaccgggccatgaagaacctattcccatgtccacatacggctggaatctggtccgcctgcagagcggggtggacgtgttcttcacaccccctgagaagtgcgatacactcctttgtgacatcggagaatcctctcccaaccctacgattgaggcgggccggaccctgagagttctgaatctcgtcgaaaactggctgaataacaatacacaattttgcatcaaagtgcttaacccgtatatgcccagcgtgattgagaagatggaaaccctgcagcgcaaatacgggggagccctcgtccggaatcctctgtccagaaactctacacacgagatgtactgggttagcaatgctaccggcaacatcgtgtcctctgtgaatatgatcagccgcatgctgattaaccggttcacgatgaagcacaagaaagccacctatgagcccgatgtcgacctcgggtccggaacaagaaatatcggcattgaaagcgagatccctaaccttgacattatcggcaagcgcattgagaagatcaagcaggagcatgaaacctcttggcactacgatcaggaccatccctataaaacatgggcttaccacgggtcctatgagaccaagcaaacaggaagcgcctcttccatggtgaacggcgttgtgagactgctgaccaagccgtgggatgtcgtgcctatggttacgcagatggctatgacagacaccaccccctttgggcagcagcgggtgttcaaagagaaggtcgatacacgcacgcaagaacctaaagagggaaccaagaaactcatgaagatcacagccgaatggctgtggaaggagcttggcaaaaagaaaacccccagaatgtgtacacgggaggaatttaccagaaaggtgcggagcaatgcggccctgggggctattttcacagacgagaacaaatggaagtctgcccgcgaagctgtggaggattccagattttgggaactcatcgaccgggagcgcaatctgcacctggagggaaaatgcgaaacctgtgtctacaacatgatgggcaagagagagaagaaactcggcgagttcgggaaggccaaaggaagccgggccatttggtatatgtggctgggcgcgcgctttcttgagttcgaagctctggggtttctcaatgaggatcattggttctccagacggaacagcctgtctggagttgagggcgaagggcttcaccgcctgggctacatcctcagagacgtgagcaagaaagagggaggcgccatgtacgccgatgacacggctgggtgggacacccggattacactggaagatctgaagaatgaggaaatggtgaccaaccatatgaagggagagcacaaaaagctcgccgaggctatctttaaactgacatatcagaataaggtcgtgcgcgttcagagacctacaccccggggcacggtgatggacatcatttcccgcagagatcagcgggggtctggacaagtcggcacatacgggcttaacaccttcacaaatatggaagcccagctgatcagacagatggagggcgaaggaattttcaaaagcatccaacatctcaccgtgacggaggagattgcggttcagaactggctggcccgcgtgggccgggaaagactttcccgcatggctatctctggggacgattgcgtcgtgaagccgctggacgatcggtttgccagcgctctcaccgccctgaatgacatgggaaaggttagaaaagatatccagcagtgggagccttcccgcggctggaacgactggacacaagtgcccttctgctctcaccactttcatgaactggtcatgaaggatgggcgggtgctcgtcgtgccctgtagaaatcaggacgagctgattggacgcgcgcggatcagccagggcgccgggtggtcccttaaagaaaccgcttgcctgggcaagagctatgcccagatgtggacactcatgtacttccacagacgcgatctgcggcttgctgccaacgctatttgttctgccgttccttcccattgggtgccgaccagcagaacaacctggtctatccacgcgaaacacgagtggatgacgacagaggacatgctggccgtctggaaccgggtgtggattcaagaaaatccctggatggaggacaagacccctgtggaatcctgggaggaagttccctatctcggaaagagagaggatcagtggtgcggcagcctgatcgggctgacctcccgcgctacatgggccaaaaacattcagaccgccatcaatcaggtgcggtctctcatcggaaacgaggaatacacagactatatgcctagcatgaagagatttcgcagagaggaagaggaagctggcgtcctgtggtga

SEQ ID NO: 20287 - RNA, 9876 nt, synthetic construct
  misc_feature 1..9876: note = derived and/or modified CDS sequence (opt5) from DENV-2__GQ398290__SS-prME
  source 1..9876: mol_type = other RNA
accgccggcgtgatcattatgctgatccccacggctatggccttccacctcacgacccggaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacttcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgattttaacgaaatggttctgctccagatggaggacaaggcttggctggtgcaccgccaatggttccttgatctgccgctcccttggctgcccggggccgacacacagggatctaattggatccagaaggagaccctggtcacgtttaagaaccctcatgctaaaaagcaggacgtggttgtgctcggctcccaagaaggggccatgcacacagccctgaccggcgctacagagattcagatgagctccggaaatcttctgttcaccggccatctcaaatgcagactgcggatggataaacttcagctgaaagggatgtcttacagcatgtgtaccggaaagttcaagatcgtcaaagaaattgcggagacacaacacggcacgatcgtgatcagagtccagtatgagggggacggatccccctgcaagattccctttgaaatcatggatctcgagaaacgccatgtgctgggccggctgattaccgttaaccctatcgtgacagaaaaggacagcccggtcaacattgaggccgaaccccctttcggggattcttacatcattatcggcgtggagcccggacagctcaaactgaattggtttaagaagggctccagcatcgggcagatgttcgagaccacaatgagaggagctaaacgcatggccattcttggcgacaccgcctgggattttgggtctctgggaggcgttttcacgagcatcgggaaggctctccaccaagtgtttggcgccatttacggagcggctttctccggcgtctcttggacaatgaaaatcctgattggggtgatcatcacctggattggaatgaacagccggtccaccagcctgtctgtgtcccttgttctcgtcggcgtggtgacactgtatctgggggccatggtccaggccgacagcggatgtgtggtttcttggaagtccaaagaactcaagtgcggcagcgggatctttattaccgataatgtgcacacatggacggagcagtacaagttccagcctgaatccccctctaaactggctagcgccatccaaaaggctcatgaggaaggcatttgtggaatcagatccgtcacccgccttgagaacctgatgtggaaacagatcacaccggagctcaatcacattctgtctgaaaacgaggtgaagctgaccatcatgacaggcgacattaaagggatcatgcaggccggaaagcggagccttagacctcagcccaccgaactcaaatattcctggaagacgtggggcaaggcgaaaatgctgagcaccgagtctcataatcaaacatttctgattgatgggcctgaaaccgccgagtgccccaacacaaatcgcgcttggaactccctcgaggttgaagactacggattcggcgtgtttaccacaaatatctggctgaaacttcgggagaaacaggacgtcttctgtgatagcaagctgatgtctgccgctatcaaagacaacagagccgtgcacgcggatatgggctattggattgaatccgccctcaatgacacctggaagatggagaaggctagcttcatcgaggttaaatcttgccactggcctaagagccatacgctgtggtccaacggggtgctggaaagcgagatgattatccccaaaaattttgccggaccggtctctcagcacaactaccgccctggctatcatacacagaccgctgggccctggcaccttggaaagctcgaaatggatttcgacctgtgtgagggcaccacagtggtggtcaccgaaaactgcgggaatcggggaccctccctgagaacgacaaccgccagcggcaaactcattacagagtggtgctgtcggtcctgcaccctgcctccgcttcgctacagaggcgaggatgggtgttggtacggaatggaaatccggcccctgaaggagaaggaagagaacctcgttaattctctggtgacagccggccatgggcaaattgacaactttagcctgggagtgcttggcatggctctcttcctggaagagatgctgagaacccgcgtcgggacgaaacacgcgatcctcctggtggccgtttcctttgtgacccttatcacaggaaatatgtctttccgggatctgggcagagtcatggtgatggttggcgctaccatgacagacgatattgggatgggagtgacctatctcgccctgctggccgcttttaaggtccgccctacgttcgccgcgggccttctgctcagaaaactgacaagcaaggagctcatgatggctaccatcgggattgccctgctttcccagtctacaatccccgaaaccattctggagctcaccgacgccctggctctgggaatgatggtgcttaaaatcgttcggaacatggaaaagtaccagctggccgtgacaatcatggcgattagctgcgtccctaatgctgtgatcctccaaaacgcctggaaggtgtcctgtacgattctggccgctgtcagcgtttctcccctcctgcttacctccagccagcagaaagccgattggatccctctggctctcacaattaagggcctgaatcccaccgccatctttctgacaaccctttctcgcacgtccaaaaagagaagctggccgctgaacgaggcgatcatggccgtggggatggtgtctattctcgcttccagcctgctcaaaaatgacatccctatgacaggacccctggtcgccggcggccttctgaccgtgtgctatgttctgaccgggcggtccgctgacctcgaactggagcgcgccgccgatgtgaagtgggaggaccaggctgaaattagcggatctagccctatcctttccattacaatctctgaggatggcagcatgtccattaaaaacgaagaggaggaacaaaccctgacaatcctcatcagaacggggctgctcgtcatttctggagtgttccccgttagcatcccgattaccgcggccgcttggtacctgtgggaggtgaagaagcagcgggccggcgtcctttgggacgtgccttctccccctcccgtcgggaaagccgaactggaggatggagcttatcgcatcaagcagagaggcattctgggctacagccagatcggggccggagtgtataaagaaggcacatttcacaccatgtggcatgttacaagaggggcggtgctcatgcaccgcggaaagagaatcgagcccagctgggctgacgtcaaaaaggatctgatttcctacggcgggggatggaaacttgagggcgaatggaaagagggcgaagaggtgcaagttctggccctcgaacctgggaagaatccgcgggccgtgcagaccaaacccggactgttcaagacgaacaccggcacaatcggggctgtcagcctcgacttttctcctggaacctccggcagccccattgtggatagaaaagggaaggtggttggactgtacggcaatggcgtcgtgacacgctctggggcctatgtgtccgcgatcgctcagaccgaaaagagcattgaggacaaccctgaaatcgaggatgacatcttccggaaaaagagacttacaattatggatctgcatcccggagccggcaaaacgaagcgctacctgcctgccatcgtccgggaagctattaaaagagggctccgcaccctgatccttgccccgacacgggtggttgctgccgagatggaagaggcgctgagaggactccccattcgctatcagacccctgccatccgggctgagcacaccggcagagaaattgtggacctgatgtgtcatgccacattcacgatgcggctcctgtcccccgtccgcgtgcctaactacaatcttatcatcatggacgaggctcactttaccgatcccgcctctattgccgctagagggtatatcagcacacgggttgaaatgggcgaggcggccggaattttcatgaccgctacaccgcctggctcccgcgacccctttccccaaagcaacgcccctatcatggatgaggaaagagagattcccgaacggtcttggaactccgggcacgagtgggtgaccgacttcaagggaaagacggtctggtttgtgcctagcatcaaagccggcaacgatatcgctgcctgcctgagaaagaatgggaaaaaggttattcagctgtctcgcaaaacattcgacagcgaatacgtgaagacccgggcgaacgattgggactttgtcgtgaccacagatatctccgagatgggagctaatttcaaggccgagagagtgattgacccgcgccggtgtatgaaacccgtcatcctcaccgatggcgaagagagagttattctggccgggcctatgcccgtgacacattctagcgctgcccagcgccggggcagaatcggacgcaaccctaagaatgaaaacgaccaatatatctacatgggcgagccccttgaaaatgacgaggattgcgcgcactggaaagaggccaagatgctgctcgacaacattaataccccggaagggatcattccttccatgtttgagcccgaaagagagaaagtggatgctatcgacggagaataccggctgcgcggcgaggccagaaagacgttcgtcgatctgatgcggcgcggggacctccctgtgtggcttgcttatagagttgccgctgagggaattaactacgccgatcggagatggtgttttgacggcatcaaaaataaccagattctggaagagaacgtggaagtcgagatctggacaaaggagggggaacgcaagaaactgaagccccggtggctcgatgcgagaatctattctgaccctctggcccttaaagagttcaaggagttcgctgccggccgcaaaagcctgaccctcaatctgattacagagatgggacggctgcccacctttatgacgcagaaggctagagatgccctcgacaaccttgccgtgctgcataccgctgaagcgggcgggcgggcctacaatcacgctctgtccgagctcccggagacactggaaacccttctgctcctgacactgctcgccaccgttacaggaggcatcttcctttttctgatgagcgggcgcggaattggcaagatgaccctgggcatgtgctgcatcattacggcctctatcctcctgtggtatgctcagatccaacctcactggattgccgcgtccatcattcttgagttctttctgatcgtgctcctgattcccgaacccgagaaacagagaacacctcaggataaccagctgacctacgtcgtgatcgccatcctcaccgtcgtggctgccacaatggctaatgaaatggggttccttgagaagaccaaaaaggacctgggactgggcagcattacaacgcaagagtccgaatctaacatcctcgacattgatctgcggccggccagcgcgtggaccctttatgccgttgctacaacctttgtgacacccatgctgcgccattccatcgaaaattctagcgtgaacgtctccctcaccgccattgctaatcaggccacggttctgatggggctgggaaaaggctggcctctcagcaagatggacatcggggtgccccttctggctattggatgttactctcaggtgaaccctatcaccctgacagccgcgctcctgcttctggtcgcccactacgctatcattggccccggcctccaggccaaggctaccagagaagcccaaaaacgggccgcggctgggatcatgaagaatcctacagtggatggaattaccgttatcgacctggagccgattccctatgatcctaaattcgaaaagcagctgggccaggtgatgctccttatcctgtgcgtcacacaggtgctgatgatgcgcacaacctgggccctctgtgaggctctgacacttgccaccgggcccatctccaccctgtgggagggaaaccctggcagattttggaatacaacgattgccgtcagcatggctaacatcttccgggggtcttacctcgccggagcgggcctgctgttttccattatgaaaaataccacaaacacccgcagaggcacagggaatatcggagaaaccctcggcgagaagtggaagtcccggcttaacacgctggggaaatctgagttccaaatttataagaaaagcggaatccaggaggtggacagaacactggccaaggagggcatcaaacgcggggaaaccgatcatcacgctgtttcccggggatctgccaagctcagatggtttgtggagcgcaacatggtcacccccgaaggcaaagtggttgacctgggctgcgggcggggaggctggagctactattgtgggggacttaagaatgtgagagaggtcaagggcctgacaaaagggggaccgggccatgaagaacctattcccatgtccacctacggctggaacctcgtgcgcctgcagagcggggtggatgttttcttcacaccccctgagaagtgcgacacgctgctctgtgatatcggagaatcctctcccaatcctaccattgaggctggccggacacttagagtcctgaacctggtggaaaattggctcaacaataacacccaattttgcatcaaagtgctgaatccgtatatgcccagcgtcattgagaagatggaaacacttcagcgcaaatacgggggagccctggttcggaaccctctctccagaaattctacccacgagatgtactgggtgagcaacgcgacgggcaatatcgtgtcctctgtcaacatgatcagccgcatgctgattaatcggttcaccatgaagcacaagaaagccacatatgagcccgacgtggatctggggtccggaaccagaaacatcggcattgaaagcgagatccctaacctcgacattatcggcaagcgcattgagaagatcaagcaggagcatgaaacatcttggcactacgaccaggatcatccctataaaacctgggcttaccacgggtcctatgagacaaagcaaaccggaagcgcctcttccatggttaatggcgtggtcagacttctgacgaagccgtgggacgtggttcctatggtgacacagatggctatgaccgataccacaccctttgggcagcagcgggtcttcaaagagaaggtggacacgcgcacccaagaacctaaagagggaacaaagaaactgatgaagatcaccgccgaatggctctggaaggagctgggcaaaaagaaaacacccagaatgtgtacccgggaggaatttacaagaaaggtgcggagcaacgctgcccttggggcgattttcaccgatgagaataaatggaagtctgcccgcgaagctgtcgaggactccagattttgggaactgatcgatcgggagcgcaacctccacctggagggaaaatgcgaaacgtgtgtttacaatatgatgggcaagagagagaagaaactgggcgagttcgggaaggccaaaggaagccgggctatttggtatatgtggctcggcgcccgctttctggagttcgaagcccttgggtttctgaacgaggaccattggttctccagaggaaatagcctctctggcgtggagggggaaggcctgcaccggcttggatacatcctgcgcgatgtgagcaagaaagagggcggggcgatgtacgctgacgataccgccggatgggacacaagaattaccctcgaagacctgaagaacgaggaaatggtcacaaatcatatgaagggcgagcacaaaaagctggccgaggctatctttaaactcacctatcagaacaaggtggttcgggtgcagcgccctacgcccagagggacagtcatggatatcatttcccggcgcgaccagagaggatctggccaagtggggacctacggcctgaatacattcaccaacatggaagcccagcttatccggcagatggagggagaaggcattttcaaaagcatccaacatctgacggctaccgaggagattgccgttcagaattggctcgcgagagtggggcgcgaacggctgtccagaatggccatctctggagatgactgcgtcgtgaagccgcttgatgaccgctttgctagcgccctgacagctctcaacgatatgggcaaggttcggaaagacatccagcagtgggagccttccagagggtggaatgattggacccaagtgcccttctgctctcaccactttcatgaactggtcatgaaggacggacgcgtgctggtcgtgccctgtcggaaccaggatgagctcattggcagagcccgcatcagccagggggcgggctggtccctgaaagaaacagcctgccttggaaagagctatgctcagatgtggaccctgatgtacttccaccggagagacctccgcctggccgctaacgccatttgttctgctgttccttcccattgggtgccgacaagccggaccacgtggtctatccacgccaaacacgagtggatgacaaccgaggatatgcttgcggtctggaatagagtgtggattcaagaaaacccctggatggaggacaagacccctgtggaatcctgggaggaagttccctatctgggcaagcgggaggaccagtggtgcgggagcctcatcggactgacatccagagccacctgggctaaaaatattcagacagccatcaaccaggtgcgctctctgatcggcaatgaggaatacacggattatatgcctagcatgaagcggtttagacgcgaggaagaggaagccggggtcctctggtga

SEQ ID NO: 20288 - RNA, 9876 nt, synthetic construct
  misc_feature 1..9876: note = derived and/or modified CDS sequence (opt5) from DENV-2__GQ398284__SS-prME
  source 1..9876: mol_type = other RNA
accgcgggagtgatcattatgctgatccccacagctatggccttccacctcacgaccagaaatggggaacctcatatgattgttgggaagcaggaaaagggcaagagcctgctttttaaaacagaggacggggttaatatgtgcaccctgatggcgatcgatctcggagaactgtgtgaggacacaattacctacaagtgcccgcttctgcggcaaaatgaacccgaggatatcgactgttggtgcaattccacatctacctgggtgacgtatggcacctgtacaaccacaggggagcacagaagagaaaaacggagcgtggctctcgtccctcatgtgggaatgggcctggagacccgcacggaaacatggatgtcctctgagggcgcctggaagcacgttcagagaatcgagacctggattctgcggcatcccgggttcacaatcatggccgctattctcgcctacaccatcggaaccacacactttcagcgcgctctgattttcatccttctgacggccgtggcgcctagcatgaccatgagatgcattggcatctccaaccgggattttgtcgaaggggtgtctggaggcagctgggttgacatcgtgctcgagcacgggtcctgtgtcacaaccatggccaagaataaacccacactggatttcgaacttattaagaccgaggctaaacagcctgccacgctgcgcaagtattgcatcgaagctaaactcacaaacaccaccacagagagcagatgtccgacccaaggagagccctctctgaatgaggaacaggacaagcggtttctgtgcaagcattccatggtggatcgcggctggggcaacgggtgtggactcttcggcaaagggggaattgtgacatgcgccatgtttacgtgcaagaaaaatatggaaggcaaggtcgttcagcctgagaacctggaatacaccatcgtgattacaccccacagcggggaggagcatgcggtgggaaatgacaccggcaaacacggcaaggaaatcaaaatcacacctcagtcttccattaccgaggccgaacttacggggtatggaaccgtcacaatggagtgtagccccagaaccggcctggatttcaacgaaatggtgctcctgcaaatggaggacaaggcttggcttgttcaccggcagtggtttctggatctcccgctgccttggctgcccggggccgacacacagggatctaattggatccagaaggagaccctcgtgacgttcaaaaaccctcatgctaagaaacaagacgtcgtggccctgggctcccaggaaggggccatgcacacagctcttaccggcgcgacagagattcagatgagctccggaaatctgctctttaccggccatctgaagtgccgccttagaatggataaactgcaactcaaggggatgtcttacagcatgtgtaccggaaagttcaaaatcgttaaggaaattgccgagacacagcacggcacgatcgtgatccgggtccagtatgagggggacggatccccctgcaaaattcccttcgaaatcatggatctggagaagagacatgtgctgggccgcctcattaccgtcaaccctatcgtgacagaaaaagacagcccggttaacattgaggctgaacccccttttggggattcttacatcattatcggcgtggagcccggacagctgaaacttaattggttcaagaaaggctccagcatcgggcaaatgtttgagaccacaatgcggggagccaagagaatggccattctgggcgacaccgcttgggatttcgggtctctcggaggcgtctttacgagcatcgggaaagccctgcaccaggtgttcggcgcgatttaccgcgctgccttttccggagtttcttggacaatgaagatcctgattggcgtgatcatcacctggattgggatgaacagccggtccaccagcctttctgtctccctcgtgctggtgggagttgtcacactgtatctcggcgccatggtgcaggctgacagcgggtgtgtggtctcttggaaaaataaggaactgaagtgcggatccggcatcttcattaccgataacgtgcacacatggacggagcagtacaaatttcaacctgaaagcccctccaaacttgcctctgctatccagaaagcccatgaggaagggatttgtggcatcagaagcgttacccgcctggagaatctcatgtggaagcagatcacaccggagctgaaccacattctgtccgaaaatgaggtgaaacttaccatcatgacaggagacattaagggcatcatgcaggcggggaaacggtctctcagacctcaacccaccgaactgaagtatagctggaagacgtggggaaaagccaagatgctgtccaccgagagccataaccagacattcctcattgatggccctgaaaccgctgagtgccccaatacaaaccgcgcctggaactctctggaggtcgaagactacgggtttggagtgttcaccacaaacatctggcttaaactgcgggagaagcaggacgtcttttgtgattccaaactcatgagcgctgccatcaaggacaatagagcggtgcacgccgatatgggctattggattgaatctgctctgaacgacacctggaagatggagaaagcctccttcatcgaggtcaagagctgccactggcctaaatctcatacgctgtggagcaatggcgtgcttgaatccgagatgattatccccaagaacttcgctgggccggttagccagcacaactaccgccctggatatcatacacaaaccgccggcccctggcacctcgggaaactggaaatggattttgacttctgtgagggaaccacagtggtcgtgaccgaagattgcggcaatcgggggccctctctgagaacgacaaccgcctccggaaagctcattacagagtggtgctgtcggagctgcaccctgcctccgcttcgctacagaggcgaggacggctgttggtacgggatggaaatccggcccctgaaggagaaagaagagaacctcgtgaatagcctggtcacagctggacatggccagattgataacttttctctgggggttcttggaatggccctcttcctggaagagatgctgagaacccgcgtgggcacgaagcacgccatcctcctggtggctgtcagctttgtgacccttatcacagggaatatgtccttccgggacctgggaagagttatggtgatggtcggcgccaccatgacagatgacattggcatgggggtgacctatctcgccctgctggctgcctttaaagttcgccctacgttcgcggctggacttctgctcagaaagctgacatctaaagagctcatgatggccaccatcggcattgccctgcttagccagtccacaatccccgaaaccattctggagctcaccgatgctctggccctggggatgatggtgcttaagatcgtccggaacatggaaaagtaccaactggcggtgacaatcatggctatttcttgcgttcctaatgccgtgatcctccagaacgcctggaaagtcagctgtacgattctggctgccgtgtccgtgagccccctcctgcttacctcttcccagcagaaggctgactggatccctctggccctcacaattaaaggactgaatcccaccgcgatctttctgacaacccttagccgcacgtctaagaaaagatcctggccgctgaacgaggccatcatggctgtcggcatggttagcattctcgcctcttccctgctcaagaatgacatccctatgacagggcccctggtggctggaggccttctgaccgtgtgctatgtcctgaccggccggagcgccgatctcgaactggagcgcgccgctgacgtgaaatgggaggatcaagcggaaatttccgggagctctcctatccttagcattacaatctccgaggacggatctatgagcattaagaacgaagaggaggaacagaccctgacaatcctcatcagaacgggcctgctcgttatttccggggtgttccccgtctctatcccgattaccgccgctgcctggtacctgtgggaggtgaagaaacagcgggccggagttctttgggatgtgccttctccccctcccgtcggcaaggctgaactggaggacggggcctatcgcatcaaacagagaggcattctgggctactcccaaatcggcgcgggggtgtataaggaaggaacatttcacaccatgtggcatgtcacacggggcgctgtgctcatgcaccgcgggaaaagaatcgagccctcctgggccgatgttaagaaggacctgattagctacggaggcgggtggaaacttgagggagaatggaaggagggcgaagaggtgcaggtcctggccctcgaacctggcaaaaatccgcgggctgtgcagaccaagcccgggctgttcaaaacgaacaccggaacaatcggcgccgtttccctcgattttagccctgggacctctggatcccccattgtggacagaaagggcaaggtcgtggggctgtacggaaatggcgtggttacacgcagcggcgcgtatgtctctgctatcgcccagaccgagaaatccattgaggataaccctgaaatcgaggacgatatcttccggaagaaaagacttacaattatggacctgcatcccggggccggaaagacgaaacgctacctgcctgctatcgtgcgggaagccattaagagaggcctccgcaccctgatccttgctccgacacgggtggtcgccgcggagatggaagaggccctgagagggctccccattcgctatcaaacccctgctatccgggccgagcacaccggaagagaaattgtggacctgatgtgtcatgctacattcacgatgcggctcctgagccccgttcgcgtgcctaactacaatcttatcatcatggatgaggcccactttaccgaccccgcctccattgctgcgagaggctatatctctacacgggtcgaaatgggggaggccgctggcattttcatgaccgccacaccgcctggaagccgcgatccctttccccagtccaacgcccctatcatggacgaggaaagagagattcccgaacggagctggaactctggccacgagtgggtgaccgatttcaaggggaaaacggtttggtttgtgccttccatcaaggctggaaacgacatcgccgcgtgcctgcgcaagaatggcaagaaagtcattcagctgagccgcaagacattcgattctgaatacgtgaagacccgggctaacgactgggattttgttgtgaccacagacatcagcgagatgggggccaatttcaaagccgagagagtcattgatccgcgccggtgtatgaagcccgtgatcctcaccgacggagaagagagagtgattctggctggccctatgcccgtcacacattcctctgccgcgcaacgccgggggagaatcggccgcaaccctaaaaatgaaaacgaccagtatatctacatgggagagccccttgaaaatgatgaggactgcgcccactggaaggaggctaaaatgctgctcgataacattaataccccggaaggcatcattcctagcatgtttgagcccgaaagagagaaggttgacgccatcgatggggaataccggctgcgcggagaggctagaaaaacgttcgtggacctgatgcggcgcggcgatctccctgtgtggcttgcctatagagtcgctgccgaggggattaactacgcggaccggagatggtgttttgatggaatcaagaataaccagattctggaagagaacgtggaagttgagatctggacaaaggagggcgaacgcaaaaagctgaaaccccggtggctcgacgccagaatctattccgatcctctggctcttaaggagttcaaagagttcgccgctgggcgcaagtctctgaccctcaatctgattacagagatgggccggctgcccacctttatgacgcagaaggccagagacgccctcgataaccttgctgtgctgcataccgcggaagccggaggcaaggcttacaatcacgccctgagcgagctcccggagacactggaaacccttctgctcctgacactgctcgccaccgtcacagggggaatcttcctttttctgatgtccggcaaggggattggaaaaatgaccctgggcatgtgctgcatcattacggctagcatcctcctgtggtatgcccaaatccagcctcactggattgcggcctctatcattcttgagttctttctgatcgtgctcctgattcccgaacccgagaagcagcggacacctcaggacaaccaactgacctacgttgtgatcgctatcctcaccgtcgtggccgctacaatggccaatgaaatgggcttccttgagaaaaccaagaaggacctggggctgggatccattatcacacaggagagcgaatccaacattctcgatatcgacctgcgcccggcgtctgcctggacgctttatgctgtcgccaccacatttgtgacccccatgctgagacatagcattgaaaattcctctgttaacgtgagcctcacagctatcgccaatcaggctaccgtgctgatgggcctggggaaaggatggcctctctccaagatggatattggcgtcccccttctggccatcgggtgttacagccaggttaaccctatcacgctgaccgcggccctcctgcttctggtggctcactacgccattatcggacccggcctccaagctaaagccacacgggaagcccagaagcgcgcggctgccggcattatgaaaaatcctaccgtggacgggatcacagtcattgatctggagccgatcccctatgaccctaagttcgaaaagcagctgggacaggtgatgctccttatcctgtgcgttacccaagtgctgatgatgagaacgacatgggctctctgtgaggccctgacccttgccacaggccccatttctaccctgtgggaggggaaccctggacggttttggaataccacaatcgctgtctccatggccaacattttccgcggcagctacctcgcgggggccggactgctgttttctatcatgaaaaatacgaccaacacaagacggggcaccggcaatattggggaaacactcggagagaagtggaaatcccgccttaacgctctgggcaagagcgagttccagatctataaaaagtctgggatccaggaggtggatagaaccctggccaaagagggaattaagcggggcgaaacggaccatcacgctgtcagcagagggtccgccaagctccgctggtttgtggagcggaacatggttacacccgaaggaaaagtggtcgatctgggctgcggcagagggggatggtcttactattgtggcgggcttaagaatgtgcgcgaggttaaaggactgaccaagggcgggccgggacatgaagaacctatccccatgagcacctacggctggaacctcgtgcggctgcaatccggcgtcgacgtgttcttcacaccccctgagaaatgcgataccctgctctgtgacattggggaaagctcccccaatcctacaatcgaggcgggaagaacgcttcgcgtgctgaacctggttgaaaattggctcaacaataacacccagttttgcattaaggtcctgaatccgtatatgccctctgtgatcgagaagatggaaacacttcagcggaaatacggcggggccctggtgagaaaccctctcagccgcaattccacccacgagatgtactgggtctctaacgctacaggaaatatcgttagctccgtgaacatgatttctcggatgctgatcaatagattcaccatgaagcacaaaaaggccacgtatgagcccgatgtggacctgggcagcgggacccgcaacattggaatcgaatccgagattcctaacctcgacatcattggcaaacggatcgaaaagatcaagcaggagcatgaaacaagctggcactacgatcaagaccatccctataaaacctgggcttaccacggctcttatgagacaaagcagaccgggtccgccagctctatggtcaatggagtggttagacttctgacaaaaccgtgggatgtggtccctatggtgacccagatggctatgacggacacaaccccctttggccagcaacgcgttttcaaggagaaagtggataccagaacacaggaacctaaggaggggacgaagaaactgatgaagattaccgccgaatggctctggaaagagctgggaaagaaaaagacaccccggatgtgtacccgcgaggaatttacaagaaaagtccggtccaacgcggcccttggcgctatcttcaccgacgagaataagtggaaaagcgccagagaagctgtggaggattctcggttttgggaactggtggaccgcgagagaaacctccacctggaggggaaatgcgaaacatgtgtctacaatatgatgggaaagcgggagaaaaagctgggcgagttcggcaaagccaaggggtcccgcgccatttggtatatgtggctcggagcgagatttctggagttcgaagctcttggctttctgaacgaggatcattggttcagccggggaaattccctcagcggagttgagggcgaagggctgcaccgccttggctacatcctgagagacgtgtctaagaaagagggaggcgccatgtacgccgatgacaccgctgggtgggacacgcggattaccctcgaagatctgaagaacgaggaaatggtgacaaatcatatgaaaggagagcacaagaaactggccgaggctatctttaagctcacctatcagaacaaggtcgtgcgcgttcagagacctacaccccggggcaccgtgatggacatcattagccgcagagatcaacgggggtccggacaggtcggcacgtacgggctgaatacattcaccaacatggaagcccagcttatccgccaaatggagggcgaaggaattttcaaatctatccagcatctgacagtgaccgaggagattgcggttcagaattggctcgccagagtgggccgggaaagactgagccgcatggctatctccggggacgattgcgtcgtgaagccgcttgacgatcggtttgcctctgctctgacggccctcaacgacatgggaaaagttagaaaggatatccagcaatgggagcctagccgcggctggaatgactggacccaggtgcccttctgctcccaccactttcatgaactggtcatgaaagatgggcgggtgctggtcgtgccctgtagaaaccaggacgagctcattggacgcgcgcggatctctcagggcgccgggtggagcctgaaggaaacagcttgccttggcaagtcctatgcccaaatgtggaccctgatgtacttccacagacgcgatctccggctggctgccaacgctatttgtagcgccgttccttctcattgggtgccgacatccagaaccacatggagcatccacgcgaatcacgagtggatgaccacggaggacatgcttgccgtctggaaccgcgtgtggattcaggaaaatccctggatggaggacaaaacacctgtggaatcttgggaggaagttccctatctgggaaagcgggaggatcagtggtgcggctccctcatcgggctgaccagcagagctacctgggccaaaaacattcagacagccatcaatcaagtgcggtccctgatcggaaacgaggaatacaccgactatatgccttctatgaagagatttcgccgggaggaagaggaagctggcgtcctctggtga

SEQ ID NO: 20289 - RNA, 9876 nt, synthetic construct
  misc_feature 1..9876: note = derived and/or modified CDS sequence (opt5) from DENV-2__GQ398308__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagagcaggacaaacgctttgtgtgcaagcattccatggtggatagaggctggggcaacgggtgtggactgttcggcaaggggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaagcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaagcttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcagcacaaatatctggcttaagctgcgggagaaacaggacgtcttttgtgattctaagctcatgtccgctgccatcaaagacaacagagcggtgcacgccgatatgggctattggattgaaagcgctctgaatgacacctggaagatggagaaggcctctttcatcgaggttaaaagctgccactggcctaagtcccatacactgtggagcaacggggtgcttgaatctgagatgattatccccaaaaatttcgctggaccggtctcccagcacaactaccgccctggctatcatacccagacggccgggccctggcacctcggaaagctggaaatggattttgacttctgtgagggcacaaccgtggtggtcaccgaagattgcgggaaccggggacccagcctgagaacaaccacggcctccggcaaactcattacagagtggtgctgtcggtcttgcaccctgcctccgcttcgctacagaggcgaggacgggtgttggtacggaatggaaatccggcccctgaaggagaaggaagagaatctcgttaacagcctggtgacagctggccatgggcaaattgataatttttccctgggagtgcttggcatggcgctcttcctggaagagatgctgagaacccgcgtcgggacaaaacacgccatgctcctggtggctgtttcttttgtgacccttatcacgggaaacatgagcttccgggacctgggcagagtcatggtgatggttggcgccaccatgacagatgacatcgggatgggaattacctatctcgccctgctggctgcctttaaggtgcgccctacattcgcggctggccttctgctcagaaaactgacctccaaggagctcatgatggccacgatcgggattgccctgctttctcagagcacaatccccgaaaccattctggagctcacagatgctctggccctgggaatgatggtccttaaaatcgtgcggaatatggaaaagtaccagctggcggttaccatcatggctatttcctgcgtgcctaacgccgtcatcctccaaaatgcctggaaggtgagctgtaccattctggctgccgtgtctgtctcccccctcctgcttacaagctctcagcagaaagctgactggatccctctggccctcacgattaagggcctgaaccccaccgcgatctttctgacaaccctttcccgcacaagcaaaaagagatcttggccgctgaatgaggccatcatggctgttgggatggtgtccattctcgccagctccctgctcaaaaacgacatccctatgaccggacccctggtggctggcggccttctgacggtctgctatgtgctgacagggcggagcgccgatctcgaactggagcgcgccgctgacgttaagtgggaggatcaggcggaaatttctggaagctcccctatcctttctattaccatcagcgaggacggctccatgtctattaaaaatgaagaggaggaacaaaccctgacaatcctcatcagaaccgggctgctcgtgattagcggagtcttccccgtgtccatcccgattacagccgctgcctggtacctgtgggaggttaagaagcagcgggccggcgtgctttgggatgtcccttctccccctcccgtggggaaagctgaactggaggacggagcctatcgcatcaagcagagaggcattctgggctacagccagatcggggcgggagtctataaagaaggcacgtttcacaccatgtggcatgtgacacggggggctgttctcatgcaccgcggaaagagaatcgagccctcctgggccgatgtgaaaaaggacctgattagctacggcgggggatggaagcttgagggcgaatggaaagagggcgaagaggtccaagtgctggccctcgaacctgggaagaacccgcgggctgttcagaccaaacccggactgttcaagacaaataccggcacgatcggggccgtgtctctcgatttttcccctggaaccagcggctctcccattgtcgacagaaaagggaaggtggtgggactgtacggcaacggcgttgtcacacgctccggggcgtatgtgagcgctatcgcccagaccgagaagtccattgaggataatcctgaaatcgaggacgatatcttccggaaaaagagacttacaattatggacctgcatcccggagccggcaaaaccaagcgctacctgcctgctatcgtgcgggaagccattaaaagagggctccgcacactgatccttgctccgacgcgggtcgtggccgcggagatggaagaggccctgagaggactccccattcgctatcagacccctgctatccgggccgagcacacaggcagagaaattgttgacctgatgtgtcatgctaccttcaccatgcggctcctgtctcccgtgcgcgtccctaactacaaccttatcatcatggatgaggcccactttacagaccccgccagcattgctgcgagagggtatatctccacgcgggtggaaatgggcgaggccgctggaattttcatgaccgccacaccgcctggcagccgcgatccctttccccaatctaatgcccctatcatggacgaggaaagagagattcccgaacggtcctggaacagcgggcacgagtgggttaccgatttcaagggaaagacagtgtggtttgtcccttctatcaaagctggcaatgacatcgccgcgtgcctgagaaagaacgggaaaaaggtgattcagctgagccgcaaaaccttcgattccgaatacgttaagacgcgggctaatgactgggattttgtggtcacaaccgacatctctgagatgggagccaacttcaaggccgagagagtgattgatccgcgccggtgtatgaaacccgtgatcctcaccgacggcgaagagagagtcattctggctgggcctatgcccgttacacatagctccgccgcgcagcgccggggcagaatcggacgcaatcctaagaacgaaaatgaccaatatatctacatgggcgagccccttgaaaacgatgaggactgcgcccactggaaagaggctaagatgctgctcgataatattaacaccccggaagggatcattccttctatgtttgagcccgaaagagagaaagtggacgccatcgatggagaataccggctgcgcggcgaggctagaaagacattcgtggacctgatgcggcgcggggatctccctgtctggcttgcctatagagtggctgccgagggaattaattacgcggaccggagatggtgttttgatggcatcaaaaacaatcagattctggaagagaacgttgaagtggagatctggaccaaggagggggaacgcaagaaactgaagccccggtggctcgacgccagaatctatagcgatcctctggctcttaaagagttcaaggaattcgccgctggccgcaaatccctgacgctcaacctgattacagagatgggacggctgcccacctttatgacacagaaggccagagacgccctcgataatcttgctgtcctgcataccgcggaagccggcgggcgggcttacaaccacgccctgagcgagctcccggagacgctggaaacccttctgctcctgacactgctcgccaccgtgacaggaggcatcttcctttttctgatgtctgggaagggaattggcaaaatgaccctgggcatgtgctgcatcattacagcttccatcctcctgtggtatgcccagatccaacctcactggattgcggccagcatcattcttgagttctttctgatcgttctcctgattcccgaacccgagaagcagcgcacccctcaggacaatcagctgacgtacgtggtcatcgctatcctcacagtggtcgccgctaccatggccaacgaaatggggttccttgagaaaaccaagaaagacctgggactgggctccattgcgacacaagagtctgaaagcaatatcctcgatattgacctgagaccggcctccgcttggaccctttatgccgtggctacaacgtttgttacccccatgctgcggcattctatcgagaacagctccgtgaatgtgagcctcacagccattgctaaccaggccaccgtcctgatggggctgggaaagggctggcctctctctaagatggatatcggggttccccttctggcgattggatgttactcccaggtgaatcctatcacactgaccgccgctctcctgcttctggtggcccactacgctatcattggccccggcctccaggccaaagccacgcgcgaagcgcaaaagagagctgccgctgggatcatgaaaaaccctaccgtcgacggaattacagtgatcgatctggagccgattccctatgaccctaagttcgaaaaacagctgggccaggttatgctccttatcctgtgcgtgacccaggtcctgatgatgcggacaacctgggccctctgtgaggccctgacgcttgctacagggcccatcagcaccctgtgggagggaaatcctggccgcttttggaacacaaccattgccgtgtctatggcgaatatcttcagagggtcctacctcgccggagctggcctgctgtttagcattatgaagaacaccacaaatacgcggcgcggcaccgggaacatcggagaaacactcggcgagaagtggaaatctagacttaatgccctggggaagagcgaattccaaatttataaaaagtccggaatccaggaggtcgatcggaccctggctaaagagggcatcaagagaggggaaacagaccatcacgccgtgtctcgcggaagcgcgaaactccggtggtttgttgagagaaacatggtgacccccgaaggcaaggtcgtggatctgggctgcgggcgcggaggctggtcctactattgtgggggacttaagaacgttcgggaggtgaaaggcctgacgaaggggggaccgggccatgaagagcctattcccatgagcacatacggctggaatctcgtcagactgcagtccggggtggacgtgttcttcaccccccctgagaaatgcgataccctgctctgtgacatcggagaatctagccccaaccctacaattgaggccggccgcacccttcgggttctgaatctggtcgaaaactggctcaataacgatacacaattttgcatcaaggtgctgaatccgtatatgccctccgtgattgagaaaatggaaacgcttcagagaaagtacgggggagctatcgtccgcaaccctctgtctcggaatagcacccacgagatgtactgggtttccaacgccacaggcaatatcgtgtctagcgtgaacatgatttccagaatgctcatcaatcgcttcaccatgaagcacaaaaaggctacatatgagcccgacgtcgacctggggagcggaacccggaacattggcatcgaatctgagattcctaatctggatatcattggcaaaagaatcgaaaagatcaaacaggagcatgaaacgtcctggcactacgaccaggatcatccctataagacctgggcctaccacgggagctatgagacaaagcaaaccggatctgcttccagcatggtgaacggcgttgtgcgcctccttacaaaaccgtgggacgtcgtgcctatggttacccagatggccatgacagataccacgccctttgggcagcagagagtgttcaaggagaaagtcgacacacggacccaagaacctaaggagggaaccaaaaagctgatgaagattacagcggaatggctgtggaaagagctcggcaagaaaaagacgccccgcatgtgtaccagagaggaatttacacggaaagtgagatctaacgccgctctgggggccatcttcaccgatgagaataagtggaaatccgctcgggaagccgtggaggacagccgcttttgggaacttattgatagagagcggaacctgcacctcgagggaaagtgcgaaacatgtgtctacaatatgatgggcaagcgcgagaaaaagctgggcgaattcgggaaagccaagggatccagagcgatctggtatatgtggctgggcgctcggtttctcgagttcgaagccctggggtttcttaacgaggaccattggttcagccgcggaaattctctgagcggcgttgagggggaaggcctccacagactgggatacattcttcgggatgtgtccaaaaaggagggcggggccatgtacgctgacgacaccgccggatgggatacacgcatcaccctggaagacctcaagaacgaggaaatggtgacgaatcatatgaaaggcgagcacaagaaactggctgaggccatctttaagctgacctatcagaacaaagtcgtgagagttcagcggcctacaccccgcgggaccgtgatggatattatctctagacgggaccagcgcggaagcggccaagtcgggacatacggcctcaataccttcacgaacatggaagcgcagctgattagacagatggagggagaaggcatcttcaagtccattcaacatcttacagtgaccgaggagatcgccgttcagaattggctggctcgggtggggagagaacgcctctctcggatggccatcagcggagatgactgcgtcgtgaagccgctggatgacagatttgcttccgcccttacagcgctgaacgatatgggcaaagttcgcaaggacattcagcagtgggagccttctcgggggtggaatgattggacccaagtgcccttctgcagccaccactttcatgaactcgtcatgaaagacggaagagtgctggtcgtgccctgtcgcaaccaggatgagctgatcggccgggccagaatttcccagggggctggctggagcctcaaggaaacggcctgcctgggaaaatcttatgctcagatgtggacccttatgtacttccaccgccgggacctgagactcgccgctaatgccatctgttccgcggttcctagccattgggtgccgacatctcgcaccacatggtccattcacgccaagcacgagtggatgaccacagaggacatgctgaccgtctggaaccgggtgtggatccaagaaaacccctggatggaggataagacgcctgtggaaagctgggaggaagttccctatcttggcaaaagagaggaccagtggtgcgggtccctgattggactcacatctcgggctacctgggccaagaatatccagaccgccatcaaccaggtgagaagcctgattggcaatgaggaatacacagattatatgccttccatgaaacgctttcggagagaggaagaggaagctggggtcctgtggtga

SEQ ID NO: 20290 - RNA, 9876 nt, synthetic construct
  misc_feature 1..9876: note = derived and/or modified CDS sequence (opt5) from DENV-2__GQ398287__SS-prME
  source 1..9876: mol_type = other RNA
accgccggagtgatcattatgctgatccccacagctatggccttccacctcacgaccagaaacggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaggaacaggacaaacgctttgtgtgcaagcattccatggtggatagaggctggggcaacgggtgtggactgttcggcaaaggcgggattgtcacatgcgcgatgtttacatgcaaaaagaatatggaagggaaagttgtgctccctgagaacctggaatacacgatcgtgattacaccccacagcggggaggagcatgccgtcggaaatgacacaggcaagcacggcaaagaaatcaagatcacccctcagtcttccattacagaggctgaacttaccgggtatggaacggtgaccatggagtgtagcccccggacaggcctggatttcaacgaaatggttctcctgcagatggaggacaaagcctggcttgtgcaccgccaatggtttctggatctcccgctgccttggctgcccggggctgacacccagggatctaattggatccagaaggagacactcgtcaccttcaagaaccctcatgccaaaaagcaggacgtggttgtgctgggctcccaagaaggggccatgcacacggctcttacaggcgcgaccgagattcagatgagctccggaaatctgctctttacaggccatctgaaatgcagacttcggatggataagctgcagctcaaagggatgtcttacagcatgtgtaccggaaagttcaagatcgtcaaagaaattgccgagacccaacacggcacaatcgtgatcagagtccagtatgagggggacggatccccctgcaagattcccttcgaaatcatggatctggagaaacgccatgtgctgggccggctcattacggttaaccctatcgtgaccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatctcgctggaccggtctctcagcacaactaccgccctggctatcatacgcagacagccgggccctggcacctgggaaagctggaaatggatttcgacttttgtgagggcaccaccgtggtggtcacagaagattgcgggaaccggggaccctccctcagaaccacgacagccagcggcaaactgattaccgagtggtgctgtcggtcctgcacacttcctccgctgcgctacagaggcgaggacgggtgttggtacggaatggaaatccggcccctcaaggagaaggaagagaatctggttaactctctggtgaccgctggccatgggcaaattgataatttcagccttggagtgctcggcatggcgctgtttctggaagagatgctcagaacacgcgtcgggaccaaacacgccatcctgcttatcgctgtgtccttcgttacgctgattaccggaaacatgtcttttcgggacctcggcagagtgatggtcatggtgggcgccacaatgaccgatgacatcgggatgggagttacatatctggccctgcttgctgccttcaaggtgcgccctacctttgcggctggcctgctcctgagaaaactcacgagcaaggagctgatgatggccacaattgggatcgcccttctgtcccagtctaccattcccgaaacaatcctcgagctgaccgatgctctggcccttggaatgatggtcctgaaaatcgtgcggaatatggaaaagtaccagctcgcggttaccattatggctatcagctgcgtgcctaacgccgtcattctgcaaaatgcctggaaggtgtcctgtacaatcctcgctgccgtgagcgtctctcccctgcttctgacgtccagccagcagaaagctgactggattcctctcgccctgaccatcaagggcctgaaccccacagcgatcttccttaccacactgtctcgcacctccaaaaagagaagctggccgctcaatgaggccattatggctgttgggatggtgtctatcctggcctccagcctcctgaaaaacgacattcctatgacgggaccccttgtggctggcggcctgctgacagtctgctatgtgctcaccgggcggtccgccgatctggaacttgagcgcgccgctgacgttaagtgggaggatcaggcggaaatcagcggatctagccctattctgtccatcaccatttctgaggacggcagcatgtccatcaaaaatgaagaggaggaacaaacactcaccatcctgattagaacagggctcctggtgatctctggagtctttcccgtgagcattccgatcacggccgctgcctggtacctttgggaggttaagaagcagcgggccggcgtgctgtgggatgtcccttctccccctcccgtggaaaaagctgagctggaagacggggcctatcgcattaagcagagaggaatcctcggctacagccagatcggcgcgggggtctataaagagggaaccttccacacaatgtggcatgtgacccggggcgctgttctgatgcaccgcgggaagagaattgagcccagctgggccgatgtgaaaaaggaccttatctcctacggaggcgggtggaagctggaaggagagtggaaagaaggcgaggaagtccaagtgctcgccctggagcctggcaagaacccgcgggctgttcagacaaaacccgggctctttaagaccaatacgggaaccattggcgccgtgagcctggatttctctcctgggacatccggaagccccatcgtcgacagaaaaggcaaggtggtggggctttacggaaacggcgttgtcacccgctctggcgcgtatgtgtccgctattgcccagacagaaaagagcatcgaggataatcctgagatcgaagacgatatttttcggaaaaagagactgaccatcatggacctgcatcccggggccggaaaaacaaagcgctacctccctgctattgtgcgggaggccatcaaaagaggcctgcgcacgcttattctggctccgacccgggtcgtggccgcggaaatggaggaggccctcagagggctgcccatccgctatcagacccctgctattcgggccgaacacaccggaagagagatcgttgacctcatgtgtcatgctaccttcacaatgcggctgctttcccccgtgcgcgtccctaactacaacctgatcattatggatgaagcccacttcacggaccccgcctctatcgctgcgagaggctatattagcacccgggtggagatgggggaggccgctggcatctttatgacagccaccccgcctggatcccgcgatcccttcccccaaagcaatgcccctattatggacgaagagagagaaatccccgagcggtcttggaactccggccacgaatgggttacagattttaaggggaagaccgtgtggttcgtccctagcatcaaagctggaaatgacattgccgcgtgcctgagaaagaacggcaaaaaggtgatccagctctctcgcaaaacgtttgatagcgagtacgttaagacacgggctaatgactgggatttcgtggtcaccaccgacatttccgagatgggggccaactttaaggccgaaagagtgatcgatccgcgccggtgtatgaaacccgtgattctgacagacggagaggaaagagtcatccttgctggccctatgcccgttacccattctagcgccgcgcagcgccgggggagaatcggccgcaatcctaagaacgagaatgaccaatatatttacatgggagaacccctggagaacgatgaggactgcgcccactggaaagaagctaagatgctcctggataatatcaacacaccggagggcattatcccttccctgttcgaacccgagagagaaaaagtggacgccattgatggggagtaccggctccgcggagaggctagaaagacctttgtggaccttatgcggcgcggcgatctgcctgtctggctggcctatagagtggctgccgaagggatcaattacgcggaccggagatggtgtttcgatggaattaaaaacaatcagatcctcgaggaaaacgttgaggtggagatctggacgaaggaaggcgagcgcaagaaactgaagccccggtggcttgacgccagaatttattctgatcctctggctctcaaagaatttaaggagttcgccgctgggcgcaaaagcctgacactgaacctcatcaccgaaatgggccggcttcccacattcatgacccagaaggccagagacgccctggataatctggctgtcctccatacggcggaggccggaggccgggcttacaaccacgccctgtccgagcttccggaaaccctggagacactcctgctgctcacccttctggccacagtgaccgggggaatttttctgttcctcatgagcggccgcgggatcggaaagatgacactgggcatgtgctgcattatcaccgcttctatccttctgtggtatgcccagattcaacctcactggatcgcggcctccattatcctcgaatttttcctgattgttctgctcatccccgagcccgaaaaacagagaacgcctcaggacaatcagcttacatacgtggtcatcgctattctgaccgtggtcgccgctaccatggccaacgagatgggctttctggagaagaccaagaaggacctcgggctgggaagcatcaccacacaagaatccgagtctaatattcttgatatcgacctgcggccggcgagcgcctggacgctctatgctgtggccaccacattcgttacccccatgctgcgccattccattgaaaactctagcgtgaatgtgtccctgacagctatcgccaaccaggctaccgtcctcatgggccttgggaaaggatggcctctgagcaagatggatattggcgttcccctgctcgccatcgggtgttactctcaggtgaatcctatcacgctgaccgcggcccttctgctcctggtggctcactacgccattatcggacccggcctgcaggctaaggccacaagagaggcccaaaaacgggcggctgccggcattatgaagaaccctaccgtcgacgggatcacagtgattgatctcgaaccgatcccctatgaccctaaatttgagaagcagcttggacaggttatgctgctgatcctctgcgtgacccaggtcctgatgatgcgcacgacatgggctctttgtgaggccctgaccctcgccacaggccccatttccaccctgtgggaagggaatcctggaagattctggaacaccacaatcgctgtgagcatggccaatatttttcggggctcttacctggcgggggccggactccttttctccatcatgaaaaacacgaccaatacacgcagaggcaccggcaacattggggagacactgggagaaaagtggaagtcccggctgaatgctctcggcaaatctgagtttcaaatctataagaaaagcgggatccaggaggtcgatagaaccctggccaaggaaggaattaaacgcggcgagacggaccatcacgctgtgtcccgggggtctgccaaacttagatggttcgttgaacgcaacatggtgacacccgagggaaaagtcgtggatctgggctgcggcagagggggatggagctactattgtggcgggctcaagaacgttagagaagtgaagggactgaccaaaggcgggccgggacatgaggagcctatccccatgtccacctacggctggaatctggtccgcctccagagcggcgtggacgtgtttttcacaccccctgaaaagtgcgataccgttctttgtgacattggggagtcctctcccaaccctacaatcgaagcgggacggacgctgagagtcctgaatctcgtggagaactggctgaataacaatacccaattctgcattaaagtgcttaacccgtatatgcccagcgtcatcgaaaagatggagacactgcagcgcaaatacggcggggccctcgttcggaatcctctgtccagaaactctacccacgagatgtactgggtgagcaatgctacaggaaacatcgtgtcctctgtcaatatgattagccgcatgctgatcaaccggtttaccatgaagcacaagaaagccacgtatgaacccgatgtggacctcggctccgggaccagaaatattggaatcgagagcgaaattcctaaccttgacatcattggcaagcgcatcgagaaaatcaagcaggaacatgagacatcttggcactacgatcaggaccatccctataaaacctgggcttaccacggctcctatgagacaaagcaaaccgggagcgcctcttccatggttaacggagtggtcagactgctgacaaagccgtgggatgtggttcctatggtgacccagatggctatgacggacacaacccccttcggccagcagcgggtctttaaagaaaaggtggatacccgcacacaagagcctaaagaagggacgaagaaactcatgaagattaccgccgagtggctgtggaaggagcttggcaagaagaaaacacccagaatgtgtacccgggaagagttcacaagaaaggtgcggagcaatgcggccctgggcgctatctttaccgacgaaaacaaatggaagtctgcccgcgaggctgtcgaagattccagattctgggagctcattgaccgggagcgcaatctgcacctggaagggaaatgcgagacatgtgtttacaacatgatgggaaagagagaaaagaaactcggcgagtttggcaaggccaaagggagccgggccatctggtatatgtggctgggagcgcgcttccttgaatttgaggctctgggcttcctcaatgaggatcattggttttccagacggaacagcctgtctggggtggaaggagagggccttcaccgcctggggtacattctcagagacgtgagcaagaaagaaggcggagccatgtacgccgatgacaccgctggctgggacacgcggatcaccctggaggatctgaagaatgaagagatggtcacaaaccatatgaagggggagcacaaaaagctcgccgaagctatcttcaaactgacctatcagaataaggtggttcgcgtgcagagacctacaccccggggaaccgtcatggacattatctcccgcagagatcagcggggctctgggcaagtgggaacgtacggccttaacacatttaccaatatggaggcccagctgattagacagatggaaggggagggcatcttcaaaagcattcaacatctcacagttaccgaggaaatcgcggtgcagaactggctggcccgcgtcggacgggagagactttcccgcatggctatctctggcgacgattgcgtggttaagccgctggacgatcggttcgccagcgctctcacggccctgaatgacatggggaaggtgagaaaagatattcagcagtgggaaccttcccgcggatggaacgactggacccaagtccccttttgctctcaccacttccatgagctggtgatgaaggatggccgggtcctcgtggttccctgtagaaatcaggacgaactgatcgggcgcgcgcggattagccagggagccggctggtcccttaaagagacagcttgcctgggaaagagctatgcccagatgtggaccctcatgtactttcacagacgcgatctgcggcttgctgccaacgctatctgttctgccgtgccttcccattgggtcccgacaagcagaaccacatggtctattcacgcgaaacacgagtggatgaccacggaagacatgctggccgtgtggaaccgggtgtggatccaagagaatccctggatggaagacaagacacctgttgagtcctgggaagaggtgccctatctcggcaagagagaggatcagtggtgcggaagcctgattggcctgacctcccgcgctacctgggccaaaaacatccagacagccatcaatcaggtccggtctctcattgggaacgaagagtacaccgactatatgcctagcatgaagagattccgcagagaagaggaagaggctggagtgctgtggtga

SEQ ID NO: 20291 - RNA, 9876 nt, synthetic construct
  misc_feature 1..9876: note = derived and/or modified CDS sequence (opt5) from DENV-2__GQ398302__SS-prME
  source 1..9876: mol_type = other RNA
accgccggcgtgatcattatgctgatccccacagctatggccttccacctcacgaccagaaacggggagcctcatatgattgtcagccggcaggaaaagggaaaatccctgctttttaagacagaggacggcgttaatatgtgcaccctgatggcgatcgatctcggggaactgtgtgaggacacaattacctacaaatgcccgcttctgcgccaaaacgaacccgaggatatcgactgttggtgcaattctacaagcacctgggtgacgtatggaacctgtacaaccacaggcgagcacagacgggaaaagcgctccgtggctctcgtccctcatgtggggatgggactggagaccagaacggaaacatggatgtctagcgagggcgcctggaaacacgttcagcggatcgagacctggattctgcgccatcccggcttcacaatcatggccgctattctcgcctacaccatcgggaccacacactttcagagagctctgattttcatccttctgacggccgtggcgccttccatgaccatgcggtgcattggaatctctaaccgcgattttgtcgaaggcgtgagcgggggatcctgggttgacatcgtgctcgagcacggcagctgtgtcacaaccatggccaagaataagcccacactggatttcgaacttattaaaaccgaggctaagcagcctgccacgctgagaaaatattgcatcgaagctaagctcacaaacaccaccacagagtctcggtgtccgacccaaggggagccctccctgaatgaagagcaggacaaacgctttgtgtgcaagcatagcatggtggatagaggatggggcaacggctgtgggctgttcggaaagggcgggattgtcacatgcgccatgtttacgtgcaaaaagaatatggaaggaaaagttgtgctccctgagaacctggaatacaccatcgtgattacaccccactctggcgaggagcatgcggtcgggaatgacaccggaaagcacggcaaagaaatcaagatcacacctcagtccagcattaccgaggccgaacttacgggctatgggaccgtgacaatggagtgttctccccggaccggactggatttcaacgaaatggttctcctgcagatggaggacaaagcttggcttgtgcaccgccaatggtttctggatctcccgctgccttggctgcccggcgccgacacacaggggtccaattggatccagaaggagaccctcgtcacgttcaagaaccctcatgctaaaaagcaggacgtggttgtgctgggaagccaagaaggcgccatgcacacagcccttaccggggctacagagattcagatgtcctctggcaatctgctctttaccggacatctgaaatgcagacttcggatggataagctgcagctcaaaggcatgagctactccatgtgtaccgggaagttcaagatcgtcaaagaaattgcggagacacaacacggaacgatcgtgatcagagtccagtatgagggcgacgggagcccctgcaagattcccttcgaaatcatggatctggagaaacgccatgtgctgggacggctcattaccgttaaccctatcgtggccgaaaaggactctccggtcaacattgaggctgaacccccttttggcgattcctacatcattatcggggtggagcccggccagctgaaacttaattggttcaagaagggaagctctatcggccagatgtttgagacaaccatgagaggggccaaacgcatggccattctgggagacacagcttgggatttcggcagcctcgggggagtttttacctccatcggcaaggccctgcaccaagtgttcggggcgatttacggcgctgccttttctggagtcagctggacgatgaaaatcctgattggcgtgatcatcacatggattgggatgaactcccggagcacctctctttccgtgagcctcgttctggtcggagtggtgaccctgtatctcggcgccatggtccaggctgactctgggtgtgtggtttcctggaagagcaaagaactgaagtgcggatccggcatcttcattacagataatgtgcacacctggacagagcagtacaagtttcagcctgaatctcccagcaaacttgcctccgctatccaaaaggcccatgaggaagggatttgtggcatcagatctgtcacgcgcctggagaacctcatgtggaaacagatcaccccggagctgaatcacattctgagcgaaaacgaggtgaagcttacaatcatgaccggagacattaaaggcatcatgcaggcggggaagcggtccctcagacctcagcccacagaactgaaatatagctggaagacctggggaaaggccaaaatgctgtctacggagtcccataatcaaaccttcctcattgatggccctgaaacagctgagtgccccaacaccaatcgcgcctggaacagcctggaggttgaagactacgggtttggagtgttcacaaccaatatctggcttaagctgcgggagaaacaggacgtcttttgtgattctaagctcatgtccgctgccatcaaagacaacagagcggtgcacgccgatatgggctattggattgaaagcgctctgaatgacacatggaagatggagaaggcctctttcatcgaggttaaaagctgccactggcctaagtcccataccctgtggagcaacggcgtgcttgaatctgagatgattatccccaaaaatttcgctgggccggtctcccagcacaactaccgccctggatatcatacgcagacagccggcccctggcacctcgggaagctggaaatggattttgacttctgtgagggaaccaccgtggtggtcacagaagattgcggcaaccgggggcccagcctgagaaccacgacagcctccggaaaactcattaccgagtggtgctgtcggtcttgcacactgcctccgcttcgctacagaggcgaggacggctgttggtacgggatggaaatccggcccctgaaggagaaggaagagaatctcgttaacagcctggtgaccgctggacatggccaaattgataatttttccctgggggtgcttggaatggcgctcttcctggaagagatgctgagaacacgcgtcggcaccaaacacgccatgctcctggtggctgtttcttttgtgacgcttatcaccgggaacatgagcttccgggacctgggaagagtcatggtgatggttggcgccacaatgaccgatgacatcggcatggggattacatatctcgccctgctggctgcctttaaggtgcgccctaccttcgcggctggacttctgctcagaaaactgacgtccaaggagctcatgatggccacaatcggcattgccctgctttctcagagcaccatccccgaaacaattctggagctcaccgatgctctggccctggggatgatggtccttaaaatcgtgcggaatatggaaaagtaccagctggcggttaccatcatggctatttcctgcgtgcctaacgccgtcatcctccaaaatgcctggaaggtgagctgtacaattctggctgccgtgtctgtctcccccctcctgcttacgagctctcagcagaaagctgactggatccctctggccctcaccattaagggactgaaccccacagcgatctttctgaccacactttcccgcaccagcaaaaagagatcttggccgctgaatgaggccatcatggctgttggcatggtgtccattctcgccagctccctgctcaaaaacgacatccctatgacggggcccctggtggctggaggccttctgacagtctgctatgtgctgaccggccggagcgccgatctcgaactggagcgcgccgctgacgttaagtgggaggatcaggcggaaatttctgggagctcccctatcctttctattaccatcagcgaggacggatccatgtctattaaaaatgaagaggaggaacaaacactgaccatcctcatcagaacaggcctgctcgtgattagcggggtcttccccgtgtccatcccgattacggccgctgcctggtacctgtgggaggttaagaagcagcgggccggagtgctttgggatgtcccttctccccctcccgtgggcaaagctgaactggaggacggggcctatcgcatcaagcagagaggaattctgggctacagccagatcggcgcgggggtctataaagaaggaacctttcacacaatgtggcatgtgacccggggcgctgttctcatgcaccgcgggaagagaatcgagccctcctgggccgatgtgaaaaaggacctgattagctacggaggcgggtggaagcttgagggagaatggaaagagggcgaagaggtccaagtgctggccctcgaacctggcaagaacccgcgggctgttcagacaaaacccgggctgttcaagaccaatacgggaaccatcggcgccgtgtctctcgatttttcccctgggacaagcggatctcccattgtcgacagaaaaggcaaggtggtggggctgtacggaaacggcgttgtcacccgctccggcgcgtatgtgagcgctatcgcccagacagagaagtccattgaggataatcctgaaatcgaggacgatatcttccggaaaaagagacttaccattatggacctgcatcccggggccggaaaaacaaagcgctacctgcctgctatcgtgcgggaagccattaaaagaggcctccgcacgctgatccttgctccgacccgggtcgtggccgcggagatggaagaggccctgagagggctccccattcgctatcagacacctgctatccgggccgagcacaccggaagagaaattgttgacctgatgtgtcatgctaccttcacaatgcggctcctgtctcccgtgcgcgtccctaactacaaccttatcatcatggatgaggcccactttacggaccccgccagcattgctgcgagaggctatatctccacccgggtggaaatgggggaggccgctggcattttcatgacagccaccccgcctggaagccgcgatccctttccccaatctaatgcccctatcatggacgaggaaagagagattcccgaacggtcctggaacagcggccacgagtgggttacagatttcaaggggaagaccgtgtggtttgtcccttctatcaaagctggaaatgacatcgccgcgtgcctgagaaagaacggcaaaaaggtgattcagctgagccgcaaaacgttcgattccgaatacgttaagacacgggctaatgactgggattttgtggtcaccaccgacatctctgagatgggggccaacttcaaggccgagagagtgattgatccgcgccggtgtatgaaacccgtgatcctcacagacggagaagagagagtcattctggctggccctatgcccgttacccatagctccgccgcgcagcgccgggggagaatcggccgcaatcctaagaacgaaaatgaccaatatatctacatgggagagccccttgaaaacgatgaggactgcgcccactggaaagaggctaagatgctgctcgataatattaacacaccggaaggcatcattccttctatgtttgagcccgaaagagagaaagtggacgccatcgatggggaataccggctgcgcggagaggctagaaagaccttcgtggacctgatgcggcgcggcgatctccctgtctggcttgcctatagagtggctgccgaggggattaattacgcggaccggagatggtgttttgatggaatcaaaaacaatcagattctggaagagaacgttgaagtggagatctggacgaaggagggcgaacgcaagaaactgaagccccggtggctcgacgccagaatctatagcgatcctctggctcttaaagagttcaaggaattcgccgctgggcgcaaatccctgacactcaacctgattaccgagatgggccggctgcccacatttatgacccagaaggccagagacgccctcgataatcttgctgtcctgcatacggcggaagccggaggccgggcttacaaccacgccctgagcgagctcccggagaccctggaaacacttctgctcctgaccctgctcgccacagtgaccgggggaatcttcctttttctgatgtctggcaaggggattggaaaaatgacactgggcatgtgctgcatcattaccgcttccatcctcctgtggtatgcccagatccaacctcactggattgcggccagcatcattcttgagttctttctgatcgttctcctgattcccgaacccgagaagcagcgcacgcctcaggacaatcagctgacatacgtggtcatcgctatcctcaccgtggtcgccgctaccatggccaacgaaatgggcttccttgagaaaacaaagaaagacctggggctgggatccattgcgacccaagagtctgaaagcaatatcctcgatattgacctgagaccggcctccgcttggacactttatgccgtggctacgacctttgttacacccatgctgcggcattctatcgagaacagctccgtgaatgtgagcctcaccgccattgctaaccaggccacagtcctgatgggcctggggaagggatggcctctctctaagatggatatcggcgttccccttctggcgattgggtgttactcccaggtgaatcctatcaccctgacggccgctctcctgcttctggtggcccactacgctatcattggacccggcctccaggccaaagccacccgcgaagcgcaaaagagagctgccgctggcatcatgaaaaaccctacagtcgacgggattaccgtgatcgatctggagccgattccctatgaccctaagttcgaaaaacagctgggacaggttatgctccttatcctgtgcgtgacacaggtcctgatgatgcggaccacgtgggccctctgtgaggccctgacacttgctaccggccccatcagcacactgtgggaggggaatcctggacgcttttggaacaccaccattgccgtgtctatggcgaatatcttcagaggctcctacctcgccggggctggactgctgtttagcattatgaagaacacaacgaatacccggcgcggcacaggcaacatcggggaaaccctcggagagaagtggaaatctagacttaatgccctgggcaagagcgaattccaaatttataaaaagtccgggatccaggaggtcgatcggacactggctaaagagggaatcaagagaggcgaaaccgaccatcacgccgtgtctcgcgggagcgcgaaactccggtggtttgttgagagaaacatggtgacgcccgaaggaaaggtcgtggatctgggctgcggccgcgggggatggtcctactattgtggcgggcttaagaacgttcgggaggtgaaaggactgacaaagggcgggccgggacatgaagagcctattcccatgagcacctacggctggaatctcgtcagactgcagtccggcgtggacgtgttcttcaccccccctgagaaatgcgatacactgctctgtgacatcggggaatctagccccaaccctaccattgaggccggacgcacacttcgggttctgaatctggtcgaaaactggctcaataacaatacgcaattttgcatcaaggtgctgaacccgtatatgccctccgtgattgagaaaatggaaacccttcagagaaagtacggcggggctctggtccgcaatcctctctctcggaacagcacacacgagatgtactgggtttccaatgccaccggaaacatcgtgtctagcgtgaatatgatctccagaatgctgattaaccgcttcacaatgaagcacaaaaaggctacctatgagcccgatgtcgacctgggcagcgggacgcggaatatcggaattgaatctgagatccctaacctcgacattatcggcaaaagaattgaaaagatcaaacaggagcatgaaacctcctggcactacgatcaggaccatccctataagacatgggcctaccacggcagctatgagaccaagcaaacagggtctgcttccagcatggtgaacggagttgtgcgccttctgaccaaaccgtgggatgtcgtgcctatggttacacagatggccatgaccgacacgacaccctttggccagcagagagtgttcaaggagaaagtcgatacccggacccaagaacctaaggaggggacaaaaaagctgatgaagatcacggcggaatggctctggaaagagctgggaaagaaaaagaccccccgcatgtgtacaagagaggaatttacccggaaagtgagatctaatgccgctcttggcgccattttcacagacgagaacaagtggaaatccgctcgggaagccgtggaggatagccgcttttgggaactgatcgacagagagcggaatctccacctggaggggaagtgcgaaacctgtgtctacaacatgatgggaaagcgcgagaaaaagctgggcgaattcggcaaagccaaggggtccagagcgatttggtatatgtggctcggagctcggtttctggagttcgaagcccttggctttctgaatgaggatcattggttcagccgcgggaactctctcagcggagttgagggcgaagggctgcacagacttggctacatcctgcgggacgtgtccaaaaaggagggaggcgccatgtacgctgatgacacagccgggtgggacacccgcattacgctcgaagatctgaagaatgaggaaatggtgaccaaccatatgaaaggagagcacaagaaactggctgaggccatctttaagctcacatatcagaataaagtcgtgagagttcagcggcctaccccccgcggcacagtgatggacatcatttctagacgggatcagcgcgggagcggacaagtcggcacctacgggctgaacacgttcacaaatatggaagcgcagcttatcagacagatggagggcgaaggaattttcaagtccatccaacatctgaccgtgacagaggagattgccgttcagaactggctcgctcgggtgggcagagaacgcctgtctcggatggccatcagcggggacgattgcgtcgtgaagccgcttgacgatagatttgcttccgccctgaccgcgctcaatgacatgggaaaagttcgcaaggatatccagcagtgggagccttctcggggctggaacgactggacgcaagtgcccttctgcagccaccactttcatgaactggtcatgaaagatgggagagtgctggtcgtgccctgtcgcaatcaggacgagctcattggacgggccagaatctcccagggcgctgggtggagcctgaaggaaaccgcctgccttggcaaatcttatgctcagatgtggacactgatgtacttccaccgccgggatctcagactggccgctaacgccatttgttccgcggttcctagccattgggtgccgacctctcgcacaacctggtccatccacgccaagcacgagtggatgacaaccgaggacatgcttgctgtctggaaccgggtgtggattcaagaaaatccctggatggaggacaagacgcctgtggaaagctgggaggaagttccctatctgggaaaaagagaggatcagtggtgcggctccctcatcgggctgacatctcgggccacctgggccaagaacattcagaccgctatcaatcaggtgagaagcctgatcggaaacgaggaatacacagactatatgccttccatgaaacgctttcggagagaggaagaggaagccggcgtcctctggtga

SEQ ID NO: 20292 - RNA, 9876 nt, synthetic construct
  misc_feature 1..9876: note = derived and/or modified CDS sequence (opt5) from DENV-2__GQ398272__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacaaacactgaccatcctcatcagaacagggctgctcgtgatttctggagttttccccgtgagcatcccgattacggctgcggcctggtacctgtgggaggtcaagaagcagcgggctggcgtgctttgggatgtcccttctccccctcccgtggggaaagccgaactggaggacggagcctatcgcatcaagcagagaggcatttttggctacagccagatcggggctggagtttataaagaaggcaccttccacacaatgtggcatgtgaccagaggggccgtcctgatgcaccgcggaaagagaatcgagcccagctgggcggatgtgaaaaaggacctcatttcctacggcgggggatggaagctggagggcgaatggaaagagggcgaagaggttcaagtgcttgctctggaacctgggaagaatccgcgggccgtccagacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcatcccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcacaccggcagagaaattgtcgacctcatgtgtcatgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccaaagcaacgctcctatcatggacgaggaaagagagattcccgaacggtcttggaactccgggcacgagtgggtcacagattttaagggaaagaccgtgtggttcgttcctagcatcaaagccggcaacgacatcgccgcttgccttagaaagaatgggaaaaaggtgattcagctgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccattctagcgccgctcagcggagaggccgcatcggaagaaaccctaaaaatgaaaacgaccaatatatctacatgggcgagcccctggaaaatgatgaggactgcgcccactggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccagattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcatacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccaacctcactggattgccgcttccatcattctggagtttttccttatcgtgctgctcattcccgaacccgagaaacagagaacgcctcaggacaaccagctgacatacgtcgtgatcgccatcctgaccgttgtggcggccaccatggctaatgaaatggggtttctcgagaagaccaagaaggaccttggactgggcagcattatcacccaagagtccgaatctaacattctggatatcgacctccggccggccagcgcttggacactgtatgccgtggcgacgaccttcgtcacacccatgcttcgccattccattgaaaattctagcgttaacgtgtccctgaccgccatcgctaatcaggccacagtgctcatggggctgggaagaggctggcctctgagcaaaatggatattggggtccccctccttgctatcggatgttactctcaggtgaaccctatcaccctgattgccgctctgctcctgcttgttgcccactacgcgatcattggccccggcctgcaggccaaggctacgcgggaagcccaaaagcgcgctgccgccgggatcatgaaaaatcctaccgtggacggaattacagtcatcgatctcgagccgatcccctatgaccctaagtttgaaaaacagctgggccaggtgatgctgctcgtcctttgcgtgacccaggttctgatgatgagaacaacctgggcgctgtgtgaggctctcacgctggccacagggcccatttccaccctttgggagggaaaccctggccggttctggaatacaaccatcgctgtgagcatggccaacatttttcgcgggtcttacctggccggagctggcctcctgttctccatcatgaagaataccacaaacacgagacggggcaccgggaatattggagaaacactgggcgagaaatggaaaagcagactcaacgcccttgggaagtctgaatttcaaatctataaaaagagcggaatccaggaggtcgatcgcaccctggcgaaagagggcattaagagaggggaaacagaccatcacgccgtgtccagaggatctgctaaactgcgctggttcgttgagcggaacatggtgacccccgaaggcaaggtcgtggatctcggctgcgggagaggaggctggagctactattgtgggggactgaaaaatgtgcgcgaggttaagggccttacgaaagggggaccgggccatgaggagcctatccccatgtccacatacggctggaacctggtccggctccagagcggggtggacgtgttctttacaccccctgagaaatgcgataccctgctgtgtgacattggagaatcctctcccaatcctacaatcgaggccggcagaaccctccgcgtccttaacctggttgaaaattggctgaacaataacacacaattctgcattaaggtgctcaatccgtatatgcccagcgtgatcgagaaaatggaaacgctgcagcggaagtacgggggagctcttgtcagaaaccctctgtcccgcaattctacccacgagatgtactgggtgagcaacgccacaggcaatatcgtttcctctgtgaacatgattagccggatgctcatcaatagatttaccatgaaacacaagaaggcgacatatgagcccgatgtcgacctggggtccggaacccgcaacattggcatcgaaaacgagattcctaatctggacatcattggcaaaagaatcgaaaagatcaaacaggagcatgaaacgagctggcactacgatcaggaccatccctataagacctgggcctaccacgggtcttatgagacaaaacaaaccggatccgctagctctatggtgaacggcgttgtgcggctccttacaaagccgtgggatgtcgtgcctatggtgacccagatggccatgacagacaccacgcccttcgggcagcagcgcgtctttaaggagaaagttgatacaagaacccaagaacctaaggagggaaccaaaaagctgatgcggattacagctgaatggctgtggaaagagctcggcaagaagaaaacgcccagaatgtgtacccgggaggagttcacacgcaaggtgagatccaatgccgctctgggggccatctttaccgacgagaacaaatggaaaagcgcgcgggaagccgtggaggattctcgcttctgggaacttgtcgacagagagcggaatctgcacctcgagggaaaatgcgaaacatgtgtgtacaacatgatgggcaagcgcgagaaaaagctgggcgaatttgggaaggctaaaggatccagagccatttggtatatgtggctgggcgctcggttcctcgagtttgaagccctggggttccttaatgaggatcattggtttagccgcggaaactccctgagcggcgttgagggggaaggcctccacaagctgggatacatccttagagacgtgtctaaaaaggagggcggggccatgtacgcggatgacaccgctggatgggacacacggattaccctggaagatctcaaaaatgaggaaatggtcacgaaccatatgaagggcgagcacaagaaactggccgaggccatcttcaagctgacctatcagaataaagtggttcgcgtgcagagacctacaccccgggggaccgtcatggacatcattagccgcaaggatcagagaggatccggccaagtggggacatacggcctcaacaccttcacgaatatggaagctcagctgatccggcagatggagggagaaggcatttttaaatctatccaacatcttacagttaccgaggagattgccgtgcagaactggctggctagagtcgggcgcgaacggctcagcagaatggccatctccggagacgattgcgtggtcaagccgctggacgatcgcttcgcgtctgcccttacagctctgaatgacatgggcaaggtgcggaaagatatccagcagtgggagcctagcagagggtggaacgactggacccaagttcccttttgctcccaccacttccatgaactcgtgatgaaggatggacgcgtcctggtggtgccctgtcggaaccaggacgagctgattggcagagcccgcatctctcagggggctggctggagcctcaaagaaacggcctgcctgggaaagtcctatgcgcagatgtggacccttatgtactttcaccggagagatctgcgcctcgccgctaatgccatttgtagcgctgttccttctcattgggtgccgacatcccggaccacatggagcatccacgccaaacacgagtggatgaccacagaggacatgctggctgtctggaacagagtgtggattcaagaaaatccctggatggaggacaagacccctgttgaatcttgggaggaagtgccctatcttggcaagcgggaggatcagtggtgcgggtccctgatcggactcacgagcagagccacatgggcgaaaaacattcagaccgccatcaatcaggtccgctccctgatcggcaacgaggaatacaccgactatatgccttctatgaagcggttcagaaaagaggaagaggaagctggggtgctgtggtga

SEQ ID NO: 20293 - RNA, 9876 nt, synthetic construct
  misc_feature 1..9876: note = derived and/or modified CDS sequence (opt5) from DENV-2__GQ398292__SS-prME
  source 1..9876: mol_type = other RNA
accgccggagtgttcatcatgctgattcccacagctatggcctttcacctcacgacccggaacggggagcctcatatgatcgtcggacggcaggaaaagggcaagtccctgcttttcaagacagaggacggggttaatatgtgcaccctgatggcgattgatctcggagaactgtgtgaggacacaatcacctacaagtgcccgcttctgcgccaaaacgaacccgaggatattgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggatcatgcgccatcccgggtttacaattatggccgctatcctggcctacaccattggaaccacacacttccagagagctctcatctttattctgcttacggccgtggcgcctagcatgaccatgcggtgcatcggcatttccaaccgcgatttcgtcgaaggggtgtctggaggcagctgggttgacatcgtgctggagcacgggtcctgtgtcacaaccatggccaagaataagcccacactcgattttgaactgatcaaaaccgaggctaagcagcctgccacgcttagaaaatattgcattgaagctaagctgacaaacaccaccacagagagccggtgtccgacccaaggagagccctctctcaatgaagaacaggacaaacgcttcgtgtgcaagcattccatggtggatagaggctggggcaacgggtgtggactgtttggcaaagggggaatcgtcacatgcgccatgttcacgtgcaaaaagaatatggaaggcaaagttgtgctgcctgagaacctcgaatacaccattgtgatcacaccccacagcggggaggagcatgcggtcggaaatgacaccggcaagcacggcaaagaaattaagatcacacctcagtcttccatcaccgaggccgaactgacggggtatggaaccgtgacaatggagtgtagcccccggaccggccttgattttaacgaaatggttctgctccagatggaggacaaggcttggctggtgcaccgccaatggttccttgatctgccgctcccttggctgcccggggccgacacacagggatctaattggattcagaaggagaccctggtcacgtttaagaaccctcatgctaaaaagcaggacgtggttgtgctcggctcccaagaaggggccatgcacacagccctgaccggcgctacagagatccagatgagctccggaaatcttctgttcaccggccatctcaaatgcagactgcggatggataaacttcagctgaaagggatgtcttacagcatgtgtaccggaaagttcaagattgtcaaagaaatcgcggagacacaacacggcacgattgtgatcagagtccagtatgagggggacggatccccctgcaagatcccctttgaaattatggatctcgagaaacgccatgtgctgggccggctgatcaccgttaaccctattgtggccgaaaaggacagcccggtcaacatcgaggctgaaccccctttcggggattcttacattatcattggcgtggagcccggacagctcaaactgaattggtttaagaagggctccagcatcgggcagatgttcgagacaaccatgagaggagccaaacgcatggccatccttggcgacacagcttgggattttgggtctctgggaggcgttttcaccagcattgggaaggccctccaccaagtgtttggcgcgatctacggagctgccttctccggcgtctcttggacgatgaaaattctgatcggggtgattatcacatggatcggaatgaacagccggtccaccagcctgtctgtgtcccttgttctcgtcggcgtggtgaccctgtatctgggggccatggtccaggctgacagcggatgtgtggtttcttggaagtccaaagaactcaagtgcggcagcgggatttttatcacagataatgtgcacacctggacagagcagtacaagttccagcctgaatccccctctaaactggccagcgctattcaaaaggcccatgaggaaggcatctgtggaattagatccgtcacgcgccttgagaacctgatgtggaaacagatcaccccggagctcaatcacatcctgtctgaaaacgaggtgaagctgacaattatgaccggcgacatcaaagggattatgcaggcgggaaagcggagccttagacctcagcccacagaactcaaatattcctggaagacctggggcaaggccaaaatgctgagcacggagtctcataatcaaacctttctgatcgatgggcctgaaacagctgagtgccccaacaccaatcgcgcctggaactccctcgaggttgaagactacggattcggcgtgtttacaaccaatatttggctgaaacttcgggagaaacaggacgtcttctgtgatagcaagctgatgtctgctgccatcaaagacaacagagcggtgcacgccgatatgggctattggatcgaatccgctctcaatgacacatggaagatggagaaggccagcttcattgaggttaaatcttgccactggcctaagagccataccctgtggtccaacggggtgctggaaagcgagatgatcattcccaaaaattttgctggaccggtctctcagcacaactaccgccctggctatcatacgcagacagccgggccctggcaccttggaaagctcgaaatggatttcgacttttgtgagggcaccaccgtggtggtcacagaagattgcgggaaccggggaccctccctgagaaccacgacagccagcggcaaactgatcaccgagtggtgctgtcggtcctgcacactccctccgctgcgctacagaggcgaggacgggtgttggtacggaatggaaattcggccccttaaggagaaggaagagaatctggttaactctctcgtgaccgctggccatgggcaaatcgataatttcagcctgggagtgctgggcatggcgctttttctcgaagagatgctgagaacacgcgtcgggaccaaacacgccatgctgctcgtggctgtttccttcgtgacgctgattaccggaaacatgtcttttcgggaccttggcagagtcatggtgatggttggcgccacaatgaccgatgacatcgggatgggaatcacatatctggccctcctggctgccttcaaggtgcgccctacctttgcggctggcctgcttctgagaaaactcacgagcaaggagctgatgatggccacaattgggatcgccctcctgtcccagtctaccattcccgaaacaatccttgagctgaccgatgctctcgccctgggaatgatggtcctgaaaattgtgcggaatatggaaaagtaccagcttgcggttaccatcatggctatcagctgcgtgcctaacgccgtcattctgcaaaatgcctggaaggtgtcctgtacaatcctcgctgccgtgagcgtctctcccctgctcctgacgtccagccagcagaaagctgactggattcctcttgccctgaccatcaagggcctcaaccccacagcgattttcctgaccacactgtctcgcacctccaaaaagagaagctggccgcttaatgaggccatcatggctgttgggatggtgtctatcctggcctccagcctcctgaaaaacgacattcctatgacgggacccctcgtggctggcggcctgcttacagtctgctatgtgctgaccgggcggtccgccgatctggaactcgagcgcgccgctgacgttaagtgggaggatcaggcggaaatcagcggatctagccctattctgtccatcaccatttctgaggacggcagcatgtccatcaaaaatgaagaggaggaacaaacacttaccattctgatcagaacagggctcctggtgatctctggagtctttcccgtgagcattccgatcacggccgctgcctggtacctctgggaggttaagaagcagcgggccggcgtgctgtgggatgtcccttctccccctcccgtggggaaagctgaacttgaggacggagcctatcgcattaagcagagaggcatcctgggctacagccagattggggcgggagtctataaagaaggcaccttccacacaatgtggcatgtgaccagaggggctgttctgatgcaccgcggaaagagaatcgagcccagctgggccgatgtgaaaaaggacctcatctcctacggcgggggatggaagctggagggcgaatggaaagagggcgaagaggtccaagtgcttgccctggaacctgggaagaacccgcgggctgttcagacaaaacccggactctttaagaccaatacgggcaccattggggccgtgagcctggatttctctcctggaacatccggcagccccatcgtcgacagaaaagggaaggtggtgggactctacggcaacggcgttgtcacccgctctggggcgtatgtgtccgctattgcccagacagaaaagagcatcgaggataatcctgaaattgaggacgatatcttccggaaaaagagactgaccatcatggaccttcatcccggagccggcaaaacaaagcgctacctgcctgctattgtgcgggaagccatcaaaagagggctgcgcacgctcattctggctccgacccgggtcgtggccgcggagatggaagaggcccttagaggactgcccatccgctatcagacccctgctattcgggccgagcacaccggcagagaaatcgttgacctcatgtgtcatgctacctttacaatgcggctgctctcccccgtgcgcgtccctaactacaacctgattatcatggatgaggcccacttcacggaccccgcctctatcgctgcgagagggtatattagcacccgggtggaaatgggcgaggccgctggaatctttatgacagccaccccgcctggctcccgcgatcccttcccccaaagcaatgcccctattatggacgaggaaagagagatccccgaacggtcttggaactccgggcacgagtgggttacagattttaagggaaagaccgtgtggttcgtccctagcattaaagctggcaatgacatcgccgcgtgccttagaaagaacgggaaaaaggtgatccagctgtctcgcaaaacgtttgatagcgaatacgttaagacacgggctaatgactgggatttcgtggtcaccaccgacatttccgagatgggagccaactttaaggccgagagagtgatcgatccgcgccggtgtatgaaacccgtgattctgacagacggcgaagagagagtcatcctcgctgggcctatgcccgttacccattctagcgccgcgcagcgccggggcagaattggacgcaatcctaagaacgaaaatgaccaatatatctacatgggcgagcccctggaaaacgatgaggactgcgcccactggaaagaggctaagatgcttctggataatatcaacacaccggaagggattatcccttccatgttcgagcccgaaagagagaaagtggacgccattgatggagaataccggctccgcggcgaggctagaaagacctttgtggacctgatgcggcgcggggatctgcctgtctggctcgcctatagagtggctgccgagggaatcaattacgcggaccggagatggtgtttcgatggcattaaaaacaatcagatccttgaagagaacgttgaagtggagatttggacgaaggagggggaacgcaagaaactgaagccccggtggctggacgccagaatctattctgatcctctcgctctgaaagagttcaaggaatttgccgctggccgcaaaagccttacactgaacctcatcaccgagatgggacggctgcccacattcatgacccagaaggccagagacgccctggataatctcgctgtccttcatacggcggaagccggcgggcgggcttacaaccacgccctgtccgagctgccggagaccctcgaaacactgcttctgctcaccctgctggccacagtgaccggaggcatttttctcttccttatgagcgggaagggaatcggcaaaatgacactgggcatgtgctgcattatcaccgcttctattctgctctggtatgcccagatccaacctcactggatcgcggcctccattatcctggagtttttccttattgttctgctcatccccgaacccgagaagcagcgcacgcctcaggacaatcagctgacatacgtggtcattgctatcctgaccgtggtcgccgctaccatggccaacgaaatggggtttctcgagaaaacaaagaaagaccttggactgggcagcatcgcgacccaagagtccgaatctaatattctggatatcgacctcagaccggccagcgcttggacactgtatgccgtggctacgaccttcgttacacccatgcttcggcattccattgagaactctagcgtgaatgtgtccctgaccgccatcgctaaccaggccacagtcctcatggggctgggaaagggctggcctctgagcaagatggatattggggttcccctccttgcgatcggatgttactctcaggtgaatcctattaccctgacggccgctctgctcctgcttgtggcccactacgctatcatcggccccggcctgcaggccaaagccacccgcgaagcgcaaaagagagctgccgctgggattatgaaaaaccctacagtcgacggaatcaccgtgattgatctcgagccgatcccctatgaccctaagtttgaaaaacagctgggccaggttatgctgctcattctttgcgtgacacaggtcctgatgatgcggaccacgtgggccctgtgtgaggccctcacactggctaccgggcccatctccacactttgggagggaaatcctggccgcttctggaacaccaccatcgccgtgagcatggcgaatatttttagagggtcttacctggccggagctggcctcctgttctccatcatgaagaacacaacgaatacccggcgcggcacagggaacattggagaaaccctgggcgagaagtggaaaagcagactcaatgcccttgggaagtctgaatttcaaatctataaaaagagcggcattcaggaggtcgatcggacactggctaaagagggcatcaagagaggggaaaccgaccatcacgccgtgtcccgcggatctgcgaaactgcggtggttcgttgagagaaacatggtgacgcccgaaggcaaggtcgtggatctcggctgcgggcgcggaggctggagctactattgtgggggactgaagaacgttcgggaggtgaaaggccttacaaaagggggaccgggccatgaggagcctatccccatgtccacctacggctggaatctggtcagactccagagcggggtggacgtgttctttacaccccctgagaaatgcgataccctgctgtgtgacattggagaatcctctcccaaccctaccatcgaggccggccgcacactccgggttcttaatctggtcgaaaactggctgaataacaatacgcaattctgcattaaggtgctcaacccgtatatgcccagcgtgatcgagaaaatggaaaccctgcagagaaagtacgggggagctcttgtccgcaatcctctgtcccggaactctacacacgagatgtactgggttagcaatgccaccggcaacattgtgtcctctgtgaatatgatcagcagaatgctcatcaaccgctttacaatgaagcacaaaaaggctacctatgagcccgatgtcgacctggggtccggaacgcggaatattggcatcgaaagcgagattcctaacctggacatcattggcaaaagaatcgaaaagattaaacaggagcatgaaacctcttggcactacgatcaggaccatccctataagacatgggcctaccacgggtcctatgagaccaagcaaacaggaagcgcttcttccatggtgaacggcgttgtgcgcctccttaccaaaccgtgggatgtcgtgcctatggttacacagatggccatgaccgacacgacacccttcgggcagcagagagtgtttaaggagaaagtcgatacccggacccaagaacctaaggagggaaccaagaagctgatgaagatcacggcggaatggctgtggaaagagctcggcaagaaaaagacaccccgcatgtgtacaagagaggagttcacccggaaagtgagaagcaatgccgctctgggggccatctttacagacgagaacaagtggaaatctgctcgggaagccgtggaggattcccgcttctgggaacttattgacagagagcggaatctgcacctcgagggaaagtgcgaaacctgtgtctacaacatgatgggcaagcgcgagaaaaagctgggcgaatttgggaaagccaagggaagcagagcgatctggtatatgtggctgggcgctcggttcctcgagtttgaagccctggggttccttaatgaggatcattggttttcccgcggaaacagcctgtctggcgttgagggggaaggcctccacagactgggatacattcttcgggacgtgagcaaaaaggagggcggggccatgtacgctgatgacacagccggatgggacacccgcatcacgctggaagatctcaagaatgaggaaatggtgaccaaccatatgaaaggcgagcacaagaaactggctgaggccattttcaagctgacatatcagaataaagtcgtgagagttcagcggcctacaccccgcgggacagtgatggacatcatctccagacgggatcagcgcggatctggccaagtcgggacctacggcctcaacacgttcacaaatatggaagcgcagctgattagacagatggagggagaaggcatctttaagagcattcaacatcttaccgtgacagaggagatcgccgttcagaactggctggctcgggtggggagagaacgcctctcccggatggccatttctggagacgattgcgtcgtgaagccgctggacgatagattcgctagcgcccttaccgcgctgaatgacatgggcaaagttcgcaaggatatccagcagtgggagccttcccgggggtggaacgactggacgcaagtgcccttttgctctcaccacttccatgaactcgtcatgaaagatggaagagtgctggtcgtgccctgtcgcaatcaggacgagctgatcggccgggccagaattagccagggggctggctggtccctcaaggaaaccgcctgcctgggaaaaagctatgctcagatgtggacacttatgtactttcaccgccgggatctgagactcgccgctaacgccatctgttctgcggttccttcccattgggtgccgaccagccgcacaacctggtctattcacgccaagcacgagtggatgacaaccgaggacatgctggctgtctggaaccgggtgtggatccaagaaaatccctggatggaggacaagacgcctgtggaatcctgggaggaagttccctatcttggcaaaagagaggatcagtggtgcgggagcctgattggactcacatcccgggccacctgggccaagaacatccagaccgctattaatcaggtgagatctctgatcggcaacgaggaatacacagactatatgcctagcatgaaacgcttccggagagaggaagaggaagccggggtcctgtggtga

SEQ ID NO: 20294 - RNA, 9876 nt, synthetic construct
  misc_feature 1..9876: note = derived and/or modified CDS sequence (opt5) from DENV-2__GQ398267__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaaagcctcctgtttaagacggagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggttagcatcctcgcgtcttccctgctcaaaaacgatattcctatgacagggcccctggtggccggaggccttctgaccgtctgctacgtgctgaccggccgcagcgctgacctcgagctggaaagagccgctgacgtccggtgggaggagcaggccgaaatctccgggagctctcctatccttagcattacaatctccgaggatggatctatgagcattaagaatgaagaggaggaacagaccctgacaatcctcattcgcacgggcctgctcgtgatctccgggctgttccccgtttctattccgatcaccgccgctgcgtggtatctttgggaggtgaaaaagcaaagagccggagtcctgtgggacgtgccttctccccctcccgttggcaaagctgaactggaggatggggcctaccggatcaagcagaagggcattctcggctattcccagatcggcgccggggtgtacaaagaaggaacatttcacaccatgtggcatgtcacacgcggcgctgtgctgatgcacaaggggaaaagaattgagccctcctgggccgacgtgaagaaagatcttatcagctacggaggcgggtggaagctggagggagaatggaaggagggcgaagaggttcaggtcctcgcgctggaacctggcaaaaacccgcgggctgtgcaaaccaagcccggactcttcaaaacgaacaccggaacaattggcgccgtgtccctggactttagccctgggacctctggatcccccatcgtcgataagaaaggcaaggtggttgggctttatggaaatggcgtggtcacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggacctcatgtgtcatgcgacgttcaccatgagactgcttagccccatccgggttcctaattataacctgattatcatggatgaggcccactttacagaccccgcttccattgccgctcgcggctacatctctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggtcacggacttcaaggggaagacagtgtggtttgtgccttccattaaagccggaaatgatatcgctgcctgcctgcggaagaacggcaaaaaggtcattcaactcagcagaaaaaccttcgactctgaatatatcaagacccgcacaaatgattgggactttgttgtgaccacagatatcagcgagatgggggccaacttcaaggctgagcgggtgattgacccgagacgctgtatgaaacccgtcatcctgaccgatggagaagaacgggtgattcttgccggccctatgcccgttacgcattcctctgcggctcagagacgcgggcgggtgggcagaaatcctaagaacgaaaatgaccagtacatctacatgggagagcccctggaaaacgatgaggactgcgcccactggaaagaggccaagatgctcctggacaatattaacacaccggaaggcatcatccctagcatgtttgagcccgaacgcgagaaagtcgatgctattgacggggaatatagactgcggggagaggcccgcaagaccttcgtggatctcatgagacggggcgaccttcctgtttggctggcgtaccgcgtggccgctgaggggatcaactatgccgatagacggtggtgttttgacggagtcaaaaataaccaaattctggaagagaatgtggaagtcgagatctggacaaaggagggcgaaagaaagaaactcaagccccgctggctggatgctcggatttactccgaccctcttgccctgaaagagttcaaggagttcgctgccgggagaaaatctctcaccctgaacctgatcacggagatgggccgcctccccacctttatgacacagaaggcgaagaatgcccttgataacctggctgtgctgcataccgccgaagctggaggccgggcctataatcacgccctcagcgagctgccggagacacttgaaaccctgctcctgctgacactccttgctaccgttacaggcgggattttcctgtttctgatgtccgggaaagggatcggaaagatgacactcggcatgtgctgcatcattaccgcgagcatcctgctttggtacgcccagattcagcctcactggatcgctgcctctattatcctggagttctttctcatcgtgctgctgattcccgaacccgagaaacaaagaacccctcaggacaaccagctcacatatgtggtcatcgccattcttaccgttgtggctgccacaatggcgaatgaaatgggcttcctggagaagacgaaaaaggattttgggctgggatccatcaccacacagcaaccggagagcaacattctcgacatcgatctgcggcccgcctccgcttggaccctttacgccgtggctacaaccttcatcacgcctatgctgcgccattctattgaaaatagctccgtcaacgtgtctctcaccgccatcgcgaatcaggccacagttctgatgggcctggggaagggatggcccctcagcaaaatggacattggcgtgcctcttctggctatcgggtgttactcccaggtcaaccccattaccctgatcgccgctctcctgcttctggtggcccactatgctattatcggacctggcctccaggccaaggcgacaagagaggcccaaaaacgggctgccgctggcatcatgaagaatccgaccgtcgacgggatgacggtgattgatctggaccccatcccttacgatcccaaatttgaaaagcagctgggacaggttatgctccttgtgctgtgcgtcacacaggtgctgatgatgcgcaccacatgggccctctgtgaggccctgacccttgcgaccggccctattagcacactgtgggaagggaaccccggaagattctggaatacgaccatcgctgtttctatggccaacatttttcggggctcctatctcgctggggccggactgctgttcagcatcatgaagaacacagccaatacccgcagaggcacaggcaacatcggggagaccctcggagagaaatggaagaatcggcttaacgctctgggcaaatctgaatttcaaatttacaagaaatccgggatccaggaggtggaccgcacgctggccaaggaaggaattaaaagaggcgagacagatcatcacgcggtcagccgggggtctgccaagctcagatggttcgtggagcgcaatctggtgaccccggaaggaaaggttgtcgaccttggctgcggcagagggggatggagctattactgtggcgggctgaaaaacgtgaaggaggtgaaaggactcaccaagggcgggcctggacatgaagaacccatccccatgtccacatatggctggaatctggtcagactgcagtctggcgttgatgtgttctttacccctcccgaaaaatgcgacacactcctttgtgatattggggagagctcccctaacccgacggtggaggctggacgcaccctgcgggtcctgaatctcgtggaaaactggctgaataacaatacacaattctgcatcaaggttcttaacccctacatgcctagcgtgatcgagaagatggaagccctgcagagaaaatacggcggggctctcgtccgcaatcccctgtcccggaactctacccacgagatgtattgggtgagcaacgcctccggaaatattgtttctagcgtgaacatgatctccagaatgctgattaatcgctttacaatgcggcacaagaaagcgacctacgaacctgacgtcgatctcggctctgggacgagaaacatcggaattgagagcgagacccccaatcttgacatcatcggcaagcgcattgagaaaatcaagcaggagcatgaaacatcctggcactatgatcaggaccatccgtacaagacctgggcctatcacggcagctacgagacaaaacaaaccgggtctgcttccagcatggtgaacggagtggtccggctgctgacaaagccttgggacgttattcccatggtgacccagatggccatgacggatacaacccctttcggccagcagagagtgtttaaagaaaaggtcgacacccgcacacaagagcccaaagaggggacgaagaagctcatgaaaatcaccgctgaatggctgtggaaggagcttggcaaaaagaaaacacctagaatgtgtacccgggaagagttcacacgcaaggtgagatctaatgccgctctgggcgccatttttaccgatgagaacaaatggaagtccgcgcgggaagccgttgaggacagcgggttctgggaactcgtggataaggagagaaatctgcacctggaaggaaaatgcgagacatgtgtctataacatgatgggcaagcgggagaaaaagctcggcgaatttgggaaagctaagggatctcgcgccatctggtacatgtggctgggcgctagattccttgagtttgaagccctggggttcctcaatgaggaccattggttttcccgggaaaacagcctgtccggagtggagggcgaggggcttcacaagctgggctacattctccgcgatgttagcaaaaaggaaggaggcgccatgtatgcggacgataccgctgggtgggacacgagaatcaccctggaggatctgaaaaatgaagagatggtgacaaaccatatggaaggagagcacaagaaactcgccgaggccatcttcaagctgacctaccagaataaggtcgtgcgggttcagcgccccacaccgagaggcaccgtgatggacattatctctcggcgcgaccagagagggagcggacaagtcgtgacgtatggccttaacacattcaccaacatggaagctcagctgattcggcagatggagggggaaggcgtctttaaatccatccaacagctcacagtgaaggaggagattgccgttaaaaattggctgatccgcgtgggaagagaacggctttctcgcatggctatcagcggcgatgactgcgtcgtgaagcctctggatgacagattcgcctccgcgctcattgccctgaacgatatggggaaagtgcggaaggacatccagcagtgggagccctctagaggatggaatgattggacccaagttcccttttgcagccatcacttccacgaactgattatgaaggacggccgcgtgctcgtcgtgccttgtcggaaccaggatgagctgatcgggagagctcgcatttcccagggagccggctggtctcttcgggaaacggcttgcctggggaaaagctacgcccagatgtggtccctcatgtattttcatagacgcgacctgcggcttgcggccaatgctatctgtagcgccgttccgtctcactgggtgcccacctccagaacaacctggagcatccatgctacacacgagtggatgaccacagaggatatgctgaccgtctggaaccgcgtgtggattcaagaaaatccttggatggaggacaagacgcccgtcgaatcttgggaggaaatcccttacctcggcaaacgggaggatcagtggtgcggatccctgattggcctgacaagcagagccacctgggctaagaacatccagaccgccattaatcaggtgcgctccctcatcgggaacgaggaatatacagactacatgccctctatgaaacggttcagacgggaggaagaggaagcgggagttctgtggtga

SEQ ID NO: 20295 - RNA, 9876 nt, synthetic construct
  misc_feature 1..9876: note = derived and/or modified CDS sequence (opt5) from DENV-2__GQ398266__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaatccctcctgtttaagacggagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgaataaaaagcggtcttggccgctgaacgaagctattatggccgtgggcatggtttccatcctcgcgagctctctgctcaaaaatgatattcctatgacagggcccctggtggccggaggccttctgaccgtctgctacgtgctgaccggccgctccgctgacctcgagctggaaagagccgctgacgtccggtgggaggagcaggccgaaatcagcgggtccagccctatcctttctattacaatcagcgaggatggatccatgtctattaagaacgaagaggaggaacagaccctgacaatcctcattcgcacgggcctgctcgtgatcagcgggctgttccccgtttccattccgatcaccgccgctgcgtggtatctttgggaggtgaaaaagcaaagagccggagtcctgtgggacgtgccttctccccctcccgttggcaaagctgaactggaggatggggcctaccggatcaagcagaagggcattctcggctatagccagatcggcgccggggtgtacaaagaaggaacatttcacaccatgtggcatgtcacacgcggcgctgtgctgatgcacaaggggaaaagaattgagccctcctgggccgacgtgaagaaagatcttatctcttacggaggcgggtggaagctggagggagaatggaaggagggcgaagaggttcaggtcctcgcgctggaacctggcaaaaacccgcgggctgtgcaaaccaagcccggactcttcaaaacgaataccggaacaattggcgccgtgagcctggacttttcccctgggaccagcggatctcccatcgtcgataagaaaggcaaggtggttgggctttatggaaacggcgtggtcacaagatccggcacctacgtgagcgccatcgctcagacagagaagtctattgaggacaatcctgaaatcgaggatgacattttccgcaaaaagcggctgacgatcatggatctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggacctcatgtgtcatgcgacgttcaccatgagactgctttcccccatccgggttcctaactataatctgattatcatggatgaggcccactttacagaccccgctagcattgccgctcgcggctacatctccaccagagtggaaatgggggaggccgccggcatcttcatgacagctaccccgcctggatctcgggacccctttccccagagcaacgcgcctattatggatgaggaacgcgagatccccgaaagatcctggaatagcggccacgagtgggtcacggacttcaaggggaagacagtgtggtttgtgccttctattaaagccggaaacgatatcgctgcctgcctgcggaagaatggcaaaaaggtcattcaactctccagaaaaaccttcgacagcgaatatatcaagacccgcacaaacgattgggactttgttgtgaccacagatatctctgagatgggggccaatttcaaggctgagcgggtgattgacccgagacgctgtatgaaacccgtcatcctgaccgatggagaagaacgggtgattcttgccggccctatgcccgttacgcatagctccgcggctcagagacgcgggcgggtgggcagaaaccctaagaatgaaaacgaccagtacatctacatgggagagcccctggaaaatgatgaggactgcgcccactggaaagaggccaagatgctcctggacaacattaacacaccggaaggcatcatcccttctatgtttgagcccgaacgcgagaaagtcgatgctattgacggggaatatagactgcggggagaggcccgcaagaccttcgtggatctcatgagacggggcgaccttcctgtttggctggcgtaccgcgtggccgctgaggggatcaattatgccgatagacggtggtgttttgacggagtcaaaaacaatcaaattctggaagagaacgtggaagtcgagatctggacaaaggagggcgaaagaaagaaactcaagccccgctggctggatgctcggatttacagcgaccctcttgccctgaaagagttcaaggagttcgctgccgggagaaaatccctcaccctgaatctgatcacggagatgggccgcctccccacctttatgacacagaaggcgaagaacgcccttgataatctggctgtgctgcataccgccgaagctggaggccgggcctataaccacgccctctctgagctgccggagacacttgaaaccctgctcctgctgacactccttgctaccgttacaggcgggattttcctgtttctgatgagcgggaaagggatcggaaagatgacactcggcatgtgctgcatcattaccgcgtccatcctgctttggtacgcccagattcagcctcactggatcgctgccagcattatcctggagttctttctcatcgtgctgctgattcccgaacccgagaaacaaagaacccctcaggacaatcagctcacatatgtggtcatcgccattcttaccgttgtggctgccacaatggcgaacgaaatgggcttcctggagaagacgaaaaaggattttgggctgggatctatcaccacacagcaaccggagtccaatattctcgacatcgatctgcggcccgccagcgcttggaccctttacgccgtggctacaaccttcatcacgcctatgctgcgccattccattgaaaactctagcgtcaatgtgtccctcaccgccatcgcgaaccaggccacagttctgatgggcctggggaagggatggcccctctctaaaatggacattggcgtgcctcttctggctatcgggtgttacagccaggtcaatcccattaccctgatcgccgctctcctgcttctggtggcccactatgctattatcggacctggcctccaggccaaggcgacaagagaggcccaaaaacgggctgccgctggcatcatgaagaacccgaccgtcgacgggatgacggtgattgatctggaccccatcccttacgatcccaaatttgaaaagcagctgggacaggttatgctccttgtgctgtgcgtcacacaggtgctgatgatgcgcaccacatgggccctctgtgaggccctgacccttgcgaccggccctatttccacactgtgggaagggaatcccggaagattctggaacacgaccatcgctgttagcatggccaacatttttcggggctcttatctcgctggggccggactgctgttctccatcatgaagaatacagccaacacccgcagaggcacaggcaataccggggagacgctcggagagaaatggaagaaccggcttaatgctctgggcaaaagcgaatttcaaatctacaagaaatctgggattcaggaggtggaccgcacactggccaaggaaggaatcaaaagaggcgagaccgatcatcacgcggtctcccgggggagcgccaagctcagatggttcgtggagcgcaacctggtgaccccggaaggaaaggttgtcgaccttggctgcggcagagggggatggtcttattactgtggcgggctgaaaaatgtgaaggaggtgaaaggactcacaaagggcgggcctggacatgaagaacccattcccatgagcacctatggctggaacctggtcagactgcagtccggcgttgatgtgttctttacacctcccgaaaaatgcgacacgctcctttgtgatatcggggagtctagccctaatccgaccgtggaggctggacgcacactgcgggtcctgaacctcgtggaaaattggctgaacaataacacccaattctgcattaaggttcttaatccctacatgccttccgtgatcgagaagatggaagccctgcagagaaaatacggcggggctctcgtccgcaaccccctgagccggaactccacacacgagatgtattgggtgtctaatgccagcggaaacatcgtttcctctgtgaatatgattagcagaatgctgatcaaccgctttaccatgcggcacaagaaagcgacgtacgaacctgacgtcgatctcggctccgggaccagaaatattggaatcgagtctgagacacccaaccttgacattatcggcaagcgcatcgagaaaattaagcaggagcatgaaaccagctggcactatgatcaggaccatccgtacaagacatgggcctatcacggctcctacgagaccaaacaaacagggagcgcttcttccatggtgaatggagtggtccggctgctgaccaagccttgggacgttatccccatggtgacgcagatggccatgacagataccacccctttcggccagcagagagtgtttaaagaaaaggtcgacacacgcacgcaagagcccaaagaggggaccaagaagctcatgaaaattacagctgaatggctgtggaaggagcttggcaaaaagaaaacccctagaatgtgtacacgggaagagttcacccgcaaggtgagaagcaacgccgctctgggcgccatctttacagatgagaataaatggaagtctgcgcgggaagccgttgaggactccgggttctgggaactcgtggataaggagagaaacctgcacctggaaggaaaatgcgagacctgtgtctataatatgatgggcaagcgggagaaaaagctcggcgaatttgggaaagctaagggaagccgcgccatttggtacatgtggctgggcgctagattccttgagtttgaagccctggggttcctcaacgaggaccattggttttctcgggaaaattccctgagcggagtggagggcgaggggcttcacaagctgggctacatcctccgcgatgtttccaaaaaggaaggaggcgccatgtatgcggacgatacggctgggtgggacaccagaattacactggaggatctgaaaaacgaagagatggtgaccaatcatatggaaggagagcacaagaaactcgccgaggccatcttcaagctgacataccagaacaaggtcgtgcgggttcagcgccccaccccgagaggcacggtgatggacatcattagccggcgcgaccagagagggtctggacaagtcgtgacatatggccttaacaccttcacaaatatggaagctcagctgatccggcagatggagggggaaggcgtctttaaaagcattcaacagctcaccgtgaaggaggagatcgccgttaaaaactggctgattcgcgtgggaagagaacggctttcccgcatggctatctctggcgatgactgcgtcgtgaagcctctggatgacagattcgccagcgcgctcacggccctgaatgatatggggaaagtgcggaaggacatccagcagtgggagccctccagaggatggaacgattggacccaagttcccttttgctctcatcacttccacgaactgattatgaaggacggccgcgtgctcgtcgtgccttgtcggaatcaggatgagctgatcgggagagctcgcattagccagggagccggctggtcccttcgggaaacagcttgcctggggaaatcttacgcccagatgtggagcctcatgtattttcatagacgcgacctgcggcttgcggccaacgctatctgttccgccgttccgagccactgggtgcccacctctagaacaacctggtccattcatgctacacacgagtggatgaccacggaggatatgctgacagtctggaatcgcgtgtggatccaagaaaacccttggatggaggacaagacccccgtcgaaagctgggaggaaatcccttacctcggcaaacgggaggatcagtggtgcggatctctgattggcctgacctccagagccacatgggctaagaatatccagaccgccattaaccaggtgcgcagcctcatcgggaatgaggaatatacagactacatgccctccatgaaacggttcagacgggaggaagaggaagcgggagttctgtggtga

SEQ ID NO: 20296 - RNA, 9876 nt, synthetic construct
  misc_feature 1..9876: note = derived and/or modified CDS sequence (opt5) from DENV-2__GQ398265__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaatccctcctgtttaagacggagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccctgccacccttagaaagtactgcgtggaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcacgccaagaaacaggatgtggtcgtgctgggaagccaagagggcgccatgcatacggctctcacaggggcgaccgaaattcagatgtcctctggcaacctgctttttacaggacacctgaagtgcagactccggatggacaaactgcagcttaagggcatgagctattccatgtgtaccgggaaattcaaggtcgtgaaggagatcgccgaaacccaacatggaacaattgttatcagagtgcagtacgagggcgacgggagcccctgcaaaattcccttcgagatcatggatctggaaaagcgccacgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcatcaagtgttcggggcgatctatggcgctgcctttagcggagtttcctggacgatgaagattctcatcggcgtcgtgattacatggatcgggatgaatagccggtctacctccctgagcgtgtctctggtccttgtgggagttgtgaccctctacctgggcgtcatggtgcaggccgactccgggtgtgttgtgagctggaaaaacaaggagctgaaatgcggatccggcattttcatcacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcacagagaacgaagttaaactgaccattatgacaggagacatcaagggcatcatgcaggccgggaaacggagcctgagacctcagcccaccgagcttaagtactcctggaaagcgtggggaaaggccaagatgctcagcacggaactgcacaatcataccttcctgattgatggccctgagacagctgaatgccccaacaccaatcgcgcctggaactctctcgaggtggaggactatgggtttggagtcttcacaaccaatatctggctgaaacttaaggaacggcaagatgtgttttgtgactccaaactgatgagcgctgccattaaggacaacagagcggtgcacgccgatatgggctactggatcgagtctgctctcaacgacacatggaaaattgaaaaggcctccttcatcgaggtcaagagctgccactggcctaaatctcataccctgtggagcaatggcgttctggagtccgaaatgatcattcccaagaacttcgctgggccggtgagccagcacaattatcgccctggataccatacgcagacagccggcccctggcaccttgggcggctcgagatggattttgacttctgtgaaggaaccaccgtggtcgtgacagaggattgcggcaacagagggccctctctgcggaccacgacagcctccggaaaactgatcaccgaatggtgctgtcgcagctgcacactccctccgctgagataccggggcgaggacggctgttggtatgggatggagattagaccccttaaggaaaaagaggaaaatctggttaactccctcgtgaccgctggacatggccagatcgataatttttctctgggggtcctgggaatggcgcttttcctcgaggaaatgctgcgcacacgggtgggcaccaagcacgccattctgctcgttgctgtgagctttgtcacgctgatcaccgggaacatgtccttcagagaccttggacgcgtgatggttatggtgggcgccacaatgaccgatgacattggcatgggggtcacatacctggccctcctggctgcctttaaggtgagacctaccttcgcggctggactgcttctgcggaaactcacgtctaaggagctgatgatgacaaccatcggcatcgtgctcctgagccaatccacaattcccgagtctatccttgaactgaccgatgccctcgccctggggatgatggtcctgaaaattgttcgcaatatggagaagtatcagcttgctgtgaccatcatggccattctgtgcgtgcctaacgcggtcatcctccagaatgcttggaaagtgagctgtacaacgctggccgttgtgtccgtcagccccctcctgcttacctcttcccaacagaaggccgactggatccctctggctctcacaattaagggactgaaccccaccgccatctttctgacaacccttagcagaacgaataaaaagcggtcttggccgctgaacgaagctattatggccgtgggcatggtttccatcctcgcgagctctctgctcaaaaatgatattcctatgacagggcccctggtggccggaggccttctgaccgtctgctacgtgctgaccggccgctccgctgacctcgagctggaaagagccgctgacgtccggtgggaggagcaggccgaaatcagcgggtccagccctatcctttctattacaatcagcgaggatggatccatgtctattaagaacgaagaggaggaacagaccctgacaatcctcattcgcacgggcctgctcgtgatcagcgggctgttccccgtttccattccgatcaccgccgctgcgtggtatctttgggaggtgaaaaagcaaagagccggagtcctgtgggacgtgccttctccccctcccgttggcaaagctgaactggaggatggggcctaccggatcaagcagaagggcattctcggctatagccagatcggcgccggggtgtacaaagaaggaacatttcacaccatgtggcatgtcacacgcggcgctgtgctgatgcacaaggggaaaagaattgagccctcctgggccgacgtgaagaaagatcttatctcttacggaggcgggtggaagctggagggagaatggaaggagggcgaagaggttcaggtcctcgcgctggaacctggcaaaaacccgcgggctgtgcaaaccaagcccggactcttcaaaacgaataccggaacaattggcgccgtgagcctggacttttcccctgggaccagcggatctcccatcgtcgataagaaaggcaaggtggttgggctttatggaaacggcgtggtcacaagatccggcacctacgtgagcgccatcgctcagacagagaagtctattgaggacaatcctgaaatcgaggatgacattttccgcaaaaagcggctgacgatcatggatctgcatcccggggccggaaaaaccaagagatatctccctgcgattgttcgcgaagctatcaaacggggcctgagaacacttatcctggccccgacccgcgtggtcgccgctgagatggaagaggccctccgggggctgcccattagataccagacccctgctatccgcgccgagcacacaggacgggaaattgtggacctcatgtgtcatgcgacgttcaccatgagactgctttcccccatccgggttcctaactataatctgattatcatggatgaggcccactttacagaccccgctagcattgccgctcgcggctacatctccaccagagtggaaatgggggaggccgccggcatcttcatgacagctaccccgcctggatctcgggacccctttccccagagcaacgcgcctattatggatgaggaacgcgagatccccgaaagatcctggaatagcggccacgagtgggtcacggacttcaaggggaagacagtgtggtttgtgccttctattaaagccggaaacgatatcgctgcctgcctgcggaagaatggcaaaaaggtcattcaactctccagaaaaaccttcgacagcgaatatatcaagacccgcacaaacgattgggactttgttgtgaccacagatatctctgagatgggggccaatttcaaggctgagcgggtgattgacccgagacgctgtatgaaacccgtcatcctgaccgatggagaagaacgggtgattcttgccggccctatgcccgttacgcatagctccgcggctcagagacgcgggcgggtgggcagaaaccctaagaatgaaaacgaccagtacatctacatgggagagcccctggaaaatgatgaggactgcgcccactggaaagaggccaagatgctcctggacaacattaacacaccggaaggcatcatcccttctatgtttgagcccgaacgcgagaaagtcgatgctattgacggggaatatagactgcggggagaggcccgcaagaccttcgtggatctcatgagacggggcgaccttcctgtttggctggcgtaccgcgtggccgctgaggggatcaattatgccgatagacggtggtgttttgacggagtcaaaaacaatcaaattctggaagagaacgtggaagtcgagatctggacaaaggagggcgaaagaaagaaactcaagccccgctggctggatgctcggatttacagcgaccctcttgccctgaaagagttcaaggagttcgctgccgggagaaaatccctcaccctgaatctgatcacggagatgggccgcctccccacctttatgacacagaaggcgaagaacgcccttgataatctggctgtgctgcataccgccgaagctggaggccgggcctataaccacgccctctctgagctgccggagacacttgaaaccctgctcctgctgacactccttgctaccgttacaggcgggattttcctgtttctgatgagcgggaaagggatcggaaagatgacactcggcatgtgctgcatcattaccgcgtccatcctgctttggtacgcccagattcagcctcactggatcgctgccagcattatcctggagttctttctcatcgtgctgctgattcccgaacccgagaaacaaagaacccctcaggacaatcagctcacatatgtggtcatcgccattcttaccgttgtggctgccacaatggcgaacgaaatgggcttcctggagaagacgaaaaaggattttgggctgggatctatcaccacacagcaaccggagtccaatattctcgacatcgatctgcggcccgccagcgcttggaccctttacgccgtggctacaaccttcatcacgcctatgctgcgccattccattgaaaactctagcgtcaatgtgtccctcaccgccatcgcgaaccaggccacagttctgatgggcctggggaagggatggcccctctctaaaatggacattggcgtgcctcttctggctatcgggtgttacagccaggtcaatcccattaccctgacagccgctctcctgcttctggtggcccactatgctatcattggacctggcctccaggccaaggcgaccagagaggcccaaaaacgggctgccgctggcatcatgaagaacccgacggtcgacgggatgacagtgatcgatctggaccccattccttacgatcccaaatttgaaaagcagctgggacaggttatgctccttgtgctgtgcgtcacccaggtgctgatgatgcgcacaacctgggccctctgtgaggccctgacccttgcgacaggccctatctccacgctgtgggaagggaatcccggaagattctggaacaccacaattgctgttagcatggccaacatctttcggggctcttatctcgctggggccggactgctgttctccattatgaagaataccgccaacacacgcagaggcaccggcaatacgggggagacactcggagagaaatggaagaaccggcttaatgctctgggcaaaagcgaatttcaaatctacaagaaatctgggatccaggaggtggaccgcaccctggccaaggaaggaattaaaagaggcgagaccgatcatcacgcggtctcccgggggagcgccaagctcagatggttcgtggagcgcaacctggtgacaccggaaggaaaggttgtcgaccttggctgcggcagagggggatggtcttattactgtggcgggctgaaaaatgtgaaggaggtgaaaggactcaccaagggcgggcctggacatgaagaacccatccccatgagcacatatggctggaacctggtcagactgcagtccggcgttgatgtgttctttacgcctcccgaaaaatgcgacaccctcctttgtgatattggggagtctagccctaatccgacagtggaggctggacgcaccctgcgggtcctgaacctcgtggaaaattggctgaacaataacacacaattctgcatcaaggttcttaatccctacatgccttccgtgattgagaagatggaagccctgcagagaaaatacggcggggctctcgtccgcaaccccctgagccggaactccacccacgagatgtattgggtgtctaatgccagcggaaacatcgtttcctctgtgaatatgatcagcagaatgctgattaaccgctttacgatgcggcacaagaaagcgacctacgaacctgacgtcgatctcggctccgggacaagaaatatcggaattgagtctgagacccccaaccttgacatcattggcaagcgcatcgagaaaatcaagcaggagcatgaaacaagctggcactatgatcaggaccatccgtacaagacctgggcctatcacggctcctacgagacaaaacaaaccgggagcgcttcttccatggtgaatggagtggtccggctgctgacgaagccttgggacgttattcccatggtgacacagatggccatgaccgataccacacctttcggccagcagagagtgtttaaagaaaaggtcgacacgcgcacccaagagcccaaagaggggacaaagaagctcatgaaaatcaccgctgaatggctgtggaaggagcttggcaaaaagaaaacacctagaatgtgtacccgggaagagttcacacgcaaggtgagaagcaacgccgctctgggcgccatttttaccgatgagaataaatggaagtctgcgcgggaagccgttgaggactccgggttctgggaactcgtggataaggagagaaacctgcacctggaaggaaaatgcgagacgtgtgtctataatatgatgggcaagcgggagaaaaagctcggcgaatttgggaaagctaagggaagccgcgccatctggtacatgtggctgggcgctagattccttgagtttgaagccctggggttcctcaacgaggaccattggttttctcgggaaaattccctgagcggagtggagggcgaggggcttcacaagctgggctacattctccgcgatgtttccaaaaaggaaggaggcgccatgtatgcggacgataccgctgggtgggacacaagaatcaccctggaggatctgaaaaacgaagagatggtgacaaatcatatggaaggagagcacaagaaactcgccgaggccattttcaagctgacctaccagaacaaggtcgtgcgggttcagcgccccacgccgagaggcacagtgatggacatcatcagccggcgcgaccagagagggtctggacaagtcgtgacctatggccttaacacattcaccaatatggaagctcagctgattcggcagatggagggggaaggcgtctttaaaagcatccaacagctcacggtgaaggaggagattgccgttaaaaactggctgatccgcgtgggaagagaacggctttcccgcatggctatttctggcgatgactgcgtcgtgaagcctctggatgacagattcgccagcgcgctcaccgccctgaatgatatggggaaagtgcggaaggacatccagcagtgggagccctccagaggatggaacgattggacacaagttcccttttgctctcatcacttccacgaactgatcatgaaggacggccgcgtgctcgtcgtgccttgtcggaatcaggatgagctgattgggagagctcgcatcagccagggagccggctggtcccttcgggaaaccgcttgcctggggaaatcttacgcccagatgtggagcctcatgtattttcatagacgcgacctgcggcttgcggccaacgctatttgttccgccgttccgagccactgggtgcccacatctagaaccacatggtccatccatgctacccacgagtggatgacgacagaggatatgctgaccgtctggaatcgcgtgtggattcaagaaaacccttggatggaggacaagacccccgtcgaaagctgggaggaaatcccttacctcggcaaacgggaggatcagtggtgcggatctctgatcggcctgacatccagagccacctgggctaagaatattcagacagccatcaaccaggtgcgcagcctcattgggaatgaggaatatacggactacatgccctccatgaaacggttcagacgggaggaagaggaagcgggagttctgtggtga

SEQ ID NO: 20297 - RNA, 9876 nt, synthetic construct
  misc_feature 1..9876: note = derived and/or modified CDS sequence (opt5) from DENV-2__KX702403__SS-prME
  source 1..9876: mol_type = other RNA
accgccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatccttattctgctcacggccgtcgcgcctagcatgaccatgcggtgcatcggcatttccaaccgcgatttcgtggaaggggtttctggaggcagctgggtggacatcgtcctggagcacgggtcctgtgtgacaaccatggccaagaataagcccacacttgattttgaactgatcaaaaccgaggctaagcagcctgccacgctcagaaaatattgcattgaagctaagctgacaaacaccaccacagagagccggtgtccgacccaaggagagccctctctgaatgaagaacaggacaaacgcttcatctgcaagcattccatggtggatagaggctggggcaacgggtgtggactctttggcaaagggggaattgtcacatgcgccatgttcacgtgcaaaaagaatatggaaggcaaaatcgttcagcctgagaacctggaatacaccattgtgatcacaccccacagcggggaggagcatgcggtgggaaatgacaccggcaagcacggcaaagaaatcaagattacacctcagtcttccaccacggaggccgaacttaccgggtatggaacagtcaccatggagtgtagcccccggacaggcctggattttaacgaaatggtgctcctgcaaatggaggacaaggcttggcttgttcaccgccagtggttcctggatctcccgctgccttggctgcccggggccgacacccagggatctaattggatccagaaggagacgctcgtgacatttaagaaccctcatgctaaaaagcaagacgtcgtggttctgggctcccaggaaggggccatgcacaccgcccttacaggcgctaccgagattcagatgagctccggaaatctcctgttcaccggccatctgaaatgcagacttcggatggataagctgcaactcaaagggatgtcttacagcatgtgtacaggaaagtttaagatcgtgaaagaaattgcggagacgcagcacggcaccatcgtcatcagagtgcagtatgagggggacggatccccctgcaagattcccttcgaaatcacagatctggagaaacgccatgtcctgggccggctcattaccgtgaaccctatcgttacagaaaaggacagcccggtgaacattgaggccgaaccccctttcggggattcttacatcattgtcggcgtggagcccggacagctgaaacttaattggtttaagaagggctccagcatcgggcaaatgttcgagaccacgatgagaggagctaaacgcatggccatcctgggcgacacagcctgggattttgggtctctcggaggcgttttcaccagcattgggaaggctctgcaccaggtgtttggcgccatctacggagcggctttctccggcgtctcttggaccatgaaaattctgatcggggtgattatcacatggatcggaatgaacagccggtccaccagcctttctgtgtccctcgttctggtcggcgtggtgacactgtatctcggggccatggtccaggccgacagcggatgtattgtgtcttggaagaataaagaactgaagtgcggctccgggatctttattacggataacgttcacacctggacagagcagtacaagttccaacctgaaagcccctccaaacttgcttctgccatccagaaggctcatgaggaaggcatttgtggaatcagaagcgtgacccgcctggagaatctcatgtggaaacagatcacaccggagctgaaccacattctgtccgaaaatgaggtcaaacttaccatcatgacgggcgacattaaagggatcatgcaggccggaaagcggtctctcagacctcaacccaccgaactgaaatatagctggaagacatggggcaaggcgaaaatgctgtccaccgagagccataaccagacatttctcattgatgggcctgaaaccgccgagtgccccaatacaaaccgcgcttggaactctctggaggtggaagactacggattcggcgtttttaccacgaacatctggcttaagctgcgggagaaacaggacgtgttctgtgattccaagctcatgagcgccgctatcaaagacaatagagccgtccacgcggatatgggctattggattgaatctgccctgaacgacacatggaagatggagaaggcttcctttatcgaggtgaaaagctgccactggcctaagtctcataccctgtggagcaatggggttcttgaatccgagatgattatccccaaaaacttcgccggaccggtgagccagcacaactaccgccctggctatcatacccaaacagctgggccctggcacctcggaaagctggaaatggatttcgacttttgtgagggcaccacggtcgtggtgacagaagattgcgagaaacgggggccctctctgagaaccacaaccgcctccggaaagctcattacagagtggtgctgtcggagctgcaccctgcctccgcttcgctacagaggcgaagacggctgttggtacgggatggagatccggcccctgaaggaaaaagaggaaaatctcgtcaactccctggttacggccggacatggccagattgataatttctctctgggggtgcttggaatggctctctttctggaggagatgctgagaacccgcgtgggcacaaagcacgcgatcctcctggtcgcccttagcttcgtgaccctgatcacagggaacatgtcctttcgggacctcggaagagttatggtgatggtcggcgctaccatgacggatgacattggcatgggggtgacatatctggccctgcttgccgctttcaaagttcgccctacctttgccgcgggactgctcctgagaaagctcacatctaaagaactgatgatggctaccatcggcattgcccttctgagccagtccaccctccccgagacaatcctggaactgacggatgcccttgctctggggatgatggccctcaagattgtgcggaatatggagaagtaccaactggcggtcaccatcatggctatctcttgcgtgcctaacgccgttattctccagaatgcctggaaagtgagctgtacaatcctggctgccgtctccgtgagcccccttctgctcacctcttcccagcagaaggctgactggattcctctggccctgacaatcaaaggacttaaccccaccgcgattttcctgacgacactcagccgcacctctaagaaaagatcctggccgctgaatgaagccatcatggctgtgggcatggtcagcatcctcgcctcttccctgcttaagaacgacattcctatgaccgggcccctggttgctggaggcctgctcacagtgtgctatgtgctgaccggccggagcgccgatcttgagctggagcgcgccgctgacgtcaaatgggaagatcaagcggagatctccgggagctctcctattctcagcatcacaatttccgaagacggatctatgagcatcaagaatgaggaggaagaacagacgctgaccattctcatcagaacaggcctgcttgtgatctccggggtttttcccgtgtctattccgatcaccgccgctgcctggtacctgtgggaagtcaagaaacagcgggccggagtgctgtgggatgttccttctccccctcccgtgggcaaggctgagctcgaagacggggcctatcgcattaaacagagaggaatcctgggctactcccaaattggcgcgggggtctataaggagggaacattccacaccatgtggcatgtgacgcggggcgctgtccttatgcaccgcgggaaaagaatcgagccctcctgggccgatgtgaagaaggacctgatcagctacggaggcgggtggaaactcgaaggagagtggaaggaaggcgaggaagttcaggtgctggccctcgagcctggcaaaaacccgcgggctgtccagaccaagcccgggatttttaaaacaaataccggaacaatcggcgccgtgtccctggatttcagccctgggacctctggatcccccattgttgacagaaagggcaaggtggtcgggctttacggaaacggcgtggtgacacgcagcggcgcgtatgtttctgctatcgcccagacggagaaatccattgaagataatcctgagatcgaagacgatatctttcggaagaaaagactgaccattatggacctgcatcccggggccggaaagacaaaacgctacctccctgctatcgtccgggaggccattaagagaggcctgcgcacccttatcctggctccgacccgggtggtggccgcggaaatggaggaggccctcagagggctgcccattcgctatcaaacgcctgctatccgggccgaacacacgggaagagagattgtcgacctcatgtgtcatgctaccttcacaatgcggctgcttagccccgtgcgcgttcctaactacaacctgatcatcatggatgaagcccacttcaccgaccccgcctccattgctgcgagaggctatatctctacacgggtggagatgggggaggccgctggcatttttatgaccgccacgccgcctggaagccgcgatcccttcccccagtccaatgcccctatcatggacgaagagagagaaattcccgagcggagctggaactctggccacgaatgggtcacagattttaaggggaaaaccgtgtggttcgttccttccatcaaggctggaaatgacatcgccgcgtgcctgcgcaagaatggcaagaaagtgattcagctcagccgcaagacctttgattctgagtacgtcaagacacgggctaatgactgggatttcgtggttaccacagacatcagcgagatgggggccaactttaaagccgaaagagtgattgatccgcgccggtgtatgaagcccgtcatcctgaccgacggagaggaaagagtgattcttgctggccctatgcccgtgacgcattcctctgccgcgcaacgccgggggagaatcggccgcaatcctaaaaacgagaatgaccagtatatctacatgggagaacccctggagaacgatgaggactgcgcccactggaaggaagctaaaatgctcctggataatattaacacaccggagggcatcattcctagcatgttcgaacccgagagagaaaaggtcgacgccatcgatggggagtaccggctgcgcggagaggctagaaaaacctttgttgacctcatgcggcgcggcgatcttcctgtgtggctggcctataaggtggctgccgaagggattaattacgcggacagaaagtggtgtttcgatggaatcaaaaacaatcagattctggaggaaaacgtcgaggtggagatctggacaaaggaaggcgagcggaaaaagctcaaacccagatggctggacgcccgcatctattccgatcctcttgctctgaaggaatttaaggagttcgccgctgggcggaaatctctcaccctgaacctgattacggaaatgggcagactccccaccttcatgacacagaaggcccgcaatgcccttgacaacctggctgttctgcataccgcggaggtgggaggcaaagcctacacacacgctctcagcgagctgccggaaacccttgagacactgctcctgctgaccctccttgccgccgtcacagggggaatctttctgttcctgatgtccggcaaggggattggaaaaatgacactcggcatgtgctgcatcattaccgctagcatcctgctttggtatgcccaaatccagcctcactggattgcggcctctatcattctggaatttttcctcatcgtgctgctgattcccgagcccgaaaagcagcggacccctcaggataatcaactcacatacgttgtgatcgctatccttaccgtcgtggccgctacaatggccaacgagatgggctttctggagaagacgaaaaaggacctggggttcggatccattaccacacaggaaagcgagtccaatatcctcgacattgatctgagaccggcgtctgcctggaccctttatgctgtcgccacaacctttgtgacgcccatgctgcggcatagcatcgaaaactcctctgttaatgtgagcctcaccgctattgccaaccaggctacagtgctgatgggcctggggaaaggatggcctctctccaagatggacatcggcgtcccccttctggccattgggtgttacagccaggttaatcctatcaccctgacagcggccctcctgcttctggtggctcactacgccatcattggacccggcctccaagctaaagccacccgcgaggcccagaagagagcggctgccggcatcatgaagaaccctacggtggatgggattacagtcatcgacctggaaccgattccccatgatcctaaattcgagaagcagctgggacaggtgatgctccttatcctgtgcgttacccaagtgctgatgatgcggacaacctgggctctctgtgaggccctgacccttgccacaggccccatctctacgctgtgggaagggaatcctggacgcttttggaacaccacaattgctgtctccatggccaatatcttcagaggcagctatctcgcgggggccggactgctgttttctattatgaaaaacaccacaaatacccggcgcggcacgggcaacgtgggggagacactcggagaaaagtggaaatccagacttaatgctctgggcaagagcgagttccagatctacaaaaagtctgggattcaggaggtcgaccggaccctggccaaggaaggaatcaaacgcggcgagaccgatcaccatgctgtgagcagagggtccgccaagctccggtggtttgttgaaagaaacatggtgacacccgagggaaaagtcgtggacctgggctgcggccgcgggggatggtcttattactgtggcgggcttaagaacgttcgggaagtgaaaggactgaccaagggcgggccgggacacgaggagcctatccccatgagcacatatggctggaatctcgtcagactgcaatccggcgtggatgtgttcttcacgccccctgaaaagtgcgacaccctgctctgtgatattggggagagctcccccaaccctacaatcgaagcgggacgcacccttcgggttctgaatctggtcgagaactggctcaataacaatacacagttttgcattaaagtgctgaacccgtacatgccctctgtgatcgaaaagatggagacccttcagagaaaatatggcggggccctggtccgcaatcctctcagccggaactccacgcacgagatgtactgggtttctaatgctaccggaaacattgtgagctccgtgaatatgatctctagaatgctgatcaaccgcttcacaatgaagcataaaaaggccacctacgaacccgacgtcgatctgggcagcgggacacggaatattggaatcgagtccgaaacccctaacctcgacattatcggcaagagaattgagaaaatcaagcaggaacacgagacaagctggcattatgaccaagatcacccctacaaaacctgggcttatcacggctcttacgagacgaagcagacagggtccgccagctctatggtgaacggagttgtgcgccttctgaccaaaccgtgggacgtcgtgcctatggttacccagatggctatgacagatacgaccccctttggccagcaacgggtgttcaaggaaaaggtcgacacaagaacccaggagcctaaagaagggacaaagaaactgatgaagattaccgccgagtggctctggaaagagctgggaaaggagaaaacaccccgcatgtgtaccagagaggaatttacgcggaaggtgcgctccaatgcggcccttggcgctgtgttcaccgatgagaacaagtggaaaagcgccagagaagctgtcgaggacgggcggttttgggagctggttgatagagaacggaatctccatctggagggaaagtgcgaaacatgtgtgtataacatgatgggcaaacgcgagaagaaactgggcgagttcgggaaggccaagggatctagagccatctggtacatgtggctcggcgcgcggtttctggagttcgaggctcttgggtttctgaatgaagaccactggttctcccgcggaaacagcctctccggcgtggagggggaaggcctgcatagacttggatatatcctgcgggaggtcggcaaaaaggaagggggagccatgtacgccgatgacaccgctggctgggatacacgcattaccctcgaggacctgaaaaatgaggaaatggtgacgaaccacatgaagggggagcataaaaagctggccgaagctatctttaagctcacataccagaataaagttgtgagagtccagcggcctacccccagaggaacagtgatggacattatcagcagaaaggatcaacggggctctgggcaggttggcacctatggactgaacacgttcaccaatatggaggcccagcttattcgccaaatggagggcgaagggatcttcaaaagcatccagcacctgacagcgaccgaggaaacagccgtgcagaactggctcgctagagtcggacgggagcgcctgtccagaatggccatttctggcgacgattgcgtggttaagccgatcgacgatcggtttgctagcgcccttaccgcgctgaatgacatggggaaagtgagaaaggatattcagcaatgggaaccttcccgcggatggaacgactggacacaggtccccttctgctctcaccattttcacgagctcgtgatgaaggatggccgggtcctggtggttccctgtagaaatcaggacgagctgatcgggcgcgcccggattagccagggcgctggatggtccctcaaagaaaccgcctgcctgggcaagtcttacgctcaaatgtggacgcttatgtatttccatagacgcgatctgcggctcgccgctaacgccatctgtagcgcggtgccttcccactgggtcccgacaagcagaaccacctggtctatccacgccaaacatgagtggatgacaaccgaagacatgctggctgtgtggaaccgcgtgtggattcaggagaatccctggatggaagataagacacctgttgagtcctgggaggaagtgccctaccttgggaaacgggaggaccagtggtgcggaagcctgatcggcctcacgtctagagccacctgggccaagaacattcagacagctatcaatcaagtccgctccctgattgggaacgaaggatataccgactacatgcctagcatgaagcggtttagacgggaggaagaggaggccggcgtgctgtggtga

SEQ ID NO: 20298 - RNA, 9876 nt, synthetic construct
  misc_feature 1..9876: note = derived and/or modified CDS sequence (opt5) from DENV-2__KX702404__SS-prME
  source 1..9876: mol_type = other RNA
accgccggcgtgatcgtcatgctgattcccacggctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaagacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccaccacggaggccgaactgaccgggtatggaacagtgaccatggagtgtagcccccggacaggccttgatttcaacgaaatggttctgctccaaatggaggacaaggcttggctggtgcaccgccagtggtttcttgatctgccgctcccttggctgcccggggccgacacccagggatctaattggattcagaaggagacgctggtcacattcaagaaccctcatgctaaaaagcaagacgtggttgtgctcggctcccaggaaggggccatgcacaccgccctgacaggcgctaccgagatccagatgagctccggaaatcttctgtttaccggccatctcaaatgcagactgcggatggataaacttcaactgaaagggatgtcttacagcatgtgtacaggaaagttcaaggtcgtgaaagaaattgcggagacgcagcacggcaccatcgtcattagagtgcagtatgagggggacggatccccctgcaagatccccttcgaaatcacagatctcgagaaacgccatgttctgggccggctgattaccgtgaaccctatcgtcacagaaaaggacagcccggtgaacattgaggccgaacccccttttggggattcttacatcattgttggcgtggagcccggacagctcaaactgaattggttcaagaagggctccagcatcgggcaaatgtttgagaccacgatgagaggagctaaacgcatggccattcttggcgacacagcctgggatttcgggtctctgggaggcgtctttaccagcatcgggaaggctctccaccaggtgttcggcgccatctacggagcggctttttccggcgtgtcttggaccatgaaaattctgatcggggttattatcacatggattggaatgaacagccggtccaccagcctgtctgtctcccttgtgctcgtgggcgtcgtgacactgtatctgggggccatggttcaggccgacagcggatgtgtggtctcttggaagaataaagaactcaagtgcggctccgggatcttcatcacggataacgtgcacacctggacagagcagtacaagtttcaacctgaaagcccctccaaactggcttctgccattcagaaggctcatgaggaaggcatctgtggaattagaagcgttacccgccttgagaatctgatgtggaaacagatcacaccggagctcaaccacattctgtccgaaaatgagatcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgtcttcaccacgaacatctggctgaaacttcgggagaaacaggacgtgttttgtgattccaagctgatgagcgccgctattaaagacaatagagccgttcacgcggatatgggctattggatcgaatctgccctcaacgacacatggaagatggagaaggcttccttcatcgaggtgaaaagctgccactggcctaagtctcataccctgtggagcaatggggtcctggaatccgagatgattatccccaaaaacttcgccggaccggtgagccagcacaactaccgccctggctatcatacccaaacagctgggccctggcaccttggaaagctcgaaatggattttgacttctgtgagggcaccacggtggtcgttacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtgaatagcctcgtgacggccggccatgggcagattgataacttttctctgggagtcctgggcatggctcttttcctcgaagagatgctgagaacccgcgtggggacaaaacacgcgatcctgctcgttgccctgagctttgtgacccttattacaggaaatatgtccttccgggacctgggcagagtcatggtgatggttggcgctaccatgacggatgacatcgggatgggagtgacatatctcgccctgctggccgcttttaaggtccgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggttaccatcatggctatttcttgcgtgcctaatgccgtcatcctgcagaacgcctggaaggtgagctgtacaatcctcgctgccgtgtccgtcagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgttgggatggtgagcattctggcctcttccctcctgaaaaatgacatccctatgaccggaccccttgtggctggcggcctgctgacagtctgctatgtgctcaccgggcggagcgccgatctggaacttgagcgcgccgctgacgttaagtgggaggatcaagcggaaatctccggaagctctcctattctgagcatcacaatttccgaggacggctctatgagcatcaaaaacgaagaggaggaacagacgctcaccattctgatcagaacagggctcctggtgatttccggagtcttccccgtgtctatcccgatcaccgccgctgcctggtacctttgggaggttaagaagcagcgggccggcgtgctgtgggatgtcccttctccccctcccgtggaaaaagctgagctggaagacggggcctatcgcattaagcagagaggaatcctcggctactcccaaattggcgcgggggtctataaagagggaacatttcacaccatgtggcatgtgacgcggggcgctgttctgatgcaccgcgggaagagaatcgagccctcctgggccgatgtgaaaaaggaccttattagctacggaggcgggtggaagctggaaggagagtggaaagaaggcgaggaagtccaggtgctcgccctggagcctggcaagaatccgcgggctgttcagaccaaacccgggatcttcaagacaaacaccggaacaatcggcgccgtgtccctcgattttagccctgggacctctggatcccccattgtcgacagaaaaggcaaggtggtggggctgtacggaaatggcgttgtcacacgcagcggcgcgtatgtgtctgctatcgcccagacggagaagtccattgaagataaccctgagatcgaagacgatattttccggaaaaagagacttaccatcatggacctgcatcccggggccggaaaaacaaagcgctacctgcctgctatcgtgcgggaggccattaaaagaggcctccgcaccctgatccttgctccgacccgggtcgtggccgcggaaatggaggaggccctgagagggctccccattcgctatcaaacccctgctatccgggccgaacacacgggaagagagattgttgacctgatgtgtcatgctaccttcacaatgcggctcctgagccccgtgcgcgtccctaactacaatcttatcattatggatgaagcccactttaccgaccccgcctccatcgctgcgagaggctatatctctacacgggtggagatgggggaggccgctggcattttcatgaccgccacgccgcctggaagccgcgatccctttccccagtccaacgcccctatcatggacgaagagagagaaattcccgagcggagctggaactctggccacgaatgggttacagatttcaaggggaagaccgtgtggtttgtcccttccatcaaagctggaaacgacattgccgcgtgcctgagaaagaatggcaaaaaggtgatccagctgagccgcaaaaccttcgattctgagtacgttaagacacgggctaacgactgggattttgtggtcaccacagacatcagcgagatgggggccaatttcaaggccgaaagagtgattgatccgcgccggtgtatgaaacccgtgatcctcaccgacggagaggaaagagtcattctggctggccctatgcccgttacgcattcctctgccgcgcaacgccgggggagaatcggccgcaaccctaagaatgagaacgaccagtatatttacatgggagaaccccttgagaatgatgaggactgcgcccactggaaagaagctaagatgctgctcgataacatcaatacaccggagggcatcattcctagcatgtttgaacccgagagagaaaaagtggacgccatcgatggggagtaccggctgcgcggagaggctagaaagaccttcgtggacctgatgcggcgcggcgatctccctgtctggcttgcctataaagtggctgccgaagggattaactacgcggacagaaagtggtgttttgatggaatcaagaataaccagattctggaggaaaacgttgaggtggagatctggacaaaagaaggcgagcggaagaaactgaagcccagatggctcgacgcccgcatttattccgatcctctggctcttaaagagttcaaggagttcgccgctgggcggaagtctctgaccctcaatctgatcacggaaatgggcagactgcccacctttatgacacagaaagcccgcaacgccctcgacaatcttgctgtcctgcataccgcggaggtgggaggcaaggcctacacacacgctctgagcgagctcccggaaaccctggagacacttctgctcctgaccctgctcgccgccgttacagggggaatcttcctttttctgatgtccggcaaagggattggaaagatgacactgggcatgtgctgcatcattaccgctagcatcctcctgtggtatgcccaaattcagcctcactggatcgcggcctctatcattcttgagttctttctgatcgtgctcctgattcccgagcccgaaaaacagcggacccctcaggataaccaactgacatacgtcgtgatcgctattctcaccgtcgtggccgctacaatggccaatgagatgggcttccttgagaagacgaagaaagacctggggtttggatccatcaccacacaggaaagcgagtccaacatcctggacattgatctcagaccggcgtctgcctggaccctgtatgctgttgccacaaccttcgtgacgcccatgcttcggcatagcatcgaaaattcctctgtgaacgtcagcctgaccgctattgccaatcaggctacagttctcatgggcctggggaagggatggcctctgtccaaaatggacatcggcgtgcccctccttgccattgggtgttacagccaggtgaaccctatcaccctgacagcggccctgctcctgcttgtcgctcactacgccattatcggacccggcctgcaagctaaggccacccgcgaggcccagaaaagagcggctgccggcatcatgaagaatcctacggtggatgggattacagttatcgacctcgaaccgattccctatgatcctaagtttgagaaacagctgggacaggtgatgctgctcatcctttgcgtcacccaagtgctgatgatgcggacaacctgggctctgtgtgaggccctcaccctggccacaggccccatttctacgctttgggaagggaaccctggacgcttctggaataccacaatcgctgtctccatggccaacatctttagaggcagctacctggcgggggccggactcctgttctctattatgaagaataccacaaacacccggcgcggcacgggcaatgtgggggagacactgggagaaaaatggaagtccagactcaacgctcttggcaaaagcgagtttcagatctataagaaatctgggattcaggaggttgaccggaccctggccaaggaaggaatcaagcgcggcgagaccgatcatcacgctgtgagcagagggtccgccaaactgcggtggttcgtcgaaagaaacatggtgacacccgagggaaaggttgtggacctcggctgcggccgcgggggatggtcttactattgtggcgggctgaaaaatgtccgggaagtgaagggacttaccaaaggcgggccgggacatgaggagcctattcccatgagcacatacggctggaacctggtgagactccaatccggcgttgatgtcttctttacgccccctgaaaagtgcgacaccctgctgtgtgatatcggggagagctcccccaatcctacaatcgaagcgggacgcaccctccgggtgcttaacctggtggagaattggctgaacaataacacacagttctgcattaaggtcctcaatccgtatatgccctctgttatcgagaagatggagaccctgcagagaaagtacggcggggcccttgtgcgcaaccctctgagcagaaattccacgcacgagatgtactgggtgtctaacgctaccggaaatattgtcagctccgtgaacatgatctctagaatgctcattaatcgctttacaatgaaacacaagaaagccacctatgaacccgacgttgatctgggcagcgggacacggaacatcggaatcgagtccgaaattcctaacctggacatcgtgggcaagagaattgagaagatcaaacaggaacatgagaccagctggcactacgaccaagatcatccctataagacatgggcttaccacggctcttatgagaccaaacagacggggtccgccagctctatggtcaatggagtggttcgcctccttacaaagccgtgggacgtggtccctatggtgacccagatggctatgaccgatacaacgcccttcggccagcaacgggtgtttaaagaaaaggtcgacaccagaacacaggagcctaaggaagggaccaaaaagctgatgaaaattacagccgagtggctgtggaaggagctcggaaaagaaaagacaccccgcatgtgtacaagagaggagttcacccggaaagttcgctccaacgcggccctgggcgctgtgtttacgaatgagaacaagtggaaaagcgccagagaagctgtggaggatgggcggttctgggagcttgtcgacagagaacggaatctgcacctcgagggaaaatgcgaaacctgtgtgtacaacatgatgggcaagcgcgagaaaaagctgggcgaatttgggaaagccaagggatctagagccatctggtatatgtggctgggcgcgcggttcctcgagtttgaggctctggggttccttaatgaagatcattggttttcccgcggaaacagcctgtccggcgttgagggggaaggcctccacagactgggatacattcttcgggaggtgggcaagaaagaagggggagccatgtacgccgacgatacagctggctgggacacccgcatcacactggaggatctcaagaatgaggaaatggtcaccaaccatatgaaaggggagcacaagaaactggccgaagctatcttcaagctgacgtatcagaataaggtggttagagtgcagcggcctacaccccgcggaaccgtcatggacattatcagcagaaaagaccaacggggctctggacaggtgggcacatacggactcaacaccttcacgaatatggaggcccagctgattcgccaaatggagggcgaagggatctttaagagcattcagcatcttaccgcgacagaggaaatcgccgttcagaactggctggctagagtgggacgggagcgcctctccagaatggccatctctggcgatgactgcgtcgtgaaaccgattgatgaccggttcgctagcgccctgaccgcgcttaatgatatggggaaggtcagaaaagacatccagcaatgggaaccttcccgcggatggaacgattggacacaggtgcccttttgctctcaccacttccatgagctggttatgaaggacggccgggtgctcgtcgtgccctgtagaaaccaggatgagctgattgggcgcgcccggatcagccagggcgctggatggtccctgaaggaaaccgcctgcctcggcaaatcttatgctcaaatgtggacactgatgtactttcacagacgcgaccttcggctggccgctaatgccatttgtagcgcggtgccttcccattgggttccgaccagcagaacgacatggtctatccacgccaagcacgagtggatgaccaccgaagatatgctcgctgtgtggaaccgcgtctggatccaggagaatccctggatggaagacaaaacacctgtggagtcctgggaggaagttccctatctggggaagcgggaggatcagtggtgcggaagccttattggcctgacctctagagccacatgggccaaaaacatccagacggctattaatcaagtgcgctccctcatcgggaacgaaggatacaccgactatatgcctagcatgaagcggttcagacgggaggaagaggaggccggcgtcctgtggtga

SEQ ID NO: 20299 - RNA, 9873 nt, synthetic construct
  misc_feature 1..9873: note = derived and/or modified CDS sequence (opt5) from DENV-2__JQ686088__SS-prME
  source 1..9873: mol_type = other RNA
acaacaggaatgatcattatgctgatccccacggtgatggccttccacctcaccacacggaacggggaacctcatatgattgtgagccggcaggacaagggaaaaagcctgctttttaagaccaaagatggaacaaatatgtgcaccctgatggctatggacctcggggaactgtgtgaagatacaatcacctacaagtgcccgttccttaaacagaacgaacccgaagacattgattgttggtgcaattctacgagcacctgggttacatatggaacctgtacaaccacgggcgaacaccgcagagagaagcggtccgtggccctggtgcctcatgtcgggatgggactcgagacacgcaccgaaacatggatgtctagcgagggcgcgtggaagcacgctcagagaatcgaaacctggatcctgcggcatcccggctttaccattatggccgccatcctggcttacacaattgggacgacccacttccagcgcgtgctcatctttattctgcttacagccgttgctccttccatgaccatgagatgcatcggaattgccaaccgggacttcgtggagggcgtctctgggggaagctgggtggatatcgttctggagcacggctcctgtgtgacaaccatggcgaaaaataagcccacgctcgactttgaactgatcaaaacagaggccaagcagcctgctacccttcgcaaatattgcattgaagccaagctgaccaacacaaccacagatagcagatgtccgacgcaaggggagccctctctcaatgaagaacaggacaagcggttcgtctgcaaacattccatggtggatcgcggatggggcaacggctgtgggctgtttggaaagggcgggatcgtgacctgcgctatgttcacatgcaaaaagaatatgaaaggaaagattgtccagcctgagaacctggaatacaccatcgttattacaccccacagcggcgaggaacatgccgtggggaatgacaccggaaaacacggcaaggaggtgaagatcacgcctcagtcttccatcaccgaagcggagctcacaggctatgggaccgtcacaatggagtgtagccccagaaccggactggattttaacgaaatggtgcttctgcaaatggaggacaaagcctggctcgttcaccggcagtggttcctggaccttccgctgccttggctccccggcgctgatacgcaggggtctaattggattcagaaggaaacactggtgacctttaaaaaccctcatgccaagaaacaagacgtcgtggttctgggatcccaggagggcgctatgcacacagccctcaccggggccaccgaaatccagatgagctccggcaatctgcttttcacaggacatctgaagtgccgcctcagaatggataagctgcaacttaaaggcatgtcttacagcatgtgtacggggaagttcaaagtggtcaaggagattgctgagacccagcacggaacaatcgtgattcgggtccagtatgaaggcgacgggtccccctgcaaaatcccctttgagatcatggatctggaaaagagacatgtgctcggacgcctgattaccgttaaccctatcgtgacagagaaggaccggccggtcaacattgaggcggaaccccctttcggcgatagctacatcattatcggggtggagcccggccagctgaaactcaattggtttaagaaaggatcttccattggccaaatgttcgaaaccacgatgagaggggccaagcgcatggctatcctgggagacacagcctgggattttggcagccttgggggagttttcacctctatcggcaaagccctgcaccaggtgtttggggctatttacggcgccgcgttcagcggagtctcctggaccatgaagatcctcattggcgtgatcattacatggatcgggatgaactctcggagcacctccctgagcgtgtctctggttcttgtcggaatcgtgacactctatctgggcgtgatggtccaggctgactccgggtgtgtggttagctggaagaataaagagctgaagtgcggaaacggcatttttgtgacggataatgtccacacctggacagaacagtacaaattccaacctgagtctccctccaagctcgccagcgccatccagaaagctcatgaggaagggatttgtggcatcagatccgtgacccgcctggagaaccttatgtggaagcagattacaccggaactgaatcacatcctctctgagaacgaagttaaactgaccatcatgacgggagacattaagggcatcatgcaagtggggaagcggagcctgcaacctcagcccaccgagcttagatattcctggaaaacatggggaaaggccaaaatgctctctaccgagctgcataatcagacatttctgattgacggccctgaaaccgctgagtgccccaacacaaatcgcgcctggaacagcctcgaagtcgaggattacgggttcggagtgtttaccacgaatatctggctgaaacttcgggaaaaacaggacgttttctgtgattccaagctgatgagcgcggccattaaggacaacagagctgtgcacgccgatatgggctattggatcgagtctgctctcaatgacacatggaaaatcgagaaggcctccttcattgaagtcaaaagctgccactggcctaagtctcataccctgtggtccaacggcgtgctggagagcgaaatgatcattcccaaaaaccttgcggggccggtgtctcaacacaataaccgccctggatactatacccagacagccggcccctggcatctcgggaagctggagatggattttgacttctgtaagggaaccacggtcgttgtgacagaggattgcggcaatcgggggcccagcctgagaaccacaaccgcttccggaaaactcatcacagaatggtgctgtcggagctgcaccctgcctccgcttcgctacagaggcgaggacggctgttggtacgggatggaaattcggcccctgaaggagaaagaagagaacctcgtcaattctctggtcacggccggacacggccagatcgataacttttccctggggattcttggaatggctctcttcctggaggaaatgctgagaacccgcgtgggcacaaagcatgccatcctcctggttgccgtgagctttgtcacccttatcacagggaatatgtccttccgggacctgggaagagtgattgttatggtgggcgctaccatgacggatgacatcggcatgggggtcacatatctcgcgctgctggccgcttttaaagtgcgccctaccttcgccgccggacttctgctcagaaagctgacatctaaggagctcatgatgaccaccattggcatcgttctgcttagccaatcctctattcccgaaacaatcctggagctcacggacgctctggccctggggatgatgatccttaaaatggtgcggaacatggaaaagtaccagctggcggtcaccattatggctatcctctgcgtgcctaatgccgtgattctgcagaacgcctggaaagtcagctgtacaatcctcgctgttgtgtccgtgtctcccctgcttctgaccagctcccagcaaaaggccgattggattcctatcgcgctcacaatcaaaggactgaatcccaccgctatttttctgacgacacttagccgcacctctaagaaaagatcctggccgctgaacgaggccatcatggccgtcggcatggtgagcattctcgcttcttccctgctcaagaatgacatccctatgaccgggcccctggttgccggaggccttctgacagtgtgctatgtcctgaccggccggagcgctgatctcgagctggaacgcgccgcggacgtgaagtgggaggatcaggccgaaatttctgggtccagccctatcctttccattacaatcagcgaggacggatctatgagcatcaaaaacgaagaggaggaacagacgctgaccattctcatcagaacaggcctgctcgttgtgtccgggctgttccccgtctctgtgccgattaccgctgccgcttggtacctttgggaggtcaagaaacagcgggccggagtgctgtgggatgttccttctccccctcccgccggcaaggctgaactggaggacggggcgtatcgcatcaaacaaaagggcattctcggctactcccagatcggcgccggggtgtataaggagggaacatttcacaccatgtggcacgtcacgagaggcgctgtgctgatgcataaagggaagcggatcgaaccctcctgggccgatgttaaaaaggaccttattagctacggaggcgggtggaaactggagggagaatggaaggagggcgaagaggtgcaggtcctcgccctggagcctggcaagaatccgcgcgctgtgcagaccaaacccggactcttcaagacaaacaccggaacaatcggcgccgtgtccctggatttttctcctgggaccagcggatcccccattgttgacaaaaagggcaaagtcgtggggctttacggaaacggcgtggtcacaagaagcggcgcgtatgtgtctgctatcgcccaaacggaaaagtccattgaggataatcctgaaatcgaggacgacatcttccggaagagacgcctgaccattatggatctgcaccccggggccggaaaaacaaagcggtacctccctgctatcgttagagaagccattaaacgcggcctgcggacccttatcctggcgccgaccagagtggtcgctgccgagatggaggaagccctccgcgggctgcccgtgcggtatcagacccctgctattagagccgagcatacgggacgcgaaatcgttgacctcatgtgtcacgctaccttcacaatgcggctgcttagccccattagagtgcctaactacaatctgatcatcatggatgaggcccattttaccgaccccgcgtctattgccgctcggggctatatctccacacgcgtcgaaatgggggaggccgctggcattttcatgaccgccacgccgcctggaagcagagatccctttccccagtccaacgcccctatcatggacgaggaacgggagattcccgaacgctcttggaatagcggccacgagtgggtgacagatttcaaggggaaaaccgtttggtttgtgccttccatcaagaccggaaacgacatcgctgcgtgcctgagaaagaatggcaaacgggtcattcaactcagcagaaagacattcgattctgagtacatcaaaacccgcacaaacgactgggattttgtggtgaccacggacatttccgaaatgggggccaatttcaaggctcagcgggtcatcgacccgagacgctgtatgaaacccgttattctgacagatggagaggaacgggtgatccttgccggccctatgcccgtgacccacagctctgccgctcagagagggcgcgtcggccggaaccctaagaatgagaacgaccagtatatctacatgggagaacccctggagaatgatgaggactgcgcccattggaaagaagcgaagatgctcctggataacattaatacaccggagggcatcattcctagcatgtttgaacccgagagagaaaaggtggacgctatcgatggggagtaccgcctgagaggagaggcccggaaaaccttcgttgacctcatgcgcagaggcgatcttcctgtgtggctggcctataaggtcgctgccgaagggattaactacgcggaccggcgctggtgttttgatggaacgagaaacaatcaaatcctggaggaaaacgtggaggttgaaatttggaccaaagagggcgagcggaagaaactcaagcccagatggctggacgcccgcatctatgctgatcctcttgccctgaaggagttcaaagagttcgctgccgggcggaagtccctcacactgaatctgatcaccgaaatgggcagactccccacatttatgacccagaaagtgcgcgacgctcttgacaacctggccgtcctgcacacagcggaggccggaggcaaggcttacaatcatgccctcaacgagctgccggaaacccttgagacgctgctcctgctgacactccttgctaccgtgaccgggggaattttcctgtttctgatgtctggccgggggatcggaaaaatgacactcggcatgtgctgcattatcaccgccagcattctgctttggtatgcccagatccagcctcactggatcgctgcgtccattatcctggagttctttctcattgtcctgctgatccccgagcccgaaaagcaaagaacacctcaggataatcagctcacgtacgtggttattgccatccttaccgtggtggctgccacaatggccaacgagatgggcttcctggagaagaccaaaaaggacctggggctcggatctatcgtcacacagcaaccggaaagcaatattctggatatcgaccttcggcccgcttccgcctggaccctgtatgcggttgccacgacctttattacacctatgctccgccacagcatcgagaactcttccgtgaatgtgagcctgaccgctattgccaaccaggctacagtcctgatgggcctcgggaaaggatggcccctttccaagatggatatcggcgtgcctctgctggccattgggtgttactctcaggttaatcccatcaccctcacggcggccctgttccttctggtggctcattacgccatcattggacctggcctccaggctaaagccacaagagaagctcaaaagcgggccgcggccggcatcatgaagaacccgaccgtcgacgggattacagtgatcgatctggaccccattccttatgatcccaaatttgagaagcagctgggacaggtcatgctccttgtgctgtgcgttacccaagtgctgatgatgcgcaccacatgggctctctgtgaagccctgacgcttgctaccggccctgtcagcacactgtgggaggggaatcccggaagattctggaacaccacaatcgccgtgtccatggccaatatctttcggggctcttacctcgcgggggctggactgctgttcagcattatgaaaaacaccacgtccgcccgcagaggcacaggcaacatcggggagaccctcggagaaaagtggaaaagccggcttaatgctctgggcaagtctgagtttcagatttataaaaagtccgggatccaggaagttgaccgcaccctggccaaggagggaattaaaagaggcgaaacagatcaccatgccgtgagccgggggtctgctaagctcagatggttcgtcgagcgcaacctggtgaccccggagggaaaagtggttgaccttggctgcggcagaggcgggtggtcctactattgtggagggctgaagaatgtcagagaagtgaaagggctcacaaagggcgggcctggacacgaggaacccatccccatgagcacgtacggctggaacctggtgcgcctgcagtctggcgtcgatgttttctttatccctcccgagcggtgcgacaccctcctttgtgacattggggagagctccccttctccgacagtggaagccggaagaaccctgcgcgtgctgaatctcgtcgagaactggctgagcaataacacacaattctgcgtgaaggttcttaatccctatatgccttccgtgatcgagaagatggaggcgctgcagcggaagcatggcggggccctcgtcagaaaccccctgagccgcaattccacccacgaaatgtactgggtgtctaacgctagcggaaatattgtttcctctgtgaacatgatcagccggatgctgattaatagatttacgatgcgccacaaaaaggccacctacgagcctgatgtcgacctcggctccgggacacggaacatcggaatcgagtctgaaacccccaaccttgatattatcggcaaaagaattgagaagatcaagcaggaacatgagacaagctggcactatgaccaggatcatccgtacaaaacctgggcttatcacggctcctacgaaacaaagcaaaccgggagcgcctcttccatggtgaatggagtggtccgcctgctgacgaaaccttgggacgttgtgcccatggtgacacagatggcgatgaccgataccacacctttcggccagcagagagtctttaaggagaaagtggacacgcggacccaagagcccaaggaagggacaaagaaactcatgcgcattaccgccgagtggctgtggaaggaacttggcaaaaagaaaacacctagaatgtgtacccgggaggagttcacaaagaaagttagaagcaacgctgccctgggcgctatctttaccgatgagaataagtggaagtctgcccgggaggctgtgggggacggacgcttctgggaactcgtcgataaagagagaaacctgcacctggaaggcaagtgcgagacgtgtgtgtataatatgatgggcaaacgggagaagaaactcggggaatttggaaaggccaagggctcccgcgcgatttggtacatgtggctgggggccagattccttgagtttgaagctctgggattcctcaacgaggaccattggtttagccgggaaaattctctgtccggcgttgagggggagggccttcacaaactgggatatatcctccgcgaagtgagcaagaaagagggcggggccatgtacgctgacgataccgccggatgggacacaagaatcaccattgaagatctgaagaacgaggaaatgatcacaaatcatatggagggcgagcacaaaaagctggccgaagcgattttccggctcacctaccagaacaaggtcgtgcgcgttcagagacccacgccgcgggggacagtgatggacatcatttcccgcagagatcaacggggaagcggccaggtcgggacctatggcctgaatacattcaccaacatggaggctcagcttatccgccagatggaaggagagggcgtgtttaaatctatccaacatctgacggccgccgaagagattgctgtccagaattggctcgtgagagttgggcgggagagactgagccgcatggccatctccggagacgattgcgtggtcaagcctcttgacgatcggttcgctagagccctgaccgcgctcaacgacatgggcaaagtgcgcaaggatattcagcagtgggaaccctctcgggggtggaatgactggacacaagtgcccttttgcagccaccacttccatgagctgatcatgaaagatggacgcattctggttgtgccttgtagaaaccaggacgaactcatcggccgggccagaatctcccagggggctggctggtctctgcgcgagaccgcctgccttggaaagagctacgctcagatgtggtccctgatgtattttcaccggagagacctccgcctggccgcgaacgccatttgttctgctgtcccgagccattgggtgcccacatcccggaccacatggagcatccacgcctctcacgagtggatgaccacggaagatatgcttacagtttggaatagagtgtggattcaagagaacccttggatggaagacaagacccccgtcgagtcctgggaagagatcccttacctgggcaaacgggaggatcagtggtgcgggagcctcattggactgacctctagagctacatgggccaagaatatccagaccgctattaaccaggtgcgctccctgatcggcaatgaagagtatacagactacatgcccagcatgaaacggttcagacgcgaagaggaagaggccggggtcctctggtga

SEQ ID NO: 20300 - RNA, 9876 nt, synthetic construct
  misc_feature 1..9876: note = derived and/or modified CDS sequence (opt5) from DENV-2__KF479233__SS-prME
  source 1..9876: mol_type = other RNA
accgccggcgtcatcattatgctgatccccaccgctatggccttccacctcacgaccagaaacggggaacctcatatgattgtcagccggcaggaaaagggaaaatccctgctttttaagacagaggacggcgttaatatgtgcaccctgatggcgatggatctcggggaactgtgtgaggacaccatcacctacaactgcccccttctgagacaaaatgaacccgaggatattgactgttggtgcaactctacaagcacctgggtgacgtatggaacctgtacagctaccggcgagcacagacgggaaaaacgctccgtggccctcgtccctcatgtggggatgggactggagacaagaaccgaaacgtggatgtctagcgagggcgcctggaagcacgctcagcggatcgagacatggatcctgcgccatcccggcttcaccattatggccgctatcctcgcctacacaattgggaccacctattttcagagagttctgatcttcattcttctgacagcggtggccccttccatgacgatgcggtgcatcggaatttctaatcgcgattttgtcgaaggcgtgagcgggggatcctgggttgacatcgtgctcgagcacggcagctgtgtcaccacaatggctaaaaacaagcccaccctggatttcgaacttatcaagacagaggccaaacagcctgctaccctgagaaagtactgcattgaagccaaactcacgaatacaaccaccgcgtctcggtgtccgacacaaggggagccctccctgaacgaggaacaggacaagcgctttgtgtgcaaacacagcatggtggatagaggatggggcaatggctgtgggctgttcggaaagggcgggatcgtgacctgcgccatgtttacatgcaagaaaaacatggagggaaagattgttcagcctgaaaatctcgagtatacgatcgtggtgacaccccattctggcgaagagaacgctgtcgggaatgacacaggaaaacacggcaaggagattaaagtgacccctcagtccagcatcacagaagccgagctgaccggctacgggacggttaccatggaatgttctccccggacaggacttgatttcaacgagatggtgctgctccaaatggaaaataaggcttggctggtccatcgccagtggtttcttgacctgccgctcccttggctgcccggcgccgatacccaggggtccaactggatccagaaagagacactggtgaccttcaagaaccctcacgccaagaaacaagacgttgtggtcctcggaagccaggagggcgctatgcacacggcgctgacaggggccaccgaaattcagatgtcctctggcaatcttctgtttacaggacatctcaagtgcagactgcggatggacaaacttcaactgaagggcatgagctattccatgtgtaccgggaaattcaaggtggtcaaggagatcgctgaaacccagcacggaacaattgtggttagagtgcagtacgagggcgatgggagcccctgcaaaatccccttcgagattatggacctcgaaaagcgccatgtcctgggacggctgatcacggtgaaccctatcgttaccgagaaagattctccggtgaatattgaagccgagcccccttttggcgactcctacatcattatcggggtcgaacccggccagctcaagctgagctggttcaaaaagggatctagcattggccaaatgtttgagacaaccatgagaggggccaagcgcatggctatccttggagatacagcctgggacttcggctccctcggaggggtgtttacctctattggcaaagcgctccaccaggtgttcggggctatctatggcgccgcctttagcggagtttcctggacgatgaagatcctgattggcgtcgtgatcacatggattgggatgaacagccggtctacctccctgagcgtgtctcttgtcctcgtgggagttgtgaccctgtacctgggcgtcatggtgcaggctgattccgggtgtgttgtgagctggaaaaataaggagctcaaatgcggatccggcatcttcattacagacaacgtccatacctggacagaacagtataagtttcaacctgagtctcccagcaagctggcctccgctatccagaaagcccacgaagaggggatctgtggcattagatctgtgacgcgccttgaaaatctgatgtggaagcagatcaccccggagctcaaccacattctgagcgagaatgaagttaaactgacaatcatgaccggagatattaagggcatcatgcaggcggggaaacggtcccttagacctcaacccacagagctcaagtacagctggaaaacctggggaaaggccaagatgctgtctacggaacctcagaaccagaccttcctgatcgacggccccgagacagctgaatgccctaataccaaccgcgcctggaactccctcgaggtggaggattatgggtttggagtcttcacaaccaacatttggctgaaacttaaggaacggcaggacgtgttttgtgacagcaaactgatgtctgctgccatcaaggataatagagcggtgcatgccgacatgggctactggattgagtccgctctcaacgatacatggaaaatcgaaaaggccagcttcattgaggtcaagtcttgccactggcccaaaagccataccctgtggtccaacggcgttctggagagcgaaatgatcatcccgaagaatttcgctgggcctgtgtctcaacacaactatcgccccggataccacacgcagacagccggcccctggcatcttgggaaactcgagatggactttgatttctgtgaaggaaccaccgtggtcgtgacagaggactgcggcaatcgggggccttccctgagaaccacgacagccagcggaaagctgattaccgaatggtgctgtcggtcctgcacactcccgcccctgcgctacaaaggcgaggatggctgttggtatgggatggagatcagacctcttaaggaaaaggaggaaaacctggttaattctctcgtgaccgctggacacggccagattgacaactttagcctgggggtcctgggaatggcgcttttcctcgaggaaatgctgcggacaagagtgggcaccaaacatgccgttctgctcgtggctgtctcctttatgacgctgatcaccgggaatatgtctttccgcgatcttggacgggtgatggttatggtgggcgccgccatgacagacgatattggcatgggggtcacctacctggctctcctggccgcgtttaaggtgagacccacattcgctgccggactgcttctgcgcaaactcaccagcaaggagctgatgatgacgacaatcggcattgtgctcctgtcccaatctaccatccctgagacaatccttgaactgaccgacgccctcgctctggggatgatgattctgaaaatcgtcagaaacatggagaagtatcagcttgccgttaccattatggcgatcctgtgcgtgcccaatgctgtgattctccagaacgcctggaaggtcagctgtacaatcctggccgtggtttccgtgagccctctcctgcttacgtcttcccagcaaaaagctgattggatccccctggccctcaccattaagggactgaatccgacagctatctttctgaccacacttagccggaccaacaaaaagcgctcttggcctctgaatgaagccattatggcggtcggcatggtgtccatcctcgccagctctctgctcaaaaacgacattcccatgacggggcctctggttgctggaggccttctgacagtgtgctacgtcctgaccggcagatccgccgacctcgagctggaacgggctgccgatgtgcgctgggaggaccaggccgagatcagcgggtccagccccatcctttctattaccatcagcgaagatggatccatgtctattaagaatgaggaagaggagcagacactgaccatcctcattagaacaggcctgctcgtcatcagcgggctgttcccggtgtccattcctatcacggctgcggcctggtatctttgggaagttaaaaagcagcgggctggagtgctgtgggacgtcccctctcctccgcccgtgggcaaggccgagctggaagatggggcctaccgcatcaaacaaaaggggattctgggctatagccagatcggcgctggggtttacaaagagggaacctttcacacaatgtggcatgtgaccagaggcgccgtcctgatgcacaaggggaaacggattgaaccttcctgggcggacgtgcgcaaggatcttatctcttacggaggcgggtggaagctggagggagagtggaaagaaggcgaggaagtgcaggttctcgctctggagccgggcaagaaccccagagccgtccagacaaaacctggactcttcaagaccaacacgggaaccattggcgccgtgagcctggacttttcccccgggacaagcggatctcctatcgtggataaaaagggcaaggtcgtggggctttatggaaatggcgttgtgacccggtccggcacatacgtcagcgctatcgcccaaaccgaaaaatctattgaggacaaccccgagatcgaagatgacattttcagaaagaaacgcctgacaatcatggatctgcaccctggggcgggaaagacgaaacggtatctcccggctattgtgagagaggccatcaagcgcggcctgcggacccttatcctggcccccacaagagttgtggctgccgaaatggaggaagctctccgcgggctgcctattcggtaccagacccccgccatcagagcggagcataccggacgcgagattgtcgacctcatgtgtcacgccacattcacgatgcggctgctttcccctgtgagagttcccaattataacctgatcattatggacgaagctcattttaccgatccggccagcatcgctgcccggggctacatttccacacgcgtggagatgggggaagccgctggcatcttcatgaccgcgacacctcccggatctagagacccctttcctcagagcaatgcccccatcatggatgaggagcgggaaattcctgagcgctcctggaacagcggccacgaatgggtcaccgacttcaaggggaaaacggtgtggtttgtgccgtctatcaaggctggaaatgatattgccgcctgcctgcgcaaaaatggcaagaaagtcatccaactctcccggaagacattcgacagcgagtatattaagaccagaaccaatgattgggactttgttgtgacaaccgatatctctgaaatgggggctaacttcaaagccgagcgcgtgatcgacccccggagatgtatgaagcctgtcattctgacagatggagaggaacgcgtgatccttgcgggccccatgcctgttacccatagctccgctgcccagcggagagggcgcattggccggaatcccaaaaacgagaatgaccagtacatctacatgggagaaccgctggagaacgacgaagattgcgcccactggaaggaggctaaaatgctcctggacaatattaacacgcctgagggcatcatcccctctatgtttgaacctgagagagaaaaggtggatgccattgacggggagtatcgcctgagaggagaagcgcggaaaacattcgtcgagctcatgcgcagaggcgatcttcccgtgtggctggcctaccgggttgctgccgaggggatcaactatgctgaccgcagatggtgttttgatggaattaagaataaccagatcctggaagagaatgtggaagtcgagatttggaccaaggagggcgagaaaaagaaactcaagcctcggtggctggacgccagaatctacagcgatccccttgctctgaaagagttcaaggagttcgccgcggggcgcaagtccctcacaatgaacctgattaccgagatgggccggctgccgacgtttatgacccaaaaagccagaaatgctctcgacaaccttgccgtgctgcacacagctgaagccggaggccgcgcctataatcatgctctgtctgagctccctgagaccctggaaacacttctgctcctgaccctgctcgcgacagtcaccgggggaatcttcctttttctgatgagcggcaaggggatcggaaaaatgacgctgggcatgtgctgcattatcacagcctccattctcctgtggtacgctcagatccagccccactggattgccgccagcatcatccttgagttctttctgattgtgctcctgatccccgaacctgagaagcagcggaccccgcaagataaccagctgacctatgttgtgattgctatcctcacagtggtcgccgcgaccatggccaatgaaatgggcttccttgagaaaacaaagaaggactttgggctgggatctattgttacgcagcagcccgagtccaacatcctggatatcgacctcagacctgctagcgcctggaccctgtacgctgtggccacaaccttcattacacccatgcttcggcattccatcgaaaattctagcgtgaacgtctccctgaccgcgattgccaatcaagctacggtgctcatgggcctggggaaaggatggcctctgtctaagatggacatcggcgttcccctccttgccattgggtgttacagccaggtgaaccctatcaccctgacagctgccctgctcctgcttgtcgctcactatgccattatcggaccgggcctgcaggcgaaagccacccgcgaggctcagaagagagccgctgccggcatcatgaaaaatcccacagtggatgggattaccgtcatcgacctcgatcctattccctacgaccctaagtttgaaaagcaactgggacaggtgatgctgctcgttctttgcgtgacgcaggtcctgatgatgcggacaacctgggccctgtgtgaggcgctcacactggctaccggccccatctccaccctttgggaagggaacccgggacgcttctggaatacaacgattgccgtgagcatggctaacatctttagaggctcttatctggccggggccggactcctgttctccatcatgaaaaacaccgctaatacacggcgcggcaccggcaacacaggggagaccctgggagagaagtggaaaaatagactcaacagccttggcaagtctgaatttcaaatttacaaacggtccgggatccaggaggttgatcgcacgctggccaaggaaggaattaaaagaggcgagacagaccaccatgcggtgagccgggggtctgccaagctgagatggttcgtcgagcgcaatctcgtgacccctgaaggaaaggtgatggatctgggctgcggcagagggggatggagctattactgtggcgggcttaaaaacgttcgggaggtcaagggactgaccaaaggcgggcccggacacgaagaacccatccctatgtccacatatggctggaatctcgtgcgcctgcagtctggcgtggacgtcttctttacaccccctgaaaagtgcgatacactgctctgtgacattggggagagctccccgaaccccacggttgaggctggacggacccttagagtgctgaatctggtggaaaactggctcaataacaatacacagttctgcatcaaagtcctgaacccttacatgcccagcgtgatcgagaagatggaaacccttcaacgcaagtacggcggggccctggttcggaatcctctctccagaaactctacacatgagatgtattgggtgagcaacgcttccggaaatattgtctctagcgtgaacatgatctcccgcatgctgattaatcggtttaccatgagacacaaaaaggccacgtacgaacccgatgttgacctgggctctgggacccgcaacatcggaattgagagcgagatcccgaatctcgatatcattggcaaacggatcgaaaagattaaacaggagcatgaaacatcctggcactatgaccaggaccacccttacaagacctgggcgtatcatggcagctacgagacaaagcagaccgggtctgcctccagcatggtgaacggagtcgtgagacttctgacaaaaccctgggatgtgatccctatggtcacccaaatggctatgacggacacaacccccttcggccagcagcgcgtttttaaggaaaaagtggataccagaacacaggagcctaaggaggggacgaaaaagctgatgaagattaccgccgaatggctctggaaagagctgggaaagaaaaagacaccccggatgtgtacccgcgaagagttcacaagaaaagtgcggtctaatgctgcccttggcgctatctttaccgacgagaacaagtggaaatccgccagagaagcggtcgaggatagccggttctgggaactggtggacaaggagcgcaatctccacctggaagggaagtgcgagacatgtgtttataacatgatgggaaaaagagagaagaaaattggcgaatttggcaaggccaaagggtctcgggctatctggtacatgtggctgggagcccgcttcctcgagtttgaagctctgggcttccttaatgaggatcattggttttccagagaaaacagcctgtccggggtggagggagagggcctccacaagctggggtacatccttcgggaagtcagcaagaaagagggcggagccatgtatgccgacgataccgcgggctgggacacgcgcattaccctggaagatctcaagaatgaggaaatggtgacaaaccacatggagggggagcataaaaagctggctgaagccatcttcaaactgacctaccaaaataaggttgtgagagtccagcggccgacacctcgcggaaccgtgatggacattatctctagacgggaccagcgcggcagcgggcaagttggaacgtatggcctcaacacattcaccaacatgggggcccagctgattagacagatggagggcgaaggagtgtttaagtccatccagcaccttacaaccacggaggaggtcgctgtgcaagattggctggcccgggtcggccgcgaaagactctctcggatggctatcagcggggacgattgcgtggttaaacccctggacgatagattcgcctccgcgcttaccgccctgaatgacatgggaaaggtgcgcaaagatattcagcagtgggagccctctcggggctggaacgactggacacaggtccctttttgcagccatcacttccatgaactcatcatgaaggatgggagagtgctggtggttccgtgtcgcaatcaagacgagctgattggacgggctagaatctcccagggcgccgggtggtctctccgcgaaaccgcttgcctgggcaaaagctacgcccagatgtggtcccttatgtattttcaccggagagatctgcgcctcgcggccaacgctatttgtagcgccgtgccctctcactgggtccctacatcccggaccacatggagcatccatgctagacacgagtggatgaccacggaggacatgctgacagtgtggaatcgcgtttggatccaggaaaacccctggatggaggataagacccctgtggaatcttgggaggaaattccctaccttggaaagcgggaggaccaatggtgcggctccctgatcgggctcaccagcagagccacatgggctaaaaatattcagaccgccatcaaccaggtccggtccctgattggatctgaggaatatacagactacatgcctagcatgaagagattccgccgggaggaagaggaagcgggcgtgctgtggtga

SEQ ID NO: 20301 - RNA, 9876 nt, synthetic construct
  misc_feature 1..9876: note = derived and/or modified CDS sequence (opt5) from DENV-2__KX372564__SS-prME
  source 1..9876: mol_type = other RNA
acagccggaatcattatcatgatgattcccacagtgatggctttccacctgacgaccagaaacggggagcctcatatgatcgtcagccggcaagaaaaggggaaaagcctcctgtttaagacagagaatggcgttaacatgtgcacccttatggccatggacctgggggaactctgtgaggatacaattacctacaattgcccgctgcttagacaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcacagagaacgaagtgaaactgaccatcatgacaggagacatcaagggcattatgcaggccgggaaacggagcctgagacctcagcccaccgagcttaagtactcctggaaagcgtggggaaaggccaaggttctcagcacggaactgcacaatcataccttcctgatcgatggccctgagacagctgaatgccccaacaccaatcgcgcctggaactctctcgaggtggaggactatgggtttggagtcttcacaaccaatatttggctgaaacttaaggaacggcaagatgtgtcctgtgacagcaaactgatgtctgctgccatcaaggacaacagagcggtgcacgccgatatgggctactggattgagtccgctctcaacgacacatggaaaatcgaaaaggccagctttatcgaggtcaagtcttgccactggcctaaaagccataccctgtggtccaatggcgttctggagagcgaaatgattatccccaagaacttcgctgggccggtgtctcagcacaattatcgccctggataccatacgcagacagccggcccctggcaccttgggcggctcgagatggatttcgacttttgtgaaggaaccaccgtggtcgtgacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggttaactctctcgtgaccgctggacatggccagattgataatttcagcctgggggtcctgggaatggcgctttttctcgaggaaatgctgcgcacacgggtgggcaccaagcacgccatcctgctcgttgctgtgtccttcgtcacgctgattaccgggaacatgtcttttagagaccttggacgcgtgatggttatggtgggcgccacaatgaccgatgacatcggcatgggggtcacatacctggccctcctggctgccttcaaggtgagacctacctttgcggctggactgcttctgcggaaactcacgagcaaggagctgatgatgacaaccatcggcattgtgctcctgtcccaatctacaatccccgagaccattcttgaactgaccgatgccctcgccctggggatgatggtcctgaaaatcgttcgcaatatggagaagtatcagcttgctgtgacaattatggccatcctgtgcgtgcctaacgcggtcatcctccagaatgcttggaaagtgagctgtacggccctggccgttgtgtccgtcagccccctcctgcttacctcttcccaacagaagacagactggattcctctggctctcaccatcaagggactgaaccccacagccattttcctgaccacgcttagcagaacatctaaaaagcggtcctggccgctgaatgaagctatcatggccgtgggcatggttagcattctcgcgtcttcctttctgaaaaacgatatccctatgaccgggcccctcgtggccggaggcctgcttaccgtctgctacgtgctgacaggccgcagcgctgacctggagctcgaaagagccgctgacatccggtgggaggagcaggccgaaatttccgggagctctcctatcctgagcattaccatctccgaggatggatctatgagcattaagaatgaagaggaggaacagacacttacgatcctgattcgcaccggcctcctggtcatctccggactcttccccgtgtctatcccgattacagccgctgcgtggtatctgtgggaggttaaaaagcaaagagccggagtgctttgggacgtcccttctccccctcccgtgggccgggctgaactggaggatggggcctaccgcatcaaacagaagggcattctgggctattcccagatcggcgccggggtttacaaggaaggaacctttcacacaatgtggcatgtgaccagaggcgctgtcctcatgcacaaagggaagcggattgagccctcctgggccgacgtgaaaaaggatctgatcagctacggaggcgggtggaaacttgagggagaatggaaggagggcgaagaggtgcaggttctggcgctcgaacctggcaagaacccgagagctgtccaaacgaaacccgggctgttcaagaccaacacaggaaccatcggcgccgtgtccctcgactttagccctgggacatctggatcccccattgtggataaaaagggcaaagtcgtggggctgtatggaaatggcgttgtgacccgcagcggcacatacgtctctgccatcgctcagacggagaagtccattgaggacaaccctgaaatcgaggatgacattttccggaagaaaagacttaccatcatggatctgcatcccggggccggaaagacaaaacgctatctgcctgcgatcgtgcgggaagctattaagagaggcctccgcaccctgatccttgccccgacccgggttgtggccgctgagatggaagaggccctgagagggctccccattcgctaccagacccctgctatccgggccgagcacacgggaagagaaattgtcgacctgatgtgtcatgcgaccttcacaatgcggctcctgagccccatccgcgtgcctaattataaccttattatcatggatgaggcccactttaccgaccccgcttccatcgccgctagaggctacatttctacacgggttgaaatgggggaggccgccggcatcttcatgaccgctacgccgcctggaagccgcgacccctttccccagtccaatgcgcctattatggatgaggaaagagagatccccgaacggagctggaactctggccacgagtgggtgacagacttcaaagggaagaccgtctggtttgtgccttccattaaggccggaaatgatatcgctgcctgcctgcgcaagaacggcaagaaagtgatccaactgagccgcaagaccttcgactctgaatatattaaaacacggaccaatgattgggactttgtcgttacaaccgatatcagcgagatgggggccaacttcaaggctgagagagtgattgacccgcgccggtgtatgaagcccgtgatcctcacggatggagaagagagagtcattctggccggccctatgcccgtgacacattcctctgcggctcagcgccgggggagagttggccgcaatcctaaaaacgaaaatgaccagtacatctacatgggagagccccttgaaaacgatgaggactgcgcccactggaaggaggccaaaatgctgctcgacaatatcaacaccccggaaggcattatccctagcatgtttgagcccgaaagagagaaggtggatgctattgacggggaatatcggctgcgcggagaggccagaaaaacattcgtcgatctgatgcggcgcggcgacctccctgtgtggcttgcgtacagagttgccgctgaggggatcaactatgccgatcggagatggtgttttgacggagtgaagaataaccaaattctggaagagaatgtcgaagtggagatctggaccaaagagggcgaacgcaagaagctgaaaccccggtggctcgatgctagaatttactccgaccctctggcccttaaggagttcaaagagttcgctgccgggcgcaagtctctgacgctcaacctgatcaccgagatgggccggctgcccacatttatgacccagaaagcgagaaatgccctcgataaccttgctgtcctgcatacagccgaagctggaggccgggcctataatcacgccctgagcgagctcccggagaccctggaaacacttctgctcctgaccctgctcgctacggtgacagggggaatcttcctttttctgatgtccggcaaggggattggaaagatgaccctgggcatgtgctgcatcgttaccgcgagcattctcctgtggtacgcccagatccagcctcactggattgctgcctctatcatccttgagttctttctgattgtgctcctgatccccgaacccgagaaacaacgcacacctcaggacaaccagctgacctatgtggtcattgccatcctcacagttgtggctgccacgatggcgaatgaaatgggcttccttgagaagaccaaaaaggattttgggctgggatccattacaacccagcaaccggagagcaacatcctggacatcgatctcagacccgcctccgcttggacactgtacgccgtggctaccacgttcattacccctatgcttcggcattctatcgaaaatagctccgtcaacgtgtctctgacagccattgcgaatcaggccaccgttctcatgggcctggggaaaggatggcccctgagcaagatggacatcggcgtgcctctccttgctattgggtgttactcccaggtcaaccccatcacactgaccgccgctctgctcctgcttgtggcccactatgctattatcggacctggcctgcaggccaaggcgacgcgcgaggcccagaaaagagctgccgctggcatcatgaagaatccgacagtcgacgggattaccgtgatcgatctcgaccccattccttacgatcccaaatttgaaaagcagctgggacaggttatgctgctcgtgctttgcgtcacacaggtgctgatgatgcggaccacctgggccctgtgtgaggccctcacactggcgacgggccctatcagcaccctttgggaagggaaccccggacgcttctggaatacaaccattgctgtttctatggccaacatctttagaggctcctatctggctggggccggactcctgttcagcatcatgaaaaacacagccaatacccggcgcggcacgggcaacacaggggagaccctgggagagaagtggaagaatagactcaacgctcttggcaaatctgaatttcaaatttacaagaaatccgggatccaggaggtggaccggaccctggccaaggaaggaattaaaagaggcgagacagatcatcacgcggtcagccgcgggtctgccaagctgcggtggttcgtggagagaaatctcgtgaccccggaaggaaaagttgtcgacctgggctgcggccgcgggggatggagctattactgtggcgggcttaagaacgtgaaggaggtgaaaggactgacaaagggcgggcctggacatgaagaacccatccccatgtccacgtatggctggaatctcgtccggctgcagtctggcgttgatgtgttctttacccctcccgaaaaatgcgacacactgctctgtgatattggggagagctcccctaacccgaccgtggaggctggaagaacacttcgcgtcctgaatctggtggaaaactggctcaataacaatacccaattctgcatcaaggttctgaacccctacatgcctagcgtgatcgagaaaatggaagcccttcagcggagatacggcggggctctggtccgcaatcccctctcccggaactctacgcacgagatgtattgggtgagcaacgcctccggaaatattgtttctagcgtgaacatgatctccagaatgctgattaatcgctttaccatgcggcacaagaaggcgacatacgaacctgacgtcgatctgggctctgggaccagaaacatcggaattgagagcgaggtgcccaatctcgacatcatcggcaaacgcattgaaaagatcaaacaggagcatgaaacatcctggcactatgatcaggaccatccgtacaagacctgggcctatcacggcagctacgagacaaaacaaaccgggtctgcttccagcatggtgaacggagtcgttagacttctgacgaagccttgggacgtgattcccatggtgacacagatggccatgaccgataccacacctttcggccagcagcgggtctttaaggaaaaagtggacacgcgcacccaagagcccaaggaggggaccaaaaagctgatgaaaatcaccgctgaatggctctggaaggagctgggaaagaaaaagacacctagaatgtgtacccgggaagagttcacaagaaaagttcggtctaatgccgctcttggcgccatttttaccgatgagaacaagtggaaatccgcgcgcgaagccgtggaggacagcgggttctgggaactggtcgataaggagagaaatctccacctggaaggaaaatgcgagacgtgtgtgtataacatgatgggcaagcgggagaagaaactgggcgaatttgggaaggctaaaggatctcgcgccatctggtacatgtggctcggcgctagattcctggagtttgaagcccttgggttcctgaatgaggaccattggttttcccgggaaaacagcctctccggagttgagggcgaggggctgcacaaacttggctacattctgcgcgatgtgagcaaaaaggaaggaggcgccatgtatgcggacgataccgctgggtgggacacaagaatcaccctcgaggatctgaagaatgaagagatggtcacaaaccatatggaaggagagcacaaaaagctggccgaggccatcttccggctcacctaccagaataaagtggttcgcgtgcagagacccacgccgcggggcacagtcatggacattatctctcgcagagaccagcgggggagcggacaagtggtcacctatggcctgaacacattcaccaacatggaagctcagcttattcgccagatggagggggaaggcgtgtttaagtccatccaacatctgacggccaccgaggagattgctgttaaaaattggctcgtgagagtcggacgggaaagactgtctcgcatggccatcagcggcgatgactgcgtggtgaagcctttcgatgaccggtttgcgaacgcccttacagctctgaatgatatggggaaggttagaaaagacatccagcagtgggagccctcccgcggatggaacgattggacccaggtgcccttctgctctcaccactttcatgaactcattatgaaggacggccgggtcctggtggttccttgtagaaatcaagatgagctgatcgggcgcgcccggattagccagggagctggctggtccctcagagaaacagcctgcctggggaaatcttacgcgcagatgtggagccttatgtatttccaccgccgggacctgagactcgccgctaacgccatctgttccgctgtgccgagccattgggtccccacctctcgcacaacctggtccattcacgccacgcacgagtggatgacaaccgaggatatgctgaccgtgtggaatcgggtctggatccaggaaaacccttggatggaggacaagacacccgtggaaagctgggaggaaatcccttaccttggcaaaagagaggatcaatggtgcggatctctgattggcctcacctcccgggctacatgggccaagaatatccagacggcgattaaccaggttagaagcctgatcgggaatgaggaatataccgactacatgccctccatgaagcgctttcggagagaggaagaggaagccggagtgctgtggtga

SEQ ID NO: 20302 - RNA, 9873 nt, synthetic construct
  misc_feature 1..9873: note = derived and/or modified CDS sequence (opt5) from DENV-2__KX274130__SS-prME
  source 1..9873: mol_type = other RNA
agcgccgctaccctgctcctgcttgtgcccacaatcatggccttccacctgacgaccagaaatggcgaacctcacatgattgtcgcgcggcacgaaaaggggaagtccctcatcttcaagacagagaatggagttaacatgtgcaccctgatggctatggaccttggcgaactgtgtgaggaaacagtgacctacaagtgcccctatctcaagcagtctgagcccgaggatattgactgttggtgcaatacaaccagcacgtgggtgacctacgggacatgttcctctagcggagaacatcgcagagagaaacggtccgtcgccctggcccctcacgtgggcatggggctggaaacccgcacagagacctggatgtctagcgagggagcttggaagcatgcccaaagaatcgaaaactggattctccggcaccccggctatacggttatggctgccgcgatcgccatggctatcggcacaaataacttccagcgcgccctgatttttgtgcttctgaccgctgtcgccccttccatgacaatgagatgcgtggggatcgcgaatcgggatttcgttgagggagtgagcggcgggtcttgggtcgacattgtgctcgaacacggatcctgtgtgaccaccatggccaagaacaaacccacactggattttgagcttacgaagaccgaagctaaactgcctgccacactccgcaagtactgcatcgaggctaaactgaccaatacaaccacggagagcagatgtccgacacagggcgaaccctctctgcctgaggaacaggacaagcggttcatttgccgccattccctcgtcgatagagggtggggaaacggctgtggcctgtttgggaagggaggcatcgttacctgcgccatgtttacctgcaaaaagtatatggaggggaaaattgtgcaacccgaaaatcttgagtacacagtggccgtcacccctcacagcggagaggaacattctgtgggcaacgacacagggaagcacggacaggatgttaaaatcacgccccagtccagcatcaccgagacagctctggaaggctatggctccatttctatggagtgtagcccgcggaccgggctcgactttaatgaaatggtgctgcttcagatggaggataaggcgtggctggtccaccgccaatggttcctcgacctgcctctgccctggctccctggatccgatacacagggcagcaactgggtgcagaaagagaccctggttacgtttaagaatccccatgccaagaaacaggacgtggtcgtgcttgggtctcaagaaggagctatgcactccgccctgaccggcgccacagagatccagatgaccagcgggaacctcctgttcacaggccatcttaagtgcagactgcggatggacaaactcgaactgaagggaatgtcttacagcatgtgtaccggcaaatttaaggtcgtgaaggagattgctgagacgcagcacgggacaatcgttattagagtgcaatacgaaggagagggctccccctgcaaaatccctttcgaaatcatggatctggagaagaaacatgtcctcgggcgcctgattaccgtgaacccgatcattacagaaaaggacaaacccaccaatatcgaggccgagcctcccttcggagattcttatattcttatcggcgttgaacctgggcagctgaagatgaactggtttaagaaaggcagctccatcggacagatgttcgagaccacaatgcggggcgcgaagagaatggctattctcggggacacggcctgggattttggaagcctgggcggggtgttcaattctatcggaaaagccctgcaccaggtctttggcgctgtgtacaacgccgctttctccggggtgagctggaccatgaagattcttatcggcgttattatcacatggattggaatgaactctcgctccaccagcatgtccatcacactcgtcatggtgggcctggtgaccctgtatctcggggtcgtggttcaagccgactctggatgtgtggtcagctggaaaacgaaggaactgaagtgcggctccgggatctttgtgacagataacgttcacgtgtggaccgagcagtacaaattccagcccgaatctccggcgaaacttgccgctgccattaaaaaggctcatgaggagggagtctgtggcatccggagcgtgaccagactggaaaatattatgtggaaacagatcacacctgagctcaaccacattctgaccgaaaatgacgttaaggtgacaatcatgacgggggatatcaaaggcattctgcaacagggacgccgggcccttagaccccagcctaccgagctcaagtattcctggaaaagctggggcaaatctaagatcgtctccagcgaaacacataaccagacctttctgattgacgggcccgagacaaccgagtgccctgatacgaatcgcgcgtggaactctctggaagtggaggactacggattcggcctcttttccaccaatatctggctgcggcttagagaaaaacaagacacactgtgtgatagcaagctcatgtctgccgctgtgaaagacgagcgcgccattcacgctgatatggggtattggatcgagagcaagctgaacggatcctggaagatcgaaaaagccagcttcctggaggtcaagtcttgcacctggccccggtcccacacactttggagcaatggcgttctcgaatccgagatgattatcccgaaaaacctgggcgggcctgtgtctcagcataactacagacccggatactatacccagacaaccggcccctggcacctggggaagctcgaaatggactttgattactgtgagggaacgacagtgattgtcaccgaggaatgcaataaccggggccctagcctgcgcaccacaaccgcctccgggaaacttatcacggagtggtgctgtagatcttgcacaatgccgcccctgcggttcaagggagaagacggctgttggtatggcatggagattagacctctcaaggaaaaagaggagaatctggtgaacagcctggttaccgctgggcatggacagatcgataatttctcccttggcatcctcgggattgcgctgtttctggaagaggtgatgaagtctcgcatcggaattaaacacacaatcggcatgaccattatcacattcctcctgcttgtcaccgggaacgtgagctaccgggacctgggaagagttattctcatggtgggctccacgatggccgatgaaatgggcatgggggtcacctatctggctctgcttgccacatttcgcatcagacccaccttcgccctggctctcatgatccggaagctgacaagcaaagagctcctgatggccaccattggaatcgtgcttattgcgcaatgcgacgttcctggcacgatcctggaaattacagatgcttgtgccctcgggctgatgctgcttaagatgacccgcgagctggagagataccagctcgccgtgacactgctctctctgacctgcatccccaatgctaccatcatgtggggagcctggaaggtcacatgtacgattcttaccctggtgtccatggcgcctctctttctgacaaccagccggcagaaaacagactgggtgcccgtcgctctgtctatctatggccttaacccgaccgccatttacttcacgacactggccaaggctaaaaagatccgctcctggcctctcaatgaagccgttatggctgtggggatggtgagcattctggcctcttccctcctgagaaacgatatccccatggcgggacctcttgtcgccggcggcctgctgaccctctgctacgtgctgaccgggcggagcgctgaccttgagctggaaaaatccgccgacatcaagtggaatgatgacgctgagattagcggatctagccccatcattaacgttgccgtgtccgaggatggctctatgagcatcaaagacgaagaggaagagaatacactcaccattctgatccgcacagggctcctggccatttccggaatgtatccgatggctatccctgcgacggccgctgtctggtacttttgggaagccagaaagcaacgggccggcgtgctttgggatgttccctctcctccgcccaccgggaaggctgagctggaggaaggagcctatcgcatcaaacagagaggcattttcggctacagccagatcggggcgggagtgtataaggagggcacatttcataccatgtggcacgtcacacgggggtccgtgctgatgtgtaaaggaaagagactcgaaccttcttgggctgacgtcaaaaaggatctgattagctacggcgggggatggcgccttgacggcgagtggaccgaaggcgaggaggtgcaggttctggccctcgaaccggggaagaacccccgggccgtgcaaacgaaacctggaatgttcaagaccgatacaggcagaatcggggctgtctccctggactttgcccccggaaccagcggctctcctattatcgataaaaaggggaaagtgatcggactctatggcaatggcgttgtgatgaagtccggggcgtacgtcagctctattgctcagacagagaagcgcgaagacgagatccccgaaattgaggatgacatcttccggaaaagacgcctgaccattatggaccttcaccctggagccggcaagacaaaacggtacctgccggccatcgtgagagaggctatcaagcgcgggctgcggacgctcattctggcccccaccagagtggttgctgccgaaatggaggaagcgcttcggggactgcctatccgctatcagacacccgccattagagctgagcataccggccgggagatcgtcgatctcatgtgccacgccacctttacaatgcgcctgctctcccctgtgagagtgcccaactacaacctgattatcatggacgaagctcatttcacggatccggccagcattgccgctcgggggtatatcgcgaccagagtcgagatgggcgaagccgctggaatcttcatgacagccacccctcccggctccaaagacccctttcctcagtctaatgcccccattatggatgaggaacgcgagatccctgagcggagctggaactccgggcacgaatggattacagacttcgagggaaagaccgtgtggtttgttccgagcatcagagctggcaatgatattgccacgtgtcttcgcaagaacgggaaaaaggtgatccaactgtctcggaaaacattcgacaccgaatacatcaagaccagaaataacgattgggactttgtcgtgacaaccgatatttccgagatgggagcgaatttcaaagctgaacgcgttatcgacccccggagatgcatgaagcctgtgattctgacagacggcgaggagcgcgtcatcctcgccgggcccatgcctgtgacccccagctctgccgctcagagacggggccgcattggaagaaacccgaagaatgaaaacgatcagtatatctacatgggcgagcctctggaaaatgacgaggattgcgcccattggaaagaagcgaagatgcttctggacaacatcaatacgcccgaggggattatccctgccatgtttggacccgagcgggagaagaccgatgctattgacggcgagtatcgcctcagaggggaaagccggaagaccttcgttgagctgatgagacgcggagatctgcctgtgtggctcgcctacaaagtcgcttccgagggctactcttatgccgaccggagatggtgttttgaaggggtgaagaacaatcagatccttgaggaaaacctggaggtggaaatttggacaaaagagggcgagcgcaagaagctgcggcccaaatggctcgatgctagaacctacagcgacccgcaagccctgaaggatttcaaagaatttgcggccggacggaagtccacgacccttaacctgatcgctgagctcggccgcctgcctacatatatgacccagaaaacaagagacgccctggataatctcgctgtccttcacaccgccgaagaaggcgggcgggcctaccagcacgctatttctgaactgcccgagacactggagaccctcctgcttctgtgcctcctggcgacggttagcggaggggtgttcctgttcctcatgtccgggaagggcatcggcaagatgagcatggggcttggatgtatcattacagcctctggcctgctgtggtatgctcaaatccagccccattggattgccgcctccatcattctcgaatttttcctgatcgtgcttctgatccctgagccggaaaaacagcgcacaccccaggacaaccaactcacctacgtcgtgattgctatcctgacactggttgccgcgaccatggccaatgagatggggtatctcgaaaagacaaagaaggaccttggatttggcaacccttacgtggctagccacgaggccgctattctggatatcgacctgcatcccgcctccgcgtggacgctctacgccgtcgctaccacactgattacccctatgcttagacactctatcgagaatagctccacaaacgtgtctctgaccgccatcgctaatcaggccacggttctcatggggctgggaaaaggctggcccctgagccggatggatctcggcgtgcctcttctggctctggggtgctattcccaggtcaacccgctcaccctgacagccagccttctgctcctgattggacactacgcgatcattggccccgggctgcaggccaaggctacccgcgaagcccaaaagagaacagctgccggaatcatgaaaaatcctaccgtggacggcattacggtcatcgatattgagcccatcccttatgaccccaagttcgaaaaacagctcggacaggtgatgcttctggttctgtgtgtggcccaggtgctcatgatgcggacaacctgggcgatgtgcgaggctctgacaatcgccaccggaccgatttctaccctttgggagggcaaccctggcaagttttggaatacaacgatcgctgtctccatggccaacattttccgcgggagctacctggccggagctggcctcctgttttctatcatgaaaaataccgttacagggagacggggaaccggcgtggccggggaaacactgggagagaagtggaagattaaactcaacggccttggcagaaccgatttccaaacgtataagcgctccgggatcatcgaagtggaccggacactggcgaaagagggaattaagagaggcgaaaccaatcatcacgccgtcagccgcgggtctgctaaactgcggtggtttgtggagagaaacctcgttaagcccgagggaaaagtgatcgatctgggctgtgggcgcggaggctggagctactattgcggcgggcttaagaatgtcaccgaagtgaagggactgacaaaaggcgggcccggacatgaggaacctattcccatgtccacctacggctggaacctcgtccggctgcagtctggggtggacgttttctttacacctccggagaagtgtgatacgctgctctgcgacatcggagaaagctcccccaaccctaccattgaggccggcagaacacttcgcgtgctgaatatggtcgagaactggctgggcaataaccagttctgtatcaaagtgctcaatccctacatgcctagcgttatcgaaaagatggagaacctgcagcggaaatttgggggaacccttgtgagaaatcccctgtcccgcaactctacacacgaaatgtattgggtcagcaatgcttccggcaacattgtgtctagcgtgaatatgatctcccggatgctcattaacagattcaccatgaagcataagaaaccgacgtacgagcaagatgttgacctggggtctggaacccgcaatgtcggcatcgaaacagagaagcctaacctggagattatcgggaaaagaatcgaaaagattaaagacgagcacaagcagacctggcactatgatctcgaccatccctacaagacatgggcctatcacggaagctacgaaaccaaacagacaggctccgcgagctctatgatcaatggcgtggtgaaacttctgaccaaaccttgggatgtcattcccatggttacgcaaatggccatgacagacaccacccctttcgggcagcagcgggtgtttaaggagaaagtggatacacgcacgcccgagccgaaggaaggaaccaagaaactgatgaagctcacagctaaatggctgtgggccgagcttggcagacataaggtccctcggatgtgcaccagagacgagttcacaaacaaagtgcggtccaacgctgccatgggggctgtttttaccgaggaaaatcgctggagctctgccaaggaggcggtggaggatgaagccttctgggacctggtcgatagagagcggaaactccatctgcagggaaagtgcgaaacatgtgtgtataacatgatgggcaagcgcgagaaaaagctgggggaatttggcagagctaaaggatcccgggccatctggtacatgtggctcggcgctcgcttcctggagtttgaggcccttgggttcctgaatgaagaccactggtttagcagagagaactctctctccggagttgaaggcgaggggctgcataaacttggatacattctgcgggaaatcggcgccaaagatgggggcatgatgtatgcggacgacaccgctggatgggatacgcgcgtgaccgaggaggacctcaagaatgaagagatgattagcgaacaaatgaagggcgagcacagaacactggccgaggccatcttcaaactgacctaccagaacaaggtcgtgcgggtgcagcgccccacacccaaagggaccgtcatggatatcatttccagacgggaccagcgcggaagcggccaagttgggacgtatggactcaatacatttaccaacatggaagctcagctgatcagacagatggagggcgaagggcttttccgggatatttctaagctgacaatccaggaggaaaccgccattctcacgtggctgaaagagaagggcagagaccgccttagccggatggctatctccggagatgactgcgtggtgaagcctgtcgatgacagatttgcccatgcgctgaccgccctcaatgatatgggcaaagtgcgcaaggacatccaacagtgggaggcttctaaagggtggaacgattggacacaggttccgttctgtagccaccatttccacgaaattatcatgaaggacggacggaaactggtggtcccctgcagaaatcaagacgagctgattggccgcgcccggatctcccagggggctggatgggccctcaaggaaaccgcgtgtctgggcaaggcctacgctcagatgtggtctcttatgtattttcacagacgcgatctgcggctcgccgctaacgccatttgcagcgctgtgccttcccattgggttcccacatctagaaccacatggagcatccacgcccatcaccagtggatgaccacggaggacatgctggatgtgtggaatcgcgtctggatccttgaaaacccttggatggacgataaaacatgtgtgaagtcctgggaggaggttccctacctggggaaacgggaagaccaatggtgcggcagcctcattggactgacctctagagcgacctgggccaagaatatcaaagtggctattgagcaggtccggtccctgatcggcaaggaagagtatacagattacatgcctagcatgaagagattcaaacaggaacagtctaccgagggggccctctggtga

SEQ ID NO: 20303 - RNA, 9876 nt, synthetic construct
  misc_feature 1..9876: note = derived and/or modified CDS sequence (opt5) from DENV-2__GU289914__SS-prME
  source 1..9876: mol_type = other RNA
tccgccggcatgatcattatgctgatccccaccgtgatggctttccacctgacaacgagaaacggggagcctcatatgattgtctcccggcaggaaaagggaaaatctctgctttttaagaccgaggacggcgttaatatgtgcacactgatggccatggatctcggggaactgtgtgaggacaccatcacatacaactgcccgcttctgagacaaaatgaacccgaggatattgactgttggtgcaacagcacctccacatgggtgacctatggaacgtgtaccacaaccggcgagcacagacgggaaaaacgctctgtggcgctcgtccctcatgtggggatgggactggagacaagaaccgaaacgtggatgagctccgagggcgcttggaagcacgcccagcggatcgagacatggatcctgcgccatcccggcttcaccattatggccgctatcctcgcctacacaattgggaccacccactttcagagagctctgatcttcattcttctgacagccgttgcgccttctatgacgatgcggtgcatcggaattagcaatcgcgattttgtggaaggcgtctccgggggaagctgggtggacatcgttctcgagcacggctcttgtgtgaccacaatggccaaaaacaagcccaccctggatttcgaacttatcaagacagaggctaaacagcctgccaccctgagaaagtattgcattgaagctaaactcacgaatacaaccaccgagtcccggtgtccgacacaaggggagcccagcctgaacgaagaacaagacaagcgctttgtctgcaaacattctatggtggatagaggatggggcaatggctgtgggctgttcggaaagggcgggatcgtgacctgcgccatgtttacatgcaagaaaaacatggaaggaaaggtcgttcagcctgagaatctcgaatacacgattgtggtgacaccccactccggcgaggagcatgcggtcgggaacgacacaggaaaacacggcaaggaaatcaaagtgacccctcagagctctattacagaggccgaactgaccggctatgggacggttaccatggagtgtagcccccggacaggacttgatttcaatgaaatggtgctgctccaaatggagaacaaggcttggctggtccaccgccagtggtttcttgacctgccgctcccttggctgcccggcgccgatacccaggggagcaattggatccagaaagagacactggtgaccttcaagaaccctcatgctaagaaacaagacgttgtggtcctcggatcccaggaaggcgccatgcacacggccctgacaggggctaccgagatccagatgtctagcggcaaccttctgtttacaggacatctcaagtgcagactgcggatggacaaacttcaactgaagggcatgtcctacagcatgtgtaccgggaaattcaaggtggtcaaggaaattgcggagacccagcacggaacaatcgtgattagagttcagtatgagggcgatgggtctccctgcaaaatccccttcgaaattatggacctcgagaagcgccatgtgctgggacggctgatcacggtcaatcctatcgtgaccgaaaaagattccccggttaacattgaggccgaacccccttttggcgacagctacatcattatcggggtggatcccggccagctcaagctgaattggttcaaaaagggatctagcattggccaaatgtttgagacaaccatgagaggggctaagcgcatggccatccttggagacacagcctgggatttcggctccctcgggggagtctttacctctattggcaaagctctccaccaggtgttcggggccatctacggcgcggcttttagcggagtgtcctggacgatgaagatcctgattggcgttatcattacatggatcgggatgaacagccggtctacctccctgagcgtctctcttgtgctcgtgggaattgtcaccctgtatctgggcgtgatggttcaggccgactccgggtgtgtggtcagctggaaaaataaggagctcaaatgcggatccggcatcttcatcacagataacgtgcacacctggacagaacagtacaagtttcaacctgagtctcccagcaagctggcctccgctattcagaaagcccaggaagaggggatctgtggcattagatctgttacgcgccttgaaaatctgatgtggaagcagatcaccccggagctcaaccatattctggctgagaatgaagtgaaactgacaatcatgaccggagacatcaagggcattatgcaagccgggaaacggagccttagacctcagcccacagagctcaagtattcctggaaaacctggggaaaggcgaagatgctgagcacggaatctcacaaccagaccttcctgatcgatggccctgagacagccgaatgccccaataccaaccgcgcttggaactccctcgaggtcgaggactacgggtttggagtgttcacaaccaacatttggctgaaacttaaggaaaaacaggacgccttttgtgatagcaagctgatgtctgctgccatcaaagacaatcgggcggttcatgccgatatgggctattggattgagtccgctctcaacgacacatggaagatcgaaaaggccagcttcatcgaggtgaaaaactgccactggcctaagtctcacaccctgtggagcaatggcgtcctggagtccgaaatgattatccccaaaaaccttgctgggccggtgagccaacataattacagacctggatatcacacgcagattgccggcccctggcatctcgggaagctggagatggatttcgacttttgtgatggaacaaccgtggtcgttaccgaagactgcggcaaccgcgggccctctctgcggacaaccacggcctccggaaaactcatcacagagtggtgctgtagaagctgcaccctgcctccgcttcggtaccgcggcgaagatggctgttggtacgggatggagattagacccctgaaggagaaggaagagaatctcgtgaactccctggtgacagctggacacggccaggtcgacaatttctctctgggggtgcttggaatggcgctctttctggaagagatgctgcggaccagagttggcacaaaacatgccatcctcctggtggctgtcagcttcgtgacccttattacggggaacatgtcctttcgcgatctgggacgggttgtggtcatggtgggcgccaccatgacagacgatatcggcatgggggttacctatctcgccctgctggctgccttcaaggtgagacctacatttgcggctggacttctgctccgcaaactgacctctaaggaactcatgatgacgacaatcggcattgtcctgcttagccaatccaccatccccgagacaattctggagctcaccgacgccctggccctggggatgatggtgcttaaaatggtgagaaatatggaaaagtaccagctggctgtcaccatcatggccattctctgcgttcctaacgcggtgatcctgcagaatgcttggaaggtgtcttgtacaatcctcgccgtcgtgagcgttagccccctgcttctgacgagctctcagcagaagaccgactggattcctctcgccctgacaatcaagggactgaaccccaccgctattttccttacaaccctgtcccggacgagcaaaaagcgctcttggccgctcaatgaggccatcatggctgtgggcatggtctccattctggccagctctctcctgaaaaacgatatccctatgacagggccccttgtggcgggaggcctgctgaccgtttgctatgtgctcaccggcagatccgccgacctggaacttgagcgggctgccgatgtcaagtgggaagaccaggctgagatcagcgggtccagccctattctgtctatcacaattagcgaggatggatccatgtctatcaaaaatgaagaggaggaacagaccctcacaattctgatccgcacgggcctcctggtgattagcgggctttttcccgtctccatcccgatcaccgccgccgcttggtacctgtgggaggtgaagaagcagagagcgggagttctgtgggacgtgccttctccccctcccatgggcaaagccgaactcgaggatggggcttatcggattaagcaaaaaggaatcctgggctacagccagattggcgccggggtctataaggaaggaacattccacaccatgtggcacgtgacacgcggcgccgttcttatgcataaagggaagagaatcgagccctcctgggctgacgtgaagaaagatctgatttcttacggaggcgggtggaagctcgaaggagagtggaaagagggcgaagaggtccaggtgctggccctcgaacctggcaagaacccgcgggcggtgcagaccaaacccgggctgtttcgcacgaacgctggaaccatcggcgccgttagccttgacttctcccctgggacaagcggatctcccatcattgataagaagggcaaagtcgtggggctgtacggaaatggcgtggtcaccagatccggcgcctatgtgagcgctatcgcccaaacagagaagtctattgaagacaaccctgagatcgaggatgacatttttcggaaaagacgcctgaccatcatggacctccaccccggggcgggaaagacaaaacggtacctgcctgctatcgttagagaagccattaagcgcggccttcggacgctgatcctcgccccgaccagagtggtcgctgccgagatggaagaggctctgcgcgggctccccattcggtatcagacccctgctatcagagcggaacataccggacgcgagattgtggatctgatgtgtcacgccaccttcacaatgcggcttctgtcccccgttagagtgcctaattacaacctgatcattatggacgaggctcatttcacggatcccgccagcatcgctgcccggggctatatctccacccgcgtcgaaatgggggaggccgctggcatttttatgacagcgaccccgcctggatctagagaccccttcccccagagcaatgcccctatcattgatgaggaacgggagatccccgaacgctcctggaacagcggccacgagtgggtgacagactttaaggggaaaaccgtttggttcgtgccttctattaaggctggaaatgatatcgccgcctgcctccgcaaaaatggcaagaaagtcatccaactgtcccggaagacgtttgacagcgaatacgtgaagacaagaaccaatgattgggacttcgtggtcaccacagatatttctgagatgggggctaactttaaagccgaacgcgttatcgacccgcggagatgtatgaagcccgtgattcttaccgacggagaggagcgcgtgatcctggcgggccctatgcccgtcacacacagctccgctgcccagcggagagggcgcattggccggaatcctaaaaacgaaaatgatcagtatatctacatgggagagcccctcgaaaacgacgaggattgcgcccattggaaggaagctaaaatgctgctggacaatatcaacaccccggagggcattatcccttctatgttcgagcccgaaagagagaaggtggatgccattgacggggaataccgcctcagaggagaggcgcggaaaacgtttgttgatcttatgcgcagaggcgacctgcctgtgtggctggcctataaggtcgctgccgaagggatcaactacgctgatcggcgctggtgtttcgacggaattaagaataaccagatcctcgaggagaatgtggaagttgagatttggacaaaagaaggcgagagaaagaaactgaagccccggtggcttgatgccagaatctatagcgaccctctggctctcaaagagtttaaggagttcgccgcggggcgcaagtccctgaccctgaacctcatcacagagatgggccggcttcccaccttcatgacgcaaaaagccagagatgctctggacaatctggccgtgctccacaccgctgaagccggaggccgcgcctacaaccatgctctgtctgagcttccggaaacactggagaccctcctgctgctcacacttctggcgaccgtcacagggggaatttttctgttcctcatgagcggccgggggatcggaaagatgaccctgggcatgtgctgcattatcacggcctccattcttctgtggtatgctcagatccagcctcactggatcgccgccagcattatcctcgagtttttcctgattgtgctgctcatccccgaacccgagaaacagagaacacctcaagacaatcagcttacctacgtcgtgattgctatcctgaccgttgtggccgcgacaatggccaacgaaatgggctttctggagaagaccaaaaaggatctcgggctgggatctatcgctacacagcagccggaatccaatattcttgacatcgatctgcggcccgccagcgcttggacgctctatgccgtggcgaccacattcgtcacccctatgctgcgccactccattgagaactctagcgttaatgtgtccctgacagccatcgctaaccaagccaccgtgctcatgggccttgggaagggatggcccctgtctaaaatggacattggcgtccctctgctcgctatcgggtgttacagccaggtgaatcccattacgctgaccgccgcccttctgctcctggttgcccattacgcgatcatcggacctggcctgcaggccaaggctacaagagaggcccagaaacgggctgccgccggcattatgaagaacccgaccgtggatgggatcacagtcattgacctcgatcccatcccttatgaccccaaatttgaaaagcaacttggacaggtgatgctgctggtcctctgcgtgacccaggttctgatgatgcgcacgacatgggcgctttgtgaggctctgaccctcgccacaggccctatttccaccctgtgggaagggaatcccggaagattctggaacaccacaatcgctgtgagcatggccaatatctttcggggctcttacctggccggggctggactccttttctccattatgaagaacacgaccaacacacgcagaggcaccggcaatatcggggagacactgggagaaaaatggaagtcccggctgaacgccctcggcaaatctgagtttcaaatttataagaaatccgggatccaggaggtcgatcgcaccctggcgaaggaaggaattaaaagaggcgagacggaccaccatgccgtgagccgggggtctgctaaacttagatggttcgttgaacgcaatatggtgacaccggagggaaaggtcgtggatctgggctgcggcagagggggatggagctactattgtggcgggctcaaaaacgtgcgggaggttaagggactgaccaaaggcgggcctggacacgaggaacccatccccatgtccacctacggctggaatctggtccgcctccagtctggcgtggacgtgtttttcatccctcccgaaaagtgcgatacacttctgtgtgacattggggagagctcccctaacccgaccgtcgaagccggacggacactgagagttctcaatctggtggagaactggcttaataacaatacgcagttctgcatcaaagtgctgaacccctatatgcctagcgtcattgagaagatggaaaccctccaacgcaagtacggcggggctctggtgcggaatcccctgtccagaaactctacacatgagatgtactgggttagcaatgcctccggaaacatcgtgtctagcgtcaacatgatttcccgcatgctcatcaatcggtttaccatgagacacaaaaaggcgacatatgaacctgacgtggatcttggctctgggacccgcaacatcggaattgagagcgaaatccccaatctggacattatcggcaaacggattgagaagatcaaacaggagcacgaaacgtcctggcattacgatcaggaccacccgtataagacctgggcctaccatggcagctatgagacaaagcagaccgggtctgcttccagcatggttaacggagtggtcagactgctcacaaaaccttgggatgtggtgcccatggtcacccaaatggccatgacagacaccacgcctttcggccagcagcgcgtttttaaggaaaaagtggatacaagaacccaggagcccaaggaagggaccaaaaagctgatgaagattacagctgagtggctttggaaagagctgggaaagaaaaagacgcctcggatgtgtacccgcgaagagttcacaagaaaagtgcggtctaatgccgctctcggcgccatctttaccgacgaaaacaagtggaaatccgcgagagaggccgtcgaggatagccggttctgggaactggtggacaaggagcgcaatctgcacctcgaagggaagtgcgagacatgtgtttacaacatgatgggaaaaagagaaaagaaactgggcgagtttggcaaggctaaagggtctcgggccatctggtatatgtggcttggagctcgcttcctggagtttgaagccctcggcttcctgaatgaggatcactggttttccagagaaaacagcctttccggggtggagggagaaggcctgcataagctcgggtacattctgcgggacgtcagcaagaaagagggcggagccatgtacgcggacgataccgctggctgggacacacgcatcaccctggaggatctcaagaatgaagagatggtgacgaaccacatggaaggggagcataaaaagctggccgaagccattttcaaacttacctatcaaaataaggttgtgagagtccagcggcccacaccgcgcggaaccgtgatggacatcatttctagacgggatcagcgcggcagcgggcaagttggaacatacggcctgaacacctttacgaatatggaggctcagctcatcagacagatggagggggaaggcgtgttcaagaacatccagcacctgacagtcaccgaggaaattgccgtgcaaaactggcttgctcgggtcggacgcgagagactgtcccggatggccatctctggcgacgattgcgtggttaaacctctcgacgatagattcgcgagcgccctgacagctctgaatgacatggggaagattcgcaaagatatccagcagtgggagccctcccggggatggaacgactggacccaggtgcccttttgctctcatcacttccacgaactcattatgaaggatggcagagtcctggtggtgccttgtcgcaatcaagacgagcttatcgggcgggccagaatcagccagggagctggctggtccctgcgcgaaacggcctgcctcgggaaatcttatgcgcagatgtggagcctgatgtactttcatcggagagaccttcgcctggccgctaacgccatttgttccgctgttccgagccactgggtgcccacctctcggacaacctggtccatccatgccaagcacgagtggatgacaaccgaagatatgctcacagtctggaatagagtgtggattcaggagaacccttggatggaggacaagacccccgttgaaagctgggaggaaatcccttatctgggcaaacgcgaggatcaatggtgcggatctctgattggcctcacgtcccgggctacatgggccaagaatatccaggcggccattaaccaggtgagaagcctgatcgggaatgaagagtacaccgactatatgccctccatgaaacggttcagacgcgaggaagaggaagctggagtcctttggtga

SEQ ID NO: 20304 - RNA, 9876 nt, synthetic construct
  misc_feature 1..9876: note = derived and/or modified CDS sequence (opt5) from DENV-2__AY858036__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattaccccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcgtgacagataatgtccacacctggacagaacagtataagtttcagcctgagtctcccagcaagctcgcttccgccatccaaaaagctcacgaagaggggatttgtggcatcagatctgtgacgcgcctggaaaaccttatgtggaagcagattaccccggagctgaatcatatcctcagcgagaacgaagttaaactgacaattatgaccggagacatcaagggcatcatgcaggccgggaaacggtccctgagacctcagcccacagagcttaagtacagctggaaaacctggggaaaggcgaagatgctctctacggaactgcacaatcataccttcctgattgatggccctgagacagccgaatgccccaacaccaatcgcgcttggaactccctcgaggtggaggactatgggtttggagtcttcacaaccaatatctggctgaaacttaaggaacggcaagatgtgttttgtgacagcaaactgatgtctgccgctattaaggacaacagagccgtgcacgcggatatgggctactggatcgagtccgccctcaacgacacatggaaaattgaaaaggctagcttcatcgaggtcaagtcttgccactggcctaaaagccataccctgtggtccaatggcgttctggagagcgaaatgatcattcccaagaacttcgccgggccggtgtctcagcacaattatcgccctggataccatacgcagacagctggcccctggcaccttgggcggctcgagatggattttgacttctgtgaaggaaccaccgtggtcgtgacagaggattgcggcaacagagggccctccctgcggaccacgacagccagcggaaaactgatcaccgaatggtgctgtcgctcctgcacactccctccgctgagataccggggcgaggacggctgttggtatgggatggagattagaccccttaaggaaaaagaggaaaatctggttaactctctcgtgaccgccggacatggccagatcgataattttagcctgggggtcctgggaatggctcttttcctcgaggaaatgctgcgcacacgggtgggcaccaagcacgcgattctgctcgttgccgtgtcctttgtcacgctgatcaccgggaacatgtctttcagagaccttggacgcgtgatggttatggtgggcgctacaatgaccgatgacattggcatgggggtcacatacctggccctcctggccgcttttaaggtgagacctaccttcgccgcgggactgcttctgcggaaactcacgagcaaggagctgatgatgacaaccatcggcatcgtgctcctgtcccaatctacaattcccgagaccatccttgaactgaccgatgctctcgccctggggatgatggtcctgaaaattgttcgcaatatggagaagtatcagcttgccgtgacaatcatggctattctgtgcgtgcctaacgccgtcatcctccagaatgcgtggaaagtgagctgtacgaccctggctgttgtgtccgtcagccccctcctgcttacatcttcccaacagaaggccgactggatccctctggccctcaccattaagggactgaaccccacagctatctttctgaccacgcttgccagaacaagcaaaaagcggtcttggccgctgaatgaagctattatggccgtgggcatggtttccatcctcgcgagctctctgctcaaaaacgatattcctatgaccgggcccctggtggccggaggccttctgaccgtctgctacgtgctgacaggccgctccgctgacctcgagctggaaagagccgctgacgtccggtgggaggagcaggccgaaatcagcgggtccagccctatcctttctattaccatcagcgaggatggatccatgtctattaagaatgaagaggaggaacagacactgacgatcctcattcgcaccggcctgctcgtgatcagcgggctgttccccgtttccattccgatcacagccgctgcgtggtatctttgggaggtgaaaaagcaaagagccggagtcctgtgggacgtgccttctccccctcccgttggcaaagctgaactggaggatggggcctaccggatcaagcagaagggaattctcggctatagccagatcggcgccggggtgtacaaagaaggaacctttcacacaatgtggcatgtcacccgcggcgctgtgctgatgcacaaggggaaaagaattgagccctcctgggccgacgtgaagaaagatcttatctcttacggaggcgggtggaagctggagggagaatggaaggagggcgaagaggttcaggtcctcgcgctggaacctggcaaaaacccgcgggctgtgcaaacgaagcccgggctcttcaaaaccaacacaggaaccattggcgccgtgagcctggacttttcccctgggacaagcggatctcccatcgtcgataagaaaggcaaggtggttgggctttatggaaatggcgtggtcaccagatccggcacatacgtgagcgccatcgctcagacggagaagtctattgaggacaaccctgaaatcgaggatgacattttccgcaaaaagcggctgaccatcatggatctgcatcccggggccggaaaaacaaagagatatctccctgcgattgttcgcgaagctatcaaacggggcctgagaacccttatcctggccccgacccgcgtggtcgccgctgagatggaagaggccctccgggggctgcccattagataccagacacctgctatccgcgccgagcacacgggacgggaaattgtggacctcatgtgtcatgcgaccttcacaatgagactgctttcccccatccgggttcctaattataacctgattatcatggatgaggcccactttaccgaccccgctagcattgccgctcgcggctacatctccacaagagtggaaatgggggaggccgccggcatcttcatgaccgctacgccgcctggatctcgggacccctttccccagagcaatgcgcctattatggatgaggaacgcgagatccccgaaagatcctggaacagcggccacgagtgggtcacagacttcaaggggaagaccgtgtggtttgtgccttctattaaagccggaaatgatatcgctgcctgcctgcggaagaacggcaaaaaggtcattcaactctccagaaaaaccttcgacagcgaatatatcaagacacgcaccaatgattgggactttgttgtgacaaccgatatctctgagatgggggccaacttcaaggctgagcgggtgattgacccgagacgctgtatgaaacccgtcatcctgacggatggagaagagcgggtgattcttgccggccctatgcccgttacacatagctccgcggctcagagacgcgggcgggtgggcagaaatcctaagaacgaaaatgaccagtacatctacatgggagagcccctggaaaacgatgaggactgcgcccactggaaagaggccaagatgctcctggacaatattaacaccccggaaggcatcatcccttctatgtttgagcccgaacgcgagaaagtcgatgctattgacggggaatatagactgcggggagaggcccgcaagacattcgtggatctcatgagacggggcgaccttcctgtttggctggcgtaccgcgtggccgctgaggggatcaactatgccgatagacggtggtgttttgacggagtcaaaaataaccaaattctggaagagaatgtggaagtcgagatctggaccaaggagggcgaaagaaagaaactcaagccccgctggctggatgctcggatttacagcgaccctcttgccctgaaagagttcaaggaattcgctgccgggagaaaatccctcacgctgaacctgatcaccgagatgggccgcctccccacatttatgacccagaaggcgcggaatgcccttgataacctggctgtgctgcatacagccgaaaccggaggcagagcttataatcacgccctctctgagctgccggagacacttgaaaccctgctcctgctgacgctccttgccacagttaccgggggaattttcctgtttctgatgagcggcaaggggatcggaaaaatgaccctcggcatgtgctgcatcattacagcttccatcctgctttggtacgcgcagattcagcctcactggatcgccgctagcattatcctggagttctttctcatcgtgctgctgattcccgaacccgagaagcaacggacccctcaggacaaccagctcacatatgtggtcatcgccattcttacggttgtggccgctaccatggccaatgaaatgggcttcctggagaaaacaaagaaagattttgggctgggatctatcaccacacagcaaccggagtccaacattctcgacatcgatctgcgccccgcgagcgcctggaccctttacgctgtggccacgaccttcatcacacctatgctgagacattccattgaaaattctagcgtcaacgtgtccctcaccgctatcgccaatcaggcgacagttctgatgggcctggggaagggatggcccctctctaagatggacattggcgtgcctcttctggccatcgggtgttacagccaggtcaaccccattaccctgacggctgccctcctgcttctggtggctcactatgccatcattggacctggcctccaggctaaagccacacgggaggcgcaaaagcgcgccgctgccggcatcatgaaaaatccgaccgtcgacgggatcacagtgattgatctggaccccatcccttacgatcccaagtttgaaaaacagctgggacaggttatgctccttgtgctgtgcgtcacccaggtgctgatgatgagaaccacatgggctctctgtgaggccctgacgcttgccaccggccctatttccacactgtgggaagggaaccccggacggttctggaataccacaatcgcggttagcatggctaacatttttcgcggctcttatctcgccggggctggactgctgttctccatcatgaagaacaccgccaatacgagacggggcacaggcaacaccggggagaccctcggagagaagtggaaaaatcgccttaacgccctgggcaagagcgaatttcaaatctacaaaaagtctgggattcaggaggtggacagaacactggctaaagaaggaatcaagcggggcgagaccgatcatcacgccgtctccagagggagcgcgaaactccgctggttcgtggagcggaatctggtgacaccggaaggaaaggttgtcgaccttggctgcggcagagggggatggtcttattactgtggcgggctgaagaacgtgaaagaggtgaagggactcacgaaaggcgggcctggacatgaagagcccattcccatgagcacctatggctggaatctggtccgcctgcagtccggcgttgatgtgttctttacacctcccgaaaagtgcgacaccctcctttgtgatatcggggagtctagccctaacccgacagtggaggccggacggaccctgagagtcctgaatctcgtggaaaactggctgaataacaatacgcaattctgcattaaagttcttaacccctacatgccttccgtgatcgagaagatggaagctctgcagcgcaagtacggcggggccctcgtccggaatcccctgagcagaaactccacccacgagatgtattgggtgtctaacgctagcggaaatatcgtttcctctgtgaacatgattagccgcatgctgatcaatcggtttacaatgagacacaaaaaggccacctacgaacctgacgtcgatctcggctccgggacacgcaacattggaatcgagtctgagacccccaatcttgacattatcggcaaacggatcgaaaagattaaacaggagcatgaaacaagctggcactatgatcaggaccatccgtacaagacctgggcgtatcacggctcctacgagacgaagcaaacagggagcgcctcttccatggtgaacggagtggtcagactgctgaccaaaccttgggacgttatccccatggtgacccagatggctatgacagatacgacccctttcggccagcagcgcgtgtttaaggaaaaagtcgacacaagaacccaagagcccaaggaggggacaaaaaagctcatgaagattaccgccgaatggctgtggaaagagcttggaaagaaaaagacacctcggatgtgtacccgcgaagagttcacgagaaaagtgcggagcaatgctgccctgggcgctatctttaccgatgagaacaagtggaaatctgccagagaagcggttgaggactccgaattctgggagctcgtggataaggaacggaatctgcacctggaggggaagtgcgagacatgtgtctataacatgatgggaaaacgcgaaaagaaactcggcgagtttggcaaggccaaagggagcagagctatttggtacatgtggctgggagcccggttccttgaatttgaggctctgggcttcctcaatgaagaccattggttttctcgcgagaactccctgagcggggtggagggagaaggccttcacaagctggggtacatcctcagagatgtttccaagaaagagggcggagccatgtatgccgacgataccgcgggctgggacacacggattaccctggaagatctgaagaatgaggaaatggtgacgaaccatatggagggggagcacaaaaagctcgctgaagccatcttccgcctgacataccagaataaagtcgtgagagttcagcggcccaccccgcgcggaacagtgatggacatcattagcagacgggaccagcgcggctctgggcaagtcgtgacctatggacttaacacgttcaccaacatggaggcccagctgatcagacagatggaaggcgagggggtctttaagagcattcaacatctcacagtgaccgaggaaatcgctgttaagaattggctggtgcgggtcggccgcgagagactttcccggatggccatttctggagatgactgcgtggtgaaacctctggatgacagattcgctagcgccctcacagcgctgaacgatatgggcaaggttcgcaaagacatccagcagtgggaaccctcccgggggtggaatgattggacccaggtgcccttttgctctcaccacttccatgagctgatcatgaaggacggaagagtcctcgtggttccttgtcgcaaccaagatgaactgattggccgggccagaatcagccagggggctggatggtcccttcgcgagacagcctgcctgggcaaatcttacgctcagatgtggagcctcatgtattttcaccggagagacctgcgccttgccgcgaatgccatttgttccgctgtgccgagccattgggtccccacctctcggacgacatggtccatccacgccacccacgagtggatgaccacagaagatatgctgaccgtgtggaacagagtctggattcaggagaatccttggatggaagacaagacacccgtggagagctgggaagagatcccttacctcgggaagcgcgaggatcaatggtgcggctctctgatcggactgacgtcccgggctacctgggccaaaaacattcagacagctatcaatcaggttagaagcctcattggcaacgaagagtataccgactacatgccctccatgaagcggttcagacgcgaagaggaagaggccggggtgctgtggtga

SEQ ID NO: 20305 - RNA, 9876 nt, synthetic construct
  misc_feature 1..9876: note = derived and/or modified CDS sequence (opt5) from DENV-2__HQ332184__SS-prME
  source 1..9876: mol_type = other RNA
acagccggagtgatcattatgctgatccccacagctatggccttccacctcacgaccagaaatggggaacctcatatgattgtcggacggcaggaaaagggaaagagcctgctttttaagacagaggacggggttaatatgtgcaccctgatggcgatcgatctcggagaactgtgtgaggacacaattacctacaaatgcccgcttctgagacaaaatgaacccgaggatatcgactgttggtgcaatagcacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgggtgggatttcggatctctgggcggggtctttacgagcattggcaaggccctccaccaggtgttcggagctatctacggcgccgcgttttccggggtttcttggacaatgaaaatcctgattggagtggtcatcacctggattggcatgaacagccggtccaccagcctgtctgtgtcccttgtgctcgttggggtcgtgacactgtatctgggagctatggtgcaggccgacagcggctgtgtcgtgtcttggaagaataaagaactcaagtgcgggtccggcatcttcattaccgataacgttcacacatggacggagcagtacaagtttcaacctgaaagcccctccaaactggcctctgctatccagaaggcccatgaggaaggaatctgtggcattagaagcgtgacccgccttgagaatctgatgtggaaacagatcacaccggagctcaaccacattctgtccgaaaatgaggtcaagctgaccatcatgacaggggacaccaaaggaattatgcaggctggcaagcggtctcttagacctcaacccacggaactcaaatatagctggaagacctgggggaaggccaaaatgctgtccacagagagccataaccagaccttcctgatcgatggacctgaaacagcggagtgccccaataccaaccgcgcctggaactctctcgaggtggaagactacggctttggcgttttcacaaccaacatctggctgaaacttcgggagaaacaggacgtgttttgtgattccaagctgatgagcgctgccattaaagacaatagagctgtccacgccgatatggggtattggatcgaatctgcgctcaacgacacgtggaagatggagaaggcctccttcattgaggtgaaaagctgccactggcctaagtctcatacactgtggagcaatggagttctggaatccgagatgatcattcccaaaaacttcgctggcccggtgagccagcacaactaccgccctgggtatcatacccaaaccgccggaccctggcaccttggcaagctcgaaatggattttgacttctgtgaggggacaaccgtcgtggtgacggaagattgcggaaatcggggcccctctctgagaacaaccacagcttccggcaaactgatcaccgagtggtgctgtcggagctgcacactccctccgctgcgctacagaggggaggacggatgttggtacggcatggaaattcggccccttaaggagaaggaagagaacctggtcaattccctcgttaccgccgggcatggacagatcgataacttttctctgggcgtgctggggatggcccttttcctcgaagagatgctgagaacgcgcgtgggaaccaaacacgctacactgctcgtcgcggccagctttgtgaccctgatcacaggcaatatgtccttccgggaccttggcagagttatggtgatggtcggggctaccatgacggatgacattggaatgggcgtgacatatctggccctcctggccgcttttaaggttcgccctaccttcgccgcggggctgcttctgagaaaactcacatctaaggagctgatgatggctaccatcggaattaccctcctgagccagtccacaatccccgaaacgattcttgagctgaccgatgccctcgccctgggcatgatggtgctgaaaatcgtccggaacatggaaaagtaccaacttgctgtgacaatcatggccatttcttgcgttcctaatgcggtgatcctgcgcaacgcttggaaggtcagctgtaccattctcgccgccgtgtccgtgagccccctgctcctgacatcttcccagcagaaagctgactggatccctcttgccctgaccattaaggggctcaatcccacggctatctttctgacaaccctgagcagaacctctaaaaagcggtcctggccgcttaacgaggccatcatggcggtcggaatggttagcattctggcctcttccctcctgaaaaatgacatccctatgacaggccccctcgtggctggcgggctgcttaccgtgtgctatgtcctgacaggacgcagcgccgatctggaactcgagagagctgccgacgtgaagtgggaggatcaggccgaaatttccggcagctctcctatcctgagcattacgatctccgaggacgggtctatgagcattaaaaacgaagaggaggaacaaacccttacaatcctgatccggaccggactcctggttatttccggcgtgttccccgtctctatcccgattacagctgcggcctggtacctctgggaggtgaagaagcagcgcgctggggttctgtgggatgtgccttctccccctcccgtcggaaaagccgaacttgaggacggcgcctatagaatcaagcagcggggcattctggggtactcccagatcggagctggcgtgtataaagaagggacctttcacacgatgtggcatgtcacccgcggagccgtgctgatgcacagaggcaagcggatcgagccctcctgggcggatgttaaaaaggacctcattagctacgggggaggctggaagctggagggcgaatggaaagagggggaagaggtgcaagtccttgctctggaacctggaaagaatccgagagccgtgcagacaaaacccggcatcttcaagaccaacacagggaccattggagccgtttccctcgattttagccctggcacatctgggtcccccatcgtggaccgcaaaggaaaggtcgtgggcctgtacggcaatggggtggttacgcggagcggagcttatgtctctgccattgcgcagaccgagaagtccatcgaggataaccctgaaatcgaggacgatattttccgcaagaagcgcctcacaatcatggacctgcatcccggcgctgggaaaaccaagcggtaccttcctgccattgtgagagaagccatcaaacgcggactgcggaccctgattctcgctccgacaagagtggtcgccgctgagatggaagaggccctgcgcggccttcccatccggtatcagacgcctgcgattaaggccgagcacaccgggagagaaatcgtggacctgatgtgtcatgctacattcaccatgcggctcctgagccccgttcgcgtgcctaactacaatctcatcattatggatgaggcccactttacagaccccgcttccatcgccgccagaggctatatttctacccgggtcgaaatgggagaggctgcgggcatcttcatgacggccacaccgcctgggagccgcgatccctttccccaatccaacgctcctattatggacgaggaaagagagatccccgaacggagctggaactctggacacgagtgggtgaccgatttcaagggcaaaaccgtttggtttgtgccttccatcaaggccgggaacgacattgccgcttgcctgcgcaagaatggaaagaaagtcatccagcttagccgcaagacattcgattctgaatacgtgaagacccgggccaacgactgggattttgttgtgacaaccgacattagcgagatgggcgcgaatttcaaagctgagagagtcatcgatccgcgccggtgtatgaagcccgtgattctgacggacggggaagagagagtgatcctggccggccctatgcccgtcacacattcctctgccgctcagcgccggggaagaatcggccgcaaccctaaaaatgaaaacgaccaatatatttacatgggggagcccctcgaaaatgatgaggactgcgcccactggaaggaggcgaaaatgctgcttgataacatcaataccccggaaggaattatccctagcatgtttgagcccgaaagagagaaggttgacgccattgatggcgaataccggctgcgcggggaggctagaaaaacattcgtggacctcatgcggcgcggagatctgcctgtgtggctggcctataaggtcgctgccgagggcatcaactacgctgacagaaagtggtgttttgatgggattaaaaataaccagatcctcgaagagaacgtggaagttgagatctggaccaaggagggcgaacggaagaaacttaaacccagatggctggacgcccgcatttattccgatcctctggcgctcaaagagttcaaggagttcgccgctggacggaaatctctgacgcttaatctgatcaccgagatgggcagactccccacatttatgacccagaaggcccgcaacgctctggacaatctggccgtgctccatacagccgaagctgggggacgggcgtacaaccacgcccttagcgagctgccggagaccctggaaacactcctgcttctgaccctcctggctacggtcacaggcgggattttcctgtttctcatgtccggaaaaggcatcggcaagatgacccttgggatgtgctgcattatcaccgccagcgtgctgctgtggtatgcccagatccaacctcactggattgctgcctctatcattctcgagttctttctgatcgttcttctgattcccgaacccgagaaacagagaacacctcaggataatcagctcacctacgtggtcatcgcgatcctgacagtggtcgccgctacgatggccaacgaaatgggattcctggagaagaccaagaaagacctcggccttgggtccattacaacccaagagagcgaatccaatatcctggacattgatctgcggccggcttctgcctggacactctatgcggtggccaccacgtttgttacccccatgctgcgccatagcatcgagaactcctctgtgaatgtgagccttacagctattgccaaccaggctaccgtcctgatgggactcggcaaggggtggcctctgtccaaaatggacatcggagttcccctgctcgccattggctgttacagccaggtgaatcctatcacacttaccgctgccctgctgctcctggtggcgcactacgccatcattggccccgggcttcaggctaaggccacgagagaagctcaaaaacgggccgccgcgggaatcatgaagaaccctacagtcgatggcattaccgtgatcgacctggagccgattccctatgatcctaagttcgaaaaacagctcgggcaggttatgctgctgatcctctgcgtgacacaggtccttatgatgcgcaccacctgggctctgtgtgaggccctgacactcgctacgggacccatctctaccctgtgggagggcaatcctgggagattttggaacacaaccattgccgtgtccatggccaatatcttccggggaagctaccttgctggcgccggcctgctcttttctattatgaagaacacaaccaatacgcgcagagggacaggaaacatcggcgaaaccctgggggagaaatggaagtcccggctgaacgcgctcggaaaaagcgagttccaaatttataagaaatctggcatccaggaggtcgaccgcacccttgccaaggaggggatcaagagaggagaaacagatcatcacgctgtgagccggggctccgccaaactgagatggtttgttgagcgcaatatggtgacccccgaaggcaaggtcgtggacctggggtgcggacggggcgggtggtcttactattgtggaggcctcaaaaacgttagagaggtgaaggggctgacaaaaggaggcccgggccatgaagaacctattcccatgagcacgtacgggtggaatcttgtccgcctgcagtccggagtggatgtgttcttcacaccccctgagaagtgcgacaccctcctgtgtgatatcggcgaaagctcccccaaccctaccattgaggctgggcggacactgagagttctcaatcttgtcgaaaactggctgaataacaatacccaattttgcatcaaggtgctgaacccgtatatgccctctgtgattgagaaaatggaaacgctccagcgcaagtacggaggcgccctggtccggaatcctcttagcagaaactccacccacgagatgtactgggtttctaatgcgacagggaacatcgtgagctccgtgaatatgatctctcgcatgctgattaaccggttcaccatgaaacacaagaaagccacatatgagcccgacgtcgatctcggaagcggcaccagaaacatcggcattgaatccgagatccctaatctggacattatcgggaagcgcattgaaaagatcaaacaggagcatgaaacaagctggcactacgaccaggatcatccctataagacctgggcttaccacggatcttatgagacgaaacaaacaggctccgccagctctatggtgaacggggttgtgcggctgctcaccaagccgtgggacgtcgtgcctatggttacccagatggctatgacagatacgaccccctttggacagcagagagtgttcaaagagaaggtcgacacacgcacccaagaacctaaggagggcaccaagaaacttatgagaatcaccgccgaatggctgtggaaagagctggggaagaaaaagacaccccggatgtgtacccgcgaggaatttacgagaaaagtgcggtccaatgctgccctcggagcgattttcaccgatgagaacaagtggaaaagcgccagagaagctgtggaggacggccggttttgggaactggtcgataaagagcgcaatcttcacctggagggcaagtgcgaaacatgtgtttacaacatgatggggaaaagagagaagaaactcggagagttcggcaaggccaaggggtctcgggctatctggtatatgtggctgggagcccgctttctggagttcgaagccctcggctttctgaatgaggaccattggttctccagagggaacagcctttccggcgtggagggagaaggcctgcaccggctcgggtacattctgcgcgatgtgggcaagaaggagggcggggcgatgtacgctgacgataccgccggatgggacacaagaatcacccttgaagacctgaaaaatgaggaaatggtcacgaaccatatgaagggcgagcacaaaaagctcgccgaggctatttttaagctgacatatcagaataaagtggttcgggtgcagcgccctacccccagagggacagtcatggatatcatcagccggcgcgaccagagaggctctggacaagtgggcacctacgggctgaacacgttcaccaatatggaagcccagctcattcggcagatggagggagaaggcatcttcaagagcattcaacatctgacagctaccgaggagatcgccgttcagaactggcttgcgcgcgtggggagagaacggctgtccagaatggccatttctggagatgactgcgtcgtgaaaccgatcgatgaccgctttgctagcgccctcacagctctgaatgatatgggcaaggttcggaaagacatccagcagtgggagccttccagagggtggaacgattggacccaagtgcccttctgctctcaccactttcatgaacttgtcatgaaggacggccgcgtgctggtcgtgccctgtcggaaccaggatgagctcattggcagagcccgcatcagccagggcgcggggtggtccctgaaggaaacagcctgcctgggaaaatcttatgctcagatgtggaccctcatgtacttccaccggagagacctgcgccttgccgctaatgccatttgtagcgctgttccttcccattgggtgccgacgagccggacaacctggtctatccacgccaagcacgagtggatgaccacagaggatatgctggcggtctggaacagagtgtggattcaagaaaatccctggatggaggacaaaacccctgtggaatcctgggaggaagttccctatctcggcaagcgcgaggaccagtggtgcgggagcctgatcggacttacatctcgggccacgtgggctaaaaacattcagaccgccatcaatcaggtgagatccctgatcggcaacgaggaatacacagattatatgcctagcatgaagcggtttagacgcgaggaagaggaagccggggtcctctggtga

SEQ ID NO: 20306 - RNA, 9876 nt, synthetic construct
  misc_feature 1..9876: note = derived and/or modified CDS sequence (opt5) from DENV-2__HQ332185__SS-prME
  source 1..9876: mol_type = other RNA
accgccggagtgatcattatgctgatccccacagctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgagacaaaacgaacccgaggatatcgactgttggtgcaatagcacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagatcaaagaactcaagtgcggctccgggattttcatcaccgataatgttcacacatggacggagcagtacaagtttcaacctgaaagcccctccaaactggcttctgccatccagaaggctcatgaggaaggcatttgtggaatcagaagcgtgacccgccttgagaacctgatgtggaaacagattacaccggagctcaatcacatcctgtccgaaaacgaggtcaagctgaccattatgacaggcgacaccaaagggatcatgcaggccggaaagcggtctcttagacctcaacccacggaactcaaatatagctggaagacctggggcaaggcgaaaatgctgtccacagagagccataatcagaccttcctgatcgatgggcctgaaacagccgagtgccccaacaccaatcgcgcttggaactctctcgaggtggaagactacggatttggcgttttcacaaccaatatttggctgaaacttcgggagaaacaggacgtgttttgtgattccaagctgatgagcgccgctatcaaaaacaatagagccgtccacgcggacatgggctattggattgaatctgccctcaacgatacgtggaagatggagaaggcttccttcatcgaggtgaaaagctgccactggcctaagtctcatacactgtggagcaatggggttctggaatccgagatgattatccccaaaaacttcgccggaccggtgagccagcacaactaccgccctggctatcatacccaaaccgctgggccctggcaccttggaaagctcgaaatggactttgatttctgtgagggcacaaccgtcgtggtgacggaagactgcgggaatcggggaccctctctgagaacaaccacagcctccggcaaactgattaccgagtggtgctgtcggagctgcacactccctccgctgcgctacagaggcgaggatgggtgttggtacggaatggaaatccggccccttaaggagaaggaagagaacctggtcaattccctcgttaccgccggccatgggcagatcgacaacttttctctgggagtgctgggcatggctcttttcctcgaagagatgctgagaacgcgcgtggggaccaaacacgcgattctgctcgtcgccgtgagctttgttacactgatcaccggaaatatgtccttccgggatcttggcagagtgatggtcatggtgggcgctacaatgaccgacgatattgggatgggagttacgtatctggccctcctggccgcttttaaggtgcgccctacattcgccgcgggcctgcttctgagaaaactcacctctaaggagctgatgatggctacaatcgggattaccctcctgagccagtccaccatccccgaaacaatccttgagctgacggacgccctcgccctgggaatgatggtcctgaaaattgtgcggaacatggaaaagtaccaacttgctgttaccatcatggccatttcttgcgtgcctaatgcggtcatcctgcgcaacgcttggaaggtgagctgtacaattctcgccgccgtgtccgtcagccccctgctcctgacctcttcccagcagaaagctgattggatccctcttgccctgacaatcaagggcctcaatcccaccgctatttttctgacgacactgagcagaacctctaaaaagcggtcctggccgcttaacgaggccatcatggcggttgggatggtgagcattctggcctcttccctcctgaaaaatgacatccctatgaccggacccctcgtggctggcggcctgcttacagtctgctatgtgctgaccgggcgcagcgccgacctggaactcgagagagctgccgatgttaagtgggaggaccaggccgaaatttccggaagctctcctatcctgagcattacaatctccgaggatggctctatgagcatcaaaaacgaagaggaggaacaaacgcttaccattctgatccggacagggctcctggtgatttccggagtcttccccgtgtctatcccgattaccgctgcggcctggtacctctgggaggttaagaagcagcgcgctggcgtgctgtgggacgtcccttctccccctcccgtggggaaagccgaacttgaggatggagcctatagaatcaagcagcggggcatcctgggctactcccagattggggctggagtctataaagaaggcacatttcacaccatgtggcatgtgacgcgcggggccgttctgatgcacagaggaaagcggatcgagccctcctgggcggacgtgaaaaaggatctcattagctacggcgggggatggaagctggagggcgaatggaaagagggcgaagaggtccaagtgcttgctctggaacctgggaagaatccgagagccgttcagaccaaacccggaatcttcaagacaaacaccggcacaattggggccgtgtccctcgactttagccctggaacctctggctcccccatcgtcgatcgcaaagggaaggtggtgggactgtacggcaatggcgttgtcacacggagcggggcttatgtgtctgccatcgcgcagacggagaagtccattgaggacaaccctgaaatcgaggatgacattttccgcaagaagcgcctcaccatcatggatctgcatcccggagctggcaaaacaaagcggtaccttcctgccattgtgagagaagccatcaaacgcgggctgcggaccctgattctcgctccgaccagagtcgtggccgctgagatggaagaggccctgcgcggacttcccatccggtatcagacccctgcgatcaaggccgagcacacgggcagagaaattgttgacctgatgtgtcatgctaccttcacaatgcggctcctgagccccgtgcgcgtccctaactacaatctcatcattatggacgaggcccactttaccgatcccgcttccatcgccgccagagggtatatttctacacgggtggaaatgggcgaggctgcgggaatcttcatgaccgccacgccgcctggcagccgcgacccctttccccaatccaacgctcctatcatggatgaggaaagagagattcccgaacggagctggaactctgggcacgagtgggttacagacttcaagggaaaaaccgtgtggtttgtcccttccatcaaggccggcaacgatattgccgcttgcctgcgcaagaatgggaagaaagtgatccagcttagccgcaagaccttcgactctgaatacgttaagacacgggccaacgattgggactttgtggtcaccacagatattagcgagatgggagcgaatttcaaagctgagagagtgatcgacccgcgccggtgtatgaagcccgtgatcctgaccgatggcgaagagagagtcattctggccgggcctatgcccgttacgcattcctctgccgctcagcgccggggcagaatcggacgcaaccctaaaaatgaaaacgaccaatatatttacatgggcgagcccctcgaaaatgacgaggattgcgcccactggaaggaggcgaaaatgctgcttgacaacatcaatacaccggaagggattatccctagcatgtttgagcccgaaagagagaaggtggatgccattgacggagaataccggctgcgcggcgaggctagaaaaaccttcgtggatctcatgcggcgcggggacctgcctgtctggctggcctataaggtggctgccgagggaatcaactacgctgatagaaagtggtgttttgacggcatcaaaaataaccagattctcgaagagaacgttgaagtggagatctggacaaaggagggggaacggaagaaacttaaacccagatggctggatgcccgcatttattccgaccctctggcgctcaaagagttcaaggagttcgccgctggccggaaatctctgacccttaatctgatcacggagatgggaagactccccacctttatgacacagaaggcccgcaacgctctggataatctggccgtcctccataccgccgaagctggcgggcgggcgtacaaccacgcccttagcgagctgccggagacactggaaaccctcctgcttctgacactcctggctaccgtgacgggaggcattttcctgtttctcatgtccgggaaaggaatcggcaagatgacacttggcatgtgctgcatcattaccgccagcgttctgctgtggtatgcccagatccaacctcactggattgctgcctctatcattctcgagttctttctgatcgtgcttctgatccccgaacccgagaaacagagaacccctcaggacaatcagctcacatacgtcgtgattgcgatcctgaccgtcgtggccgctacaatggccaacgaaatggggttcctggagaagacgaagaaagatctcggacttggctccattaccacacaagagagcgaatccaatatcctggacattgacctgcggccggcttctgcctggaccctctatgcggttgccacaacctttgtgacgcccatgctgcgccatagcatcgagaactcctctgtgaatgtcagccttaccgctattgccaaccaggctacagttctgatggggctcggaaagggctggcctctgtccaaaatggatatcggggtgcccctgctcgccatcggatgttacagccaggtgaatcctattacccttacagctgccctgctgctcctggtcgcgcactacgccatcattggccccggccttcaggctaaggccaccagagaagctcaaaaacgggccgccgcggggatcatgaagaaccctacggtggacggaattacagttatcgatctggagccgatcccctatgaccctaagttcgaaaaacagctcggccaggtgatgctgctgattctctgcgtcacccaggtgcttatgatgcgcacaacctgggctctgtgtgaggccctgaccctcgctacagggcccatctctacgctgtgggagggaaatcctggcagattttggaacaccacaattgccgtctccatggccaatatcttccgggggagctaccttgctggagccggcctgctcttttctattatgaagaacaccacaaatacccgcagaggcacggggaacatcggagaaacactgggcgagaaatggaagtcccggctgaacgcgctcgggaaaagcgagttccaaatctataagaaatctggcattcaggaggtggatcgcacccttgccaaggagggcatcaagagaggggaaaccgaccatcacgctgttagccggggatccgccaaactgagatggtttgtggagcgcaatatggtcacacccgaaggcaaggtggttgatctgggctgcgggcggggaggctggtcttactattgtgggggactcaaaaacgtgagagaggtcaagggcctgaccaaagggggaccgggccatgaagaacctattcccatgagcacatacggctggaatcttgtgcgcctgcagtccggggtggacgttttcttcacgccccctgagaagtgcgataccctcctgtgtgacatcggagaaagctcccccaaccctacaattgaggctggccggaccctgagagtcctcaatcttgtggaaaactggctgaataacaatacacaattttgcatcaaggtgctgaacccgtatatgccctctgtcatcgagaaaatggaaaccctccagcgcaagtacgggggagccctggttcggaatcctcttagcagaaactccacgcacgagatgtactgggtgtctaatgcgaccggcaacattgtgagctccgtcaatatgatctctcgcatgctgattaaccggttcacaatgaaacacaagaaagccacctatgagcccgatgtggacctcgggagcggaacaagaaacatcggcattgaatccgagatccctaatctggatattatcggcaagcgcatcgaaaagattaaacaggagcatgaaaccagctggcactacgaccaggaccatccctataagacatgggcttaccacgggtcttatgagaccaaacaaacgggatccgccagctctatggttaacggcgtggtccggctgctcacaaagccgtgggatgtggttcctatggtgacccagatggctatgaccgacacaacgccctttgggcagcagagagtcttcaaagagaaggtggatacccgcacacaagaacctaaggagggaaccaagaaacttatgagaatcacagccgaatggctgtggaaagagctgggcaaaaagaaaacaccccggatgtgtacacgcgaggaatttaccagaaaagtgcggtccaatgctgccctcggggcgattttcacggacgagaacaagtggaaaagcgccagagaagctgtcgaggatggacggttttgggaactggttgacaaagagcgcaatcttcacctggagggcaagtgcgaaacctgtgtgtacaacatgatgggcaaaagagagaagaaactcggggagttcggaaaggccaagggctctcgggctatctggtatatgtggctgggggcccgctttctggagttcgaagccctcggatttctgaatgaggatcattggttctccagaggcaacagcctttccggggtggagggcgaaggactgcaccggctcggctacattctgcgcgacgtcgggaaaaaggagggaggcgcgatgtacgctgatgacacagccgggtgggataccagaatcacacttgaagacctgaaaaatgaggaaatggtgaccaaccatatgaagggagagcacaaaaagctcgccgaggctatctttaagctgacgtatcagaataaagttgtgcgggtccagcgccctacacccagaggcaccgtgatggacattatcagccggcgcgatcagagagggtctggccaagttggaacatacggcctgaacaccttcacgaatatggaagcccagctcattcggcagatggagggggaaggaatcttcaagagcattcaacatctgaccgctacagaggagatcgccgtgcagaactggcttgcgcgcgtcggcagagaacggctgtccagaatggccatctctggggacgattgcgtggttaaaccgattgacgatcgctttgctagcgccctcaccgctctgaatgacatgggaaaggtgcggaaagatatccagcagtgggagccttccagaggctggaacgactggacacaagtccccttctgctctcaccactttcatgaacttgtgatgaaggatgggcgcgtcctggtggttccctgtcggaaccaggacgagctcattggcagagcccgcatcagccagggagcgggctggtccctgaaggaaaccgcctgcctggggaaatcttatgctcagatgtggacactcatgtacttccaccggagagatctgcgccttgccgctaatgccatttgtagcgctgtgccttcccattgggtcccgaccagccggacgacatggtctatccacgccaagcacgagtggatgaccaccgaggacatgctggcggtgtggaacagagtgtggattcaagaaaatccctggatggaggataaaacacctgttgaatcctgggaggaagtgccctatctcggaaagcgcgaggaccagtggtgcggcagcctgatcgggcttacctctcgggccacatgggctaaaaacatccagacggccattaatcaggtcagatccctgatcggaaacgaggaatacaccgactatatgcctagcatgaagcggtttagacgcgaggaagaggaagccggcgtgctctggtga

SEQ ID NO: 20307 - RNA, 9876 nt, synthetic construct
  misc_feature 1..9876: note = derived and/or modified CDS sequence (opt5) from DENV-2__HQ332186__SS-prME
  source 1..9876: mol_type = other RNA
accgccggcgtgatcgtcatgctgattcccaccgctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtggtgatcacctggattggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggttaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctatcaaagacaatagagccgttcacgcggatatgggctattggatcgaatctgccctcaacgacacgtggaagatggagaaggcttccttcattgaggtgaaaagctgccactggcctaagtctcatacattctggagcaatggggtcctggaatccgagatgatcattcccaaaaactttgccggaccggtgagccagcacaactaccgccctggctatcatacccaaatcgctgggccctggcacctgggaaaacttgaaatggatttcgacttttgtgagggcaccacagtggtcgttaccgaagattgcgggaatcggggaccctctctcagaacgacaaccgcctccggcaaactgattacagagtggtgctgtcggagctgcaccctgcctccgctccgctacagaggcgaggacgggtgttggtacggaatggaaatccggcccctgaaggagaaggaagagaaccttgtgaatagcctggtgacagccggccatgggcagattgataacttctctctcggagtcctgggcatggctctgtttcttgaagagatgctcagaacccgcgtggggacgaaacacgcgatcctgctggttgccgtgagcttcgtcaccctcatcacaggaaatatgtcctttcgggacctgggcagagtgatggttatggtgggcgctaccatgacagatgacattgggatgggagtcacctatcttgccctgctcgccgctttcaaggtgcgccctacgtttgccgcgggcctgctgcttagaaaactgacatctaaggagctcatgatggctaccatcgggattacactgctcagccagtccaccatccccgaaaccattctggagcttacagatgccctggccctcggaatgatggttctgaaaatcgtgcggaacatggaaaagtaccaactggctgtcacgatcatggccatttcttgcgtgcctaatgcggtgatccttcgcaacgcttggaaggtcagctgtaccattctggccgccgtttccgtgagccccctcctgctcacatcttcccagcagaaagctgactggatccctctggcccttaccattaagggcctgaatcccacagctatcttcctcaccacgctgagcagaacatctaaaaagcggtcctggccgctgaacgaggccatcatggcggtggggatggtcagcattcttgcctcttccctgctcaaaaatgacatccctatgaccggacccctggtggctggcggcctcctgaccgtttgctatgtgcttacagggcgcagcgccgatctggaactggagagagctgccgacgtcaagtgggaggatcaggccgaaatttccggaagctctcctatcctcagcattaccatctccgaggacggctctatgagcattaaaaacgaagaggaggaacaaacactgacgatccttatccggaccgggctgctcgtgatttccggagtttttcccgtgtctatcccgattacagctgcggcctggtacctgtgggaggtcaagaagcagcgcgctggcgtgctctgggatgtcccttctccccctcccgtggggaaagccgaactggaggacggagcctatagaatcaagcagcggggcattcttggctactcccagatcggggctggagtttataaagaaggcaccttccacacaatgtggcatgtgacccgcggggccgtcctgatgcacagaggaaagcggatcgagccctcctgggcggatgtgaaaaaggacctgattagctacggcgggggatggaagctcgagggcgaatggaaagagggcgaagaggttcaagtgctggctcttgaacctgggaagaatccgagagccgtccagacgaaacccggaatctttaagaccaacacaggcaccattggggccgtgtccctggatttcagccctggaacatctggctcccccatcgtggaccgcaaagggaaggttgtcggactctacggcaatggcgtggtgacccggagcggggcttatgtctctgccattgcgcagacagagaagtccatcgaggataaccctgaaatcgaggacgatattttccgcaagaagcgcctgacgatcatggacctccatcccggagctggcaaaaccaagcggtacctgcctgccattgtgagagaagccatcaaacgcgggcttcggacactgattctggctccgaccagagttgtggccgctgagatggaagaggccctccgcggactgcccatccggtatcagacccctgcgattaaggccgagcacacaggcagagaaatcgtcgaccttatgtgtcatgctacgtttaccatgcggctgctcagccccgtgcgcgttcctaactacaatctgatcattatggatgaggcccacttcacagaccccgcttccatcgccgccagagggtatatttctacccgggtggaaatgggcgaggctgcgggaatctttatgacagccaccccgcctggcagccgcgatcccttcccccaatccaacgctcctattatggacgaggaaagagagatccccgaacggagctggaactctgggcacgagtgggtcacggattttaagggaaaaacagtgtggttcgttccttccatcaaggccggcaacgacattgccgcttgcctccgcaagaatgggaagaaagtgatccagctgagccgcaagacctttgattctgaatacgtcaagacccgggccaacgactgggatttcgtggtgacaaccgacattagcgagatgggagcgaattttaaagctgagagagtcatcgatccgcgccggtgtatgaagcccgttattcttacagacggcgaagagagagtgatcctggccgggcctatgcccgtgacccattcctctgccgctcagcgccggggcagaatcggacgcaaccctaaaaatgaaaacgaccaatatatttacatgggcgagcccctggaaaatgatgaggactgcgcccactggaaggaggcgaaaatgctcctggataacatcaatacgccggaagggattatccctagcatgttcgagcccgaaagagagaaggtcgacgccattgatggagaataccggcttcgcggcgaggctagaaaaacatttgtggacctgatgcggcgcggggatctccctgtttggctggcctataaggtggctgccgagggaatcaactacgctgacagaaagtggtgtttcgatggcattaaaaataaccagatcctggaagagaacgtcgaagtggagatctggaccaaggagggggaacggaaaaagctcaaacccagatggcttgacgcccgcatttattccgatcctctggcgctgaaggagttcaaggaatttgccgctggccggaaatctctcacactgaatcttatcaccgagatgggaagactgcccacgttcatgacccagaaggcccgcaacgctctcgacaatctggccgttctgcatacagccgaagctggcgggcgggcgtacaaccacgccctcagcgagcttccggagaccctggaaacactgctcctgcttaccctgctcgctacagtgaccggaggcatttttctgttcctgatgtccgggaaaggaatcggcaagatgacgctcggcatgtgctgcattatcacagccagcgtccttctgtggtatgcccagatccaacctcactggattgctgcctctatcattctggagtttttcctcatcgtgctgcttattcccgaacccgagaaacagagaacccctcaggataatcagctgacctacgtcgtgatcgcgatcctcacagttgtggccgctaccatggccaacgaaatggggtttctggagaagacaaagaaagacctgggactcggctccattacgacccaagagccggaaagcaatatccttgacattgatctgcggcccgcttccgcctggacactgtatgcggtggccaccacattcgtcacccctatgctccgccattctatcgagaacagctccgttaatgtgtctctgacggctattgccaaccaggctaccgtgcttatggggctgggaaagggctggcccctcagcaaaatggacatcggggtccctctgctggccattggatgttactcccaggtgaatcccatcacactcaccgctgcccttctgctgctcgttgcgcactacgccatcattggccctggcctgcaggctaaggccacaagagaagctcaaaaacgggccgccgcggggatcatgaagaacccgaccgtggatggaattacggtcatcgaccttgagcccattccttatgatcccaagtttgaaaaacagctgggccaggtgatgctcctgatcctgtgcgtcacacaggtgctcatgatgcgcaccacatgggctctttgtgaggccctgaccctggctaccgggcctatcagcacactctgggagggaaatcccggcagattctggaacacgaccattgccgtttctatggccaatatctttcgggggtcctacctggctggagccggccttctgttcagcattatgaagaacacaaccaatacacgcagaggcaccgggaacatcggagaaacgctcggcgagaaatggaagtctcggctgaacgcgctggggaaatccgaatttcaaatttataagaaaagcggaatccaggaggtggaccgcacactcgccaaggagggcatcaagagaggggaaaccgatcatcacgctgtctctcggggaagcgccaaacttagatggttcgtggagcgcaatatggttaccccggaaggcaaggtggtcgacctgggctgcgggcggggaggctggtcctactattgtgggggactgaaaaacgtgagagaggtgaagggcctcacaaaagggggacctggccatgaggaacccattcccatgtctacctacggctggaatctggttcgccttcagagcggggtcgatgtgttctttacacctcccgagaagtgcgacacgctgctctgtgatatcggagaatccagccctaacccgaccattgaggctggccggacactgagagtgctgaatctcgtcgaaaactggcttaataacaatacccaattctgcatcaaggttctgaacccctatatgccttccgtgattgagaaaatggaaacactgcagcgcaagtacgggggagccctcgtgcggaatcccctgtctagaaacagcacccacgagatgtactgggtctccaatgcgacgggcaacatcgtgtctagcgttaatatgatctcccgcatgcttattaaccggtttaccatgaaacacaagaaagccacatatgagcctgacgtggatctggggtctggaaccagaaacatcggcattgaaagcgagatccccaatctcgacattatcggcaagcgcattgaaaagatcaaacaggagcatgaaacatcctggcactacgaccaggatcatacctataagacatgggcttaccacgggagctatgagaccaaacaaacgggatctgcctccagcatggtcaacggcgtggttcggctgctgacaaagccgtgggacgtggtccctatggtgacccagatggctatgaccgatacaacgcccttcgggcagcagagagtgtttaaagagaaggtcgacacccgcacacaagaacctaaggagggaaccaaaaagctcatgagaatcacagccgaatggctttggaaagagctgggcaagaaaaagacaccccggatgtgtacacgcgaggagttcaccagaaaagttcggtctaatgctgccctgggggcgatttttacggatgagaacaagtggaagtccgccagagaagctgtggaggacggacggttctgggaactcgtggatcgcgagagaaatctgcaccttgagggcaaatgcgaaacctgtgtctacaacatgatgggcaagcgggagaaaaagctgggggaatttggaaaagccaagggcagccgcgctatctggtatatgtggctcggggccagattcctggagtttgaagccctgggattcctcaatgaggaccattggttttctcggggcaactccctgagcggggtggagggcgaaggacttcaccgcctgggctacattctcagagatgttgggaagaaagagggaggcgcgatgtacgctgacgatacagccgggtgggacacccggatcacactggaagaccttaagaatgaggaaatggtgaccaaccatatgaaaggagagcacaagaaactggccgaggctattttcaagctcacgtatcagaataaggtcgtgcgcgttcagagacctacaccccggggcaccgtgatggatatcatctcccgcagagaccagcgggggagcggccaagtcggaacatacggcctgaacaccttcacgaatatggaagcccagctgattcgccagatggagggggaaggaatctttaaatctattcaacatctcaccgtgacagaggagatcgctgttcagaactggctggccagagtgggccgggaaagacttagccgcatggcgatttccggggatgactgcgtcgtgaagccgatcgatgaccggttcgcctctgctctgaccgccctcaatgatatgggaaaagtcagaaaggacatccagcagtgggagcctagccgcggctggaacgattggacacaagtgcccttttgctcccaccacttccatgaactggttatgaaagacgggcgggtgcttgtcgtgccctgtagaaaccaggatgagctgattggccgcgctcggatctctcagggagccggctggagcctcaaggaaaccgcgtgcctggggaagtcctatgcccagatgtggacactgatgtactttcacagacgcgacctccggctggctgccaatgctatttgttctgccgtgcctagccattgggttccgacctccagaacgacatggagcatccacgctaaacacgagtggatgaccaccgaggatatgcttgccgtgtggaaccgcgtctggattcaagaaaatccctggatggaggacaagacacctgtggaatcttgggaggaagttccctatctgggaaaacgggaggaccagtggtgcggctccctcatcgggctgaccagcagagcgacatgggccaagaacattcagacggctatcaatcaggtgcggtctcttatcggaaacgaggaatacaccgattatatgccttccatgaaaagattccgccgggaggaagaggaagccggcgtcctgtggtga

SEQ ID NO: 20308 - RNA, 9876 nt, synthetic construct
  misc_feature 1..9876: note = derived and/or modified CDS sequence (opt5) from DENV-2__HQ332187__SS-prME
  source 1..9876: mol_type = other RNA
accgccggagtgatcattatgctgatccccacagctatggccttccacctcacgaccagaaatggggaacctcatatgattgtcggacggcaggaaaagggaaagagcctgctttttaagacagaggacggggttaatatgtgcaccctgatggcgatcgatctcggagaactgtgtgaggacacaattacctacaagtgcccgcttctgagacaaaatgaacccgaggatatcgactgttggtgcaatagcacatctacctgggtgacgtatggaacctgtacaaccacaggggagcacagacgggaaaagagaagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatctgtggaattagaagcgtgacccgccttgagaatctgatgtggaaacagatcacaccggagctcaaccacattctgtccgaaaatgaggtcaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccgtgagctttgttacactgattaccggaaatatgtccttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatgatcctgaaaattgtccggaacatggaaaagtaccaacttgctgtgaccatcatggccatttcttgcgttcctaatgcggtgatcctgcgcaacgcttggaaggtcagctgtacaattctcgccgccgtgtccgtgagccccctgctcctgacctcttcccagcagaaagctgactggatccctcttgccctgacaatcaagggcctcaatcccaccgctatttttctgacgacactgagcagaacctctaaaaagcggtcctggccgcttaacgaggccatcatggcggtcgggatggttagcattctggcctcttccctcctgaaaaatgacatccctatgaccggacccctcgtggctggcggcctgcttacagtgtgctatgtcctgaccgggcgcagcgccgatctggaactcgagagagctgccgacgtgaagtgggaggatcaggccgaaatttccggaagctctcctatcctgagcattacaatctccgaggacggctctatgagcatcaaaaacgaagaggaggaacaaacgcttaccattctgatccggacagggctcctggttatttccggagtgttccccgtctctatcccgattaccgctgcggcctggtacctctgggaggtgaagaagcagcgcgctggcgttctgtgggatgtgccttctccccctcccgtcgggaaagccgaacttgaggacggagcctatagaatcaagcagcggggcatcctgggctactcccagattggggctggagtgtataaagaaggcacatttcacaccatgtggcatgtcacgcgcggggccgtgctgatgcacagaggaaagcggatcgagccctcctgggcggatgttaaaaaggacctcattagctacggcgggggatggaagctggagggcgaatggaaagagggcgaagaggtgcaagtccttgctctggaacctgggaagaatccgagagccgtgcagaccaaacccggaatcttcaagacaaacaccggcacaattggggccgtttccctcgattttagccctggaacctctggctcccccatcgtggaccgcaaagggaaggtcgtgggactgtacggcaatggcgtggttacacggagcggggcttatgtctctgccatcgcgcagacggagaagtccattgaggataaccctgaaatcgaggacgatattttccgcaagaagcgcctcaccatcatggacctgcatcccggagctggcaaaacaaagcggtaccttcctgtgattgtgagagaagccatcaaacgcgggctgcggaccctgattctcgccccgaccagagtcgtggctgccgagatggaagaggctctgcgcggacttcccatccggtatcagacccctgccatcaaggcggagcacacgggcagagaaattgttgacctgatgtgtcatgccaccttcacaatgcggctcctgagccccgtgcgcgtccctaactacaatctcatcattatggatgaggctcactttaccgaccccgcctccatcgctgccagagggtatatttctacacgggtggaaatgggcgaggccgctggaatcttcatgaccgcgacgccgcctggcagccgcgatccctttccccaatccaacgcccctatcatggacgaggaaagagagattcccgaacggagctggaactctgggcacgagtgggttacagatttcaagggaaaaaccgtgtggtttgtcccttccatcaaggctggcaacgacattgccgcctgcctgcgcaagaatgggaagaaagtgatccagcttagccgcaagaccttcgattctgaatacgttaagacacgggctaacgactgggattttgtggtcaccacagacattagcgagatgggagccaatttcaaagcggagagagtgatcgatccgcgccggtgtatgaagcccgtgatcctgaccgacggcgaagagagagtcattctggctgggcctatgcccgttacgcattcctctgccgcccagcgccggggcagaatcggacgcaaccctaaaaatgaaaacgaccaatatatttacatgggcgagcccctcgaaaatgatgaggactgcgctcactggaaggaggccaaaatgctgcttgataacatcaatacaccggaagggattatccctagcatgtttgagcccgaaagagagaaggtggacgcgattgatggagaataccggctgcgcggcgaggccagaaaaaccttcgtggacctcatgcggcgcggggatctgcctgtctggctggcttataaggtggccgctgagggaatcaactacgccgacagaaagtggtgttttgatggcatcaaaaataaccagattctcgaagagaacgttgaagtggagatctggacaaaggagggggaacggaagaaacttaaacccagatggctggacgctcgcatttattccgatcctctggccctcaaagagttcaaggagttcgcggccggccggaaatctctgacccttaatctgatcacggagatgggaagactccccacctttatgacacagaaggctcgcaacgccctggacaatctggctgtcctccataccgccgaagccggcgggcgggcttacaaccacgcgcttagcgagctgccggagacactggaaaccctcctgcttctgacactcctggccaccgtgacgggaggcattttcctgtttctcatgtccgggaaaggaatcggcaagatgacacttggcatgtgctgcatcattaccgctagcgttctgctgtggtatgcccagatccaacctcactggattgccgcttctatcattctcgagttctttctgatcgtgcttctgatccccgaacccgagaaacagagaacccctcaggataatcagctcacatacgtcgtgattgccatcctgaccgtcgtggcggccacaatggctaacgaaatggggttcctggagaagacgaagaaagacctcggacttggctccattaccacacaagagagcgaatccaatatcctggacattgatctgcggccggcctctgcttggaccctctatgccgttgcgacaacctttgtgacgcccatgctgcgccatagcatcgagaactcctctgtgaatgtcagccttaccgccattgctaaccaggccacagttctgatggggctcggaaagggctggcctctgtccaaaatggacatcggggtgcccctgctcgctatcggatgttacagccaggtgaatcctattacccttacagccgctctgctgctcctggtcgcccactacgcgatcattggccccggccttcaggccaaggctaccagagaagcccaaaaacgggctgccgccgggatcatgaagaaccctacggtggatggaattacagttatcgacctggagccgatcccctatgatcctaagttcgaaaaacagctcggccaggtgatgctgctgattctctgcgtcacccaggtgcttatgatgcgcacaacctgggcgctgtgtgaggctctgaccctcgccacagggcccatctctacgctgtgggagggaaatcctggcagattttggaacaccacaattgctgtctccatggccaatatcttccgggggagctaccttgccggagctggcctgctcttttctattatgaagaacaccacaaatacccgcagaggcacggggaacatcggagaaacactgggcgagaaatggaagtcccggctgaacgccctcgggaaaagcgagttccaaatctataagaaatctggcattcaggaggtggaccgcacccttgcgaaggagggcatcaagagaggggaaaccgatcatcacgccgttagccggggatccgctaaactgagatggtttgtggagcgcaatatggtcacacccgaaggcaaggtggttgacctgggctgcgggcggggaggctggtcttactattgtgggggactcaaaaacgtgagagaggtcaagggcctgaccaaagggggaccgggccatgaagaacctattcccatgagcacatacggctggaatcttgtgcgcctgcagtccggggtggatgttttcttcacgccccctgagaagtgcgacaccctcctgtgtgatatcggagaaagctcccccaaccctacaattgaggccggccggaccctgagagtcctcaatcttgtggaaaactggctgaataacaatacacaattttgcatcaaggtgctgaacccgtatatgccctctgtcatcgagaaaatggaaaccctccagcgcaagtacgggggagctctggttcggaatcctcttagcagaaactccacgcacgagatgtactgggtgtctaatgccaccggcaacattgtgagctccgtcaatatgatctctcgcatgctgattaaccggttcacaatgaaacacaagaaagcgacctatgagcccgacgtggatctcgggagcggaacaagaaacatcggcattgaatccgagatccctaatctggacattatcggcaagcgcatcgaaaagattaaacaggagcatgaaaccagctggcactacgaccaggatcatccctataagacatgggcctaccacgggtcttatgagaccaaacaaacgggatccgctagctctatggttaacggcgtggtccggctgctcacaaagccgtgggacgtggttcctatggtgacccagatggccatgaccgatacaacgccctttgggcagcagagagtcttcaaagagaaggtggacacccgcacacaagaacctaaggagggaaccaagaaacttatgagaatcacagctgaatggctgtggaaagagctgggcaaaaagaaaacaccccggatgtgtacacgcgaggaatttaccagaaaagtgcggtccaatgccgctctcggggccattttcacggatgagaacaagtggaaaagcgcgagagaagccgtcgaggacggacggtttggcgaactggttgataaagagcgcaatcttcacctggagggcaagtgcgaaacctgtgtgtacaacatgatggggaaaagagagaagaaactcggagagttcggcaaggctaaggggtctcgggccatctggtatatgtggctgggagctcgctttctggagttcgaagccctcggctttctgaatgaggaccattggttctccagagggaacagcctttccggcgtggagggagaaggcctgcaccggctcgggtacattctgcgcgatgtcggcaagaaggagggcggggccatgtacgcggacgatacagctggatgggacaccagaatcacacttgaagacctgaaaaatgaggaaatggtgaccaaccatatgaagggcgagcacaaaaagctcgccgaggccatctttaagctgacgtatcagaataaagttgtgcgggtccagcgccctacacccagagggaccgtgatggatattatcagccggcgcgaccagagaggctctggacaagttggcacatacgggctgaacaccttcacgaatatggaagctcagctcattcggcagatggagggagaaggcatcttcaagagcattcaacatctgaccgccacagaggagatcgctgtgcagaactggcttgcccgcgtcgggagagaacggctgtccagaatggcgatctctggagatgactgcgtggttaaaccgattgatgaccgctttgccagcgctctcaccgccctgaatgatatgggcaaggtgcggaaagacatccagcagtgggagccttccagagggtggaacgattggacacaagtccccttctgctctcaccactttcatgaacttgtgatgaaggacggccgcgtcctggtggttccctgtcggaaccaggatgagctcattggcagagctcgcatcagccagggcgccgggtggtccctgaaggaaaccgcgtgcctgggaaaatcttatgcccagatgtggacactcatgtacttccaccggagagacctgcgccttgctgccaatgctatttgtagcgccgtgccttcccattgggtcccgaccagccggacgacatggtctatccacgctaagcacgagtggatgaccaccgaggatatgctggccgtgtggaacagagtgtggattcaagaaaatccctggatggaggacaaaacacctgttgaatcctgggaggaagtgccctatctcggcaagcgcgaggaccagtggtgcgggagcctgatcggacttacctctcgggcgacatgggccaaaaacatccagacggctattaatcaggtcagatccctgatcggcaacgaggaatacaccgattatatgcctagcatgaagcggtttagacgcgaggaagaggaagccggggtgctctggtga

SEQ ID NO: 20309 - RNA, 9876 nt, synthetic construct
  misc_feature 1..9876: note = derived and/or modified CDS sequence (opt5) from DENV-2__HQ332188__SS-prME
  source 1..9876: mol_type = other RNA
acagccggcgtgatcgttatgctgattcccacagctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtggtgatcacctggattggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggttaagctgaccatcatgacaggcgacaccaaaggggtgatgcaggccggaaagcggtctcttagacctcaacccacggaactcaaatatagctggaagacctggggcaaggcgaaaatgctgtccacagagagccataaccagaccttcctgattgatgggcctgaaacaaccgagtgccccaatacaaaccgcgcctggaactctctcgaggtcgaagactacggatttggcgtgttcaccacgaacatctggctgaaacttcgggagaaacaggacgtcttttgtgattccaagctgatgagcgctgccattaaagacaatagagctgtgcacgccgatatgggctattggatcgaatctgcgctcaacgacacatggaagatggagaaggcctccttcatcgaggtcaaaagctgccactggcctaagtctcataccctgtggagcaatggggtgctggaatccgagatgattatccccaaaaacttcgctggaccggtgagccagcacaactaccgccctggctatcatacccaaattgccgggccctggcaccttggaaagctcgaaatggattttgacttctgtgagggcacaaccgtcgttgtgacggaagattgcgggaatcggggaccctctctgagaacaaccacagcttccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtcaccgccggccatgggcagatcgataacttttctctgggagtgctgggcatggcccttttcctcgaagagatgctgagaacgcgcgttgggaccaaacacgctattctgctcgtggcggtcagctttgtgacactgatcaccggaaatatgtccttccgggaccttggcagagttatggtgatggtcggcgccacaatgaccgatgacatcgggatgggagctacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatggttctgaaaattgtgcggaacatggaaaagtaccaacttgctgtcaccatcatggccatctcttgcgtgcctaatgcggtgattctgcgcaacgcttggaaggtcagctgtacaatcctcgccgccgtttccgtgagccccctgctcctgacctcttcccagcagaaagctgactggattcctcttgccctgacaatcaagggcctcaatcccaccgctatttttctgacgacactgagcagaacctctaaaaagcggtcctggccgcttaacgaggccatcatggcggtggggatggtcagcatcctggcctcttccctcctgaaaaatgacattcctatgaccggacccctcgtggctggcggcctgcttacagtttgctatgtgctgaccgggcgcagcgccgatctggaactcgagagagctgccgacgtcaagtgggaggatcaggccgaaatctccggaagctctcctattctgagcatcacaatttccgaggacggctctatgagcatcaaaaacgaagaggaggaacaaacgcttaccattctgatccggacagggctcctggtgatctccggagttttccccgtgtctattccgatcaccgctgcggcctggtacctctgggaggtcaagaagcagcgcgctggcgtgctgtgggatgtcccttctccccctcccgtggggaaagccgaacttgaggacggagcctatagaattaagcagcggggcatcctgggctactcccagattggggctggagtttataaagaaggcacatttcacaccatgtggcatgtgacgcgcggggccgtcctgatgcacagaggaaagcggatcgagccctcctgggcggatgtgaaaaaggacctcatcagctacggcgggggatggaagctggagggcgaatggaaagagggcgaagagattcaagttcttgctctggaacctgggaagaatccgagagccgtgcagaccaaacccggaatcttcaagacaaacaccggcacaattggggccgtctccctcgattttagccctggaacctctggctcccccatcgtggaccgcaaagggaaggtggttggactgtacggcaatggcgtcgtgacacggagcggggcttatgtgtctgccattgcgcagacggagaagtccatcgaggataaccctgaaatcgaggacgatattttccgcaagaagcgcctcaccatcatggacctgcatcccggagctggcaaaacaaagcggtaccttcctgccattgtcagagaagccatcaaacgcgggctgcggaccctgattctcgctccgaccagagtggttgccgctgagatggaagaggccctgcgcggacttcccatccggtatcagacccctgcgattaaggccgagcacacgggcagagaaatcgtggacctgatgtgtcatgctaccttcacaatgcggctcctgagccccgtccgcgtgcctaactacaatctcatcattatggatgaggcccactttaccgaccccgcttccatcgccgccagagggtatatttctacacgggttgaaatgggcgaggctgcgggaatcttcatgaccgccacgccgcctggcagccgcgatccctttccccaatccaacgctcctattatggacgaggaaagagagatccccgaacggagctggaactctgggcacgagtgggtgacagatttcaagggaaaaaccgtctggtttgtgccttccatcaaggccggcaacgacattgccgcttgcctgcgcaagaatgggaagaaagttatccagcttagccgcaagaccttcgattctgaatacgtgaagacacgggccaacgactgggattttgtcgtgaccacagacattagcgagatgggagcgaatttcaaagctgagagagtgatcgatccgcgccggtgtatgaagcccgtcattctgaccgacggcgaagagagagttatcctggccgggcctatgcccgtgacgcattcctctgccgctcagcgccggggcagaatcggacgcaaccctaaaaatgaaaacgaccaatatatttacatgggcgagcccctcgaaaatgatgaggactgcgcccactggaaggaggcgaaaatgctgcttgataacatcaatacaccggaagggattatccctagcatgtttgagcccgaaagagagaaggtggacgccattgatggagaataccggctgcgcggcgaggctagaaaaaccttcgtcgacctcatgcggcgcggggatctgcctgtgtggctggcctataaggttgctgccgagggaatcaactacgctgacagaaagtggtgttttgatggcattaaaaataaccagatcctcgaagagaacgtggaagtcgagatctggacaaaggagggggaacggaagaaacttaaacccagatggctggacgcccgcatttattccgatcctctggcgctcaaagagttcaaggagttcgccgctggccggaaatctctgacccttaatctgatcacggagatgggaagactccccacctttatgacacagaaggcccgcaacgctctggacaatctggccgtgctccataccgccgaagctggcgggcgggcgtacaaccacgcccttagcgagctgccggagacactggaaaccctcctgcttctgacactcctggctaccgttacgggaggcattttcctgtttctcatgtccgggaaaggaatcggcaagatgacacttggcatgtgctgcattatcaccgccagcgtgctgctgtggtatgcccagatccaacctcactggattgctgcctctatcattctcgagttctttctgatcgtccttctgattcccgaacccgagaaacagagaacccctcaggataatcagctcacatacgtggtcatcgcgatcctgaccgtggttgccgctacaatggccaacgaaatggggttcctggagaagacgaagaaagacctcggacttggctccattaccacacaagagccggaaagcaatatcctggacattgatctgcggcccgcttccgcctggaccctctatgcggtggccacaacctttgtgacgcctatgctgcgccattctatcgagaacagctccgtcaatgtttctcttaccgctattgccaaccaggctacagtgctgatggggctcggaaagggctggcccctgagcaaaatggacatcggggtgcctctgctcgccattggatgttactcccaggtcaatcccatcacccttacagctgccctgctgctcctggtggcgcactacgccatcattggccctggccttcaggctaaggccaccagagaagctcaaaaacgggccgccgcggggatcatgaagaacccgacggttgatggaattacagtgatcgacctggagcccattccttatgatcccaagttcgaaaaacagctcggccaggtcatgctgctgatcctctgcgtgacccaggtccttatgatgcgcacaacctgggctctgtgtgaggccctgaccctcgctacagggcctatcagcacgctgtgggagggaaatcccggcagattttggaacaccacaattgccgtgtctatggccaatatcttccgggggtcctaccttgctggagccggcctgctctttagcattatgaagaacaccacaaatacccgcagaggcacggggaacatcggagaaacactgggcgagaaatggaagtctcggctgaacgcgctcgggaaatccgagttccaaatttataagaaaagcggaatccaggaggttgaccgcacccttgccaaggagggcatcaagagaggggaaaccgatcatcacgctgtgtctcggggaagcgccaaactgagatggtttgtcgagcgcaatatggtgacaccggaaggcaaggttgtggacctgggctgcgggcggggaggctggtcctactattgtgggggactcaaaaacgtcagagaggtgaagggcctgaccaaagggggacctggccatgaagaacccattcccatgtctacatacggctggaatcttgtgcgcctgcagagcggggttgatgtcttcttcacgcctcccgagaagtgcgacaccctcctgtgtgatatcggagaatccagccctaacccgacaattgaggctggccggaccctgagagtgctcaatcttgtggaaaactggctgaataacaatacacaattttgcatcaaggtcctgaacccctatatgccttccgttattgagaaaatggaaaccctccagcgcaagtacgggggagccctggtgcggaatcccctttctagaaacagcacgcacgagatgtactgggtgtccaatgcgaccggcaacatcgtctctagcgtgaatatgatctcccgcatgctgattaaccggttcacaatgaaacacaagaaagccacctatgagcctgacgttgatctcgggtctggaacaagaaacatcggcattgaaagcgagatccccaatctggacattatcggcaagcgcattgaaaagatcaaacaggagcatgaaacctcctggcactacgaccaggatcatccgtataagacatgggcttaccacgggagctatgagaccaaacaaacgggatctgcctccagcatggtgaacggcgtcgtgcggctgctcacaaagccttgggacgttgtgcccatggtcacccagatggctatgaccgatacaacgccttttgggcagcagagagtgttcaaagagaaggtggacacccgcacacaagaacccaaggagggaaccaagaaacttatgagaatcacagccgaatggctgtggaaagagctgggcaaaaagaaaacccctcggatgtgtacacgcgaggaatttaccagaaaagtccggtctaatgctgccctcggggcgattttcacggatgagaacaagtggaagtccgccagagaagctgttgaggacggacggttttgggaactggtggatcgcgagagaaatcttcacctggagggcaaatgcgaaacctgtgtgtacaacatgatgggcaagcgggagaaaaagctcggggagttcggaaaagccaagggcagccgcgctatctggtatatgtggctgggggccagatttctggagttcgaagccctcggatttctgaatgaggaccattggttctctcggggcaactcccttagcggggtcgagggcgaaggactgcaccgcctcggctacattctgagagatgtggggaagaaagagggaggcgcgatgtacgctgacgatacagccgggtgggacacccggatcacacttgaagacctgaagaatgaggaaatggttaccaaccatatgaaaggagagcacaagaaactcgccgaggctatttttaagctgacgtatcagaataaggtggtccgcgtgcagagacccacaccgcggggcaccgttatggatatcatctcccgcagagaccagcgggggagcggccaagtgggaacatacggcctgaacaccttcacgaatatggaagcccagctcattcgccagatggagggggaaggaatcttcaaatctattcaacatctgaccgtcacagaggagatcgctgtgcagaactggcttgccagagttggccgggaaagactgagccgcatggcgatttccggggatgactgcgtggtcaagcctatcgatgaccggtttgcctctgctctcaccgccctgaatgatatgggaaaagtgagaaaggacatccagcagtgggagcccagccgcggctggaacgattggacacaagtccccttctgctcccaccactttcatgaacttgtgatgaaagacgggcgggttctggtggtcccttgtagaaaccaggatgagctcattggccgcgctcggatctctcagggagccggctggagcctgaaggaaaccgcgtgcctggggaagtcctatgcccagatgtggacactcatgtacttccacagacgcgacctgcggcttgctgccaatgctatttgttctgccgtgccgagccattgggtgcccacctccagaacgacatggagcatccacgctaaacacgagtggatgaccaccgaggatatgctggccgtttggaaccgcgtgtggattcaagaaaatccttggatggaggacaagacacccgtcgaatcttgggaggaagtgccttatctcggaaaacgggaggaccagtggtgcggctccctgatcgggcttaccagcagagcgacatgggccaagaacattcagacggctatcaatcaggttcggtctctgatcggaaacgaggaatacaccgattatatgccctccatgaaaagatttcgccgggaggaagaggaagccggcgtgctctggtga

SEQ ID NO: 20310 - RNA, 9876 nt, synthetic construct
  misc_feature 1..9876: note = derived and/or modified CDS sequence (opt5) from DENV-2__HQ332189__SS-prME
  source 1..9876: mol_type = other RNA
accgccggcgtgatcgtcatgctgattcccaccgctatggccttccacctcacgaccagaaacggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaacgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagaactggatcctgcgccatcccgggttcaccattatggccgctatcctcgcctacacaattggaaccacccactttcagagagctctgatcttcattcttctgacagccgtcgcgcctagcatgacgatgcggtgcatcggcatttccaatcgcgattttgtggaaggggtttctggaggcagctgggtggacatcgtcctcgagcacgggtcctgtgtgaccacaatggccaagaacaagcccaccctggatttcgaacttatcaaaacagaggctaagcagcctgccaccctgagaaaatattgcattgaagctaagctcacgaatacaaccaccgagagccggtgtccgacacaaggagagccctctctgaacgaagaacaggacaaacgctttatctgcaagcattccatggtggatagaggctggggcaatgggtgtggactgttcggcaaaggcgggattgttacctgcgccatgtttacatgcaaaaagaacatggaagggaaagttgtgcagcctgagaatctcgaatacacgatcgtgattacaccccacagcggggaggagcatgcggtcggaaacgacacaggcaagcacggcaaagaaatcaagatcacccctcagtcttccattacagaggccgaactgaccgggtatggaacggtgaccatggagtgtagcccccggacaggccttgatttcaatgaaatggttctgctccaaatggaggacaaggcttggctggtgcaccgccagtggtttcttgatctgccgctcccttggctgcccggggccgacacccagggatctaactggatccagaaggagacactggtcaccttcaagaatcctcatgctaaaaagcaagacgtggttgtgctcggctcccaggaaggggccatgcacacggccctgacaggcgctaccgagattcagatgagctccggaaaccttctgtttacaggccatctcaaatgcagactgcggatggataaacttcaactgaaagggatgtcttacagcatgtgtaccggaaagttcaagatcgtcaaagaaattgcggagacccagcacggcacaatcgtgatcagagtccagtatgagggggacggatccccctgcaagattcccttcgaaatcacggatctcgagaaacgccatgtgctgggccggctgattaccgttaaccctatcgtgattgaaaaggacagcccggtcaatatcgaggccgaacccccttttggggattcttacgtgattatcggcgttgagcccggacagctcaaactgaactggttcaagaagggctccagcatcgggcaaatgtttgagacaaccatgagaggagctaaacgcatggccattcttggcgacacagcctgggatttcgggtctctgggaggcgtgtttaccagcatcgggaaggctctccaccaggtcttcggcgccatttacggagcggctttttccggcgtgtcttggacgatgaaaatcctgattggggtggttatcacatggatcggaatgaatagccggtccaccagcctgtctgtctcccttgtgctcgtgggcgtcgtgaccctgtatctgggggccatggttcaggccgacagcggatgtgtggtctcttggaagaacaaagaactcaagtgcggctccgggattttcatcacagataatgtgcacacctggacagagcagtacaagtttcaacctgaaagcccctccaaactggcttctgccattcagaaggctcatgaggaaggcatctgtggaattagaagcgttacgcgccttgagaacctgatgtggaaacagatcaccccggagctcaatcacatcctgtccgaaaacgaggtgaagctgacaattatgaccggcgacacaaaagggatcatgcaggccggaaagcggtctcttagacctcaacccaccgaactcaaatatagctggaagacgtggggcaaggcgaaaatgctgtccaccgagagccataatcagacattcctgattgatgggcctgaaaccgccgagtgccccaacacaaatcgcgcttggaactctctcgaggtcgaagactacggatttggcgtgttcaccacaaatatctggctgaaacttcgggagaaacaggacgtcttttgtgattccaagctgatgagcgccgctattaaagacaacagagccgtgcacgcggatatgggctattggatcgaatctgccctcaatgacacctggaagatggagaaggcttccttcatcgaggtcaaaagctgccactggcctaagtctcatacgctgtggagcaacggggtgctggaatccgagatgattatccccaaaaacttcgccggaccggtgagccagcacaattaccgccctggctatcatacacaaaccgctgggccctggcaccttggaaagctcgaaatggattttgacttctgtgagggcaccacagtcgttgtgaccgaagattgcgggaaccggggaccctctctgagaacgacaaccgcctccggcaaactgattacagagtggtgctgtcggagctgcaccctccctccgctgcgctacagaggcgaggacgggtgttggtacggaatggaaatccggccccttaaggagaaggaagagaatctggtgaactccctcgtcacagccggccatgggcagattgataatttttctctgggagtgctgggcatggctcttttcctcgaagagatgctgagaacccgcgttgggacgaaacacgcgatcctgctcgtggccgtcagctttgtgaccctgattacaggaaacatgtccttccgggaccttggcagagttatggtgatggtcggcgctaccatgacagatgacatcgggatgggagtgacctatctggccctcctggccgcttttaaggttcgccctacgttcgccgcgggcctgcttctgagaaaactcacatctaaggagctgatgatggctaccatcgggattacactcctgagccagtccaccatccccgaaaccattcttgagctgacagatgccctcgccctgggaatgatggtgctgaaaatcgtccggaatatggaaaagtaccaacttgctgtgacgattatggccatctcttgcgtgcctaacgcggtcatcctgcgcaatgcttggaaggttagctgtaccattctcgccgccgtgtccgtgagccccctgctcctgacatcttcccagcagaaagctgactggatccctcttgccctgaccattaagggcctcaaccccacagctatctttctgaccacgctgagcagaacatctaaaaagcggtcctggccgcttaatgaggccattatggcggtcgggatggtgagcatcctggcctcttccctcctgaaaaacgacatccctatgaccggacccctcgttgctggcggcctgcttaccgtgtgctatgtcctgacagggcgcagcgccgatctggaactcgagagagctgccgacgtgaagtgggaggatcaggccgaaatttccggaagctctcctatcctgagcattaccatctccgaggacggctctatgagcattaaaaatgaagaggaggaacaaacacttacgatcctgattcggaccgggctcctggttatctccggagtgttccccgtctctatcccgattacagctgcggcctggtacctctgggaggtgaagaagcagcgcgctggcgtcctgtgggatgtgccttctccccctcccgttgggaaagccgaacttgaggacggagcctatagaatcaagcagcggggcattctgggctactcccagatcggggctggagtgtataaagaaggcacctttcacacaatgtggcatgtcacccgcggggccgtgctgatgcacagaggaaagcggattgagccctcctgggcggatgttaaaaaggacctcatcagctacggcgggggatggaagctggagggcgaatggaaagagggcgaagaggtgcaagtccttgctctggaacctgggaagaacccgagagccgtgcagacgaaacccggaatcttcaagaccaatacaggcaccattggggccgtgtccctcgattttagccctggaacatctggctcccccatcgttgaccgcaaagggaaggtcgtgggactgtacggcaacggcgtggtcacccggagcggggcttatgtgtctgccattgcgcagacagagaagtccatcgaggataaccctgaaattgaggacgatatcttccgcaagaagcgcctcacgatcatggacctgcatcccggagctggcaaaaccaagcggtaccttcctgccattgttagagaagccatcaaacgcgggctgcggacactgattctcgctccgaccagagtggtcgccgctgagatggaagaggccctgcgcggacttcccatccggtatcagacccctgcgattaaggccgagcacacaggcagagaaatcgtggacctgatgtgtcatgctacgttcaccatgcggctcctgagccccgttcgcgtgcctaattacaacctcattatcatggatgaggcccactttacagaccccgcttccatcgccgccagagggtatatttctacccgggtcgaaatgggcgaggctgcgggaatcttcatgacagccaccccgcctggcagccgcgatccctttccccaatccaatgctcctattatggacgaggaaagagagatccccgaacggagctggaactctgggcacgagtgggtgacggatttcaagggaaaaacagtttggtttgtgccttccattaaggccggcaatgacatcgccgcttgcctgcgcaagaacgggaagaaagtcatccagcttagccgcaagaccttcgattctgaatacgtgaagacccgggccaatgactgggattttgtggtcacaaccgacattagcgagatgggagcgaacttcaaagctgagagagttatcgatccgcgccggtgtatgaagcccgtgattctgacagacggcgaagagagagtgatcctggccgggcctatgcccgtcacccattcctctgccgctcagcgccggggcagaattggacgcaatcctaaaaacgaaaatgaccaatatatctacatgggcgagcccctcgaaaacgatgaggactgcgcccactggaaggaggcgaaaatgctgcttgataatatcaacacgccggaagggattatccctagcatgtttgagcccgaaagagagaaggtggacgccattgatggagaataccggctgcgcggcgaggctagaaaaacattcgttgacctcatgcggcgcggggatctgcctgtgtggctggcctataaggtcgctgccgagggaatcaattacgctgacagaaagtggtgttttgatggcattaaaaacaaccagatcctcgaagagaatgtggaagttgagatttggaccaaggagggggaacggaagaaacttaaacccagatggctggacgcccgcatctattccgatcctctggcgctcaaagagttcaaggagttcgccgctggccggaaatctctgacacttaacctgatcaccgagatgggaagactccccacgtttatgacccagaaggcccgcaatgctctggacaacctggccgtgctccatacagccgaagctggcgggcgggcgtacaatcacgcccttagcgagctgccggagaccctggaaacactcctgcttctgaccctcctggctacagtcaccggaggcattttcctgtttctcatgtccgggaaaggaatcggcaagatgacgcttggcatgtgctgcattatcacagccagcgtgctgctgtggtatgcccagattcaacctcactggatcgctgcctctatcattctcgagttctttctgatcgtccttctgattcccgaacccgagaaacagagaacccctcaggataaccagctcacctacgtggttatcgcgattctgacagtggtggccgctaccatggccaatgaaatggggttcctggagaagacaaagaaagacctcggacttggctccatcacgacccaagagagcgaatccaacatcctggacattgatctgcggccggcttctgcctggacactctatgcggtcgccaccacatttgttacccccatgctgcgccatagcatcgaaaatagctctgtgaacgtgagccttacggctattgccaatcaggctaccgtcctgatggggctcggaaagggctggcctctgtccaaaatggacatcggggtgcccctgctcgccattggatgttacagccaggttaaccctatcacacttaccgctgccctgctgctcctggtggcgcactacgccattatcggccccggccttcaggctaaggccacaagagaagctcaaaaacgggccgccgcggggatcatgaagaatcctaccgtcgatggaattacggtgatcgacctggagccgattccctatgatcctaagttcgaaaaacagctcggccaggtcatgctgctgatcctctgcgtgacacaggttcttatgatgcgcaccacatgggctctgtgtgaggccctgaccctcgctaccgggcccatttctacactgtgggagggaaaccctggcagattttggaatacgaccatcgccgtgtccatggccaacatcttccgggggagctaccttgctggagccggcctgctcttttctattatgaagaatacaaccaacacacgcagaggcaccgggaacatcggagaaacgctgggcgagaaatggaagtcccggctgaatgcgctcgggaaaagcgagttccaaatttataagaaatctggaatccaggaggtcgaccgcacacttgccaaggagggcattaagagaggggaaaccgatcatcacgctgtgagccggggatccgccaaactgagatggtttgttgagcgcaacatggtgacccccgaaggcaaggtcgtggacctgggctgcgggcggggaggctggtcttactattgtgggggactcaaaaatgtgagagaggttaagggcctgacaaaagggggaccgggccatgaagaacctatccccatgagcacctacggctggaaccttgtccgcctgcagtccggggtggatgtgttcttcacaccccctgagaagtgcgacacgctcctgtgtgatatcggagaaagctccccctctcctaccattgaggctggccggacactgagagtcctcaatcttgttgaagactggctgaacaataacacccaattttgcatcaaggtgctgaatccgtatatgcccagcgtgattgagaaaatggaaacactccagcgcaagtacgggggagccctggtccggaaccctctttccagaaattctacccacgagatgtactgggtgagcaacgcgacgggcaatatcgtttcctctgtgaacatgattagccgcatgctgatcaatcggttcaccatgaaacacaagaaagccacatatgagcccgatgtcgacctcgggtccggaaccagaaacatcggcattgaaagcgagatccctaacctggacattatcggcaagcgcattgaaaagatcaaacaggagcatgaaacatcttggcactacgatcaggaccatacctataagacatgggcttaccacgggtcctatgagaccaaacaaacgggaagcgcctcttccatggtgaatggcgttgtgcggctgctcacaaagccctgggatgtcgtgccgatggtgacccagatggctatgaccgacacaacgccttttgggcagcagagagtcttcaaagagaaggttgatacccgcacacaagaacccaaggagggaaccaagaaacttatgagaattacagccgaatggctgtggaaagagctgggcaaaaagaaaacccctcggatgtgtacacgcgaggaatttaccagaaaagtgcggagcaacgctgccctcggggcgatcttcacggacgagaataagtggaagtctgccagagaagctgtggaggatggacggttttgggaactggtcgaccgcgagagaaaccttcacctggagggcaaatgcgaaacctgtgtgtacaatatgatgggcaagcgggagaaaaagctcggggagttcggaaaagccaagggctcccgcgctatctggtatatgtggctgggggccagatttctggagttcgaagccctcggatttctgaacgaggatcattggttcagccggggcaattcccttagcggggttgagggcgaaggactgcaccgcctcggctacattctgagagacgtggggaagaaagagggaggcgcgatgtacgctgatgacacagccgggtgggacacccggatcacacttgaagatctgaagaacgaggaaatggtcaccaatcatatgaaaggagagcacaagaaactcgccgaggctatttttaagctgacgtatcagaacaaggtggttcgcgtgcagagacccacacctcggggcaccgtcatggacatcatttctcgcagagatcagcgggggagcggccaagtgggaacatacggcctgaataccttcacgaacatggaagcccagctcatccgccagatggagggggaaggaatcttcaaatccattcaacatctgaccgctacagaggagatcgccgttcagaattggcttgcgagagtgggccgggaaagactgtctcgcatggccattagcggggacgattgcgtcgtgaagcccatcgacgatcggtttgcttccgccctcaccgctctgaacgacatgggaaaagtcagaaaggatattcagcagtgggagccgtctcgcggctggaatgactggacacaagtgcctttctgcagccaccactttcatgaacttgttatgaaagatgggcgggtgctggtcgtgccctgtagaaaccaggacgagctcatcggccgcgcccggatctcccagggagcgggctggtctctgaaggaaaccgcctgcctgggaaagagctatgctcagatgtggacactcatgtacttccacagacgcgatctgcggcttgccgctaacgccatttgttccgctgtgcccagccattgggttcctacctctagaacgacatggtccatccacgccaaacacgagtggatgaccaccgaggacatgctggcggtgtggaatcgcgtctggattcaagaaaacccgtggatggaggacaagacacccgtggaaagctgggaggaagttccttatctcggaaaacgggaggatcagtggtgcggctctctgatcgggcttacctccagagccacatgggctaagaatattcagacggccatcaaccaggtgcggagcctgattggaaatgaggaatacaccgactatatgccctccatgaaaagatttcgccgggaggaagaggaagccggcgtcctctggtga

SEQ ID NO: 20311 - RNA, 9876 nt, synthetic construct
  misc_feature 1..9876: note = derived and/or modified CDS sequence (opt5) from DENV-2__JN368476__SS-prME
  source 1..9876: mol_type = other RNA
tccgctggaatgatcattatgctgatccccacagtgatggctttccacctcacaacgagaaacggggagcctcatatgattgtcgggatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtcttccgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagtccaaggcttggctggtgcaccggcagtggtttcttgacctgccgctcccttggctgcccggggccgataagcagggaagcaactggattcagaaagagaccctggtcacattcaagaatcctcatgctaaaaagcaagacgtggttgtgctcggctcccaggaaggggccatgcacaccgccctgacgggcgctacagagatccagatgtctagcggaaaccttctgtttaccggccatctcaaatgccgcctgagaatggacaaacttcaactgaaggggatgtcctacagcatgtgtacaggaaaattcaaggtcgtgaaagaaattgcggagacccagcacggcaccatcgtcattcgggtgcagtatgagggggatggatctccctgcaagatccccttcgaaatcatggacctcgagaaaagatacgttctgggccgcctgattacagtgaatcctatcgtcacggaaaaggattccccggtgaacattgaggccgaacccccttttggggacagctacatcattatcggcgttgagcccggacagctcaagctgaactggttcaaaaagggctctagcattgggcaaatgtttgagaccacaatgcggggagctaaaagaatggccatccttggcgataccgcctgggacttcgggtccctgggaggcgtgtttacatctatcgggaaggctctccatcaggtcttcggcgccatttatggagcggcttttagcggcgtgtcctggaccatgaaaatcctgattggggtgatcattacgtggatcggaatgaatagccgctctacatccctgagcgtttctcttgtcctcgtgggcatcgtgaccctgtacctgggggtcatggtgcaggccgattccggatgtgttgtgagctggaagaacaaggaactcaaatgcggctccgggattttcatcaccgacaatgtccacacatggaccgagcagtataagtttcaacctgaatctcccagcaaactggcctccgctattcagaaggcccaggaggaaggcatctgtggcattcggtctgtgacaagacttgagaacctgatgtggaaacagatcacgccggagctcaatcacatcctggctgaaaacgaggttaagctgaccattatgacaggcgatatcaaagggattatgcaagccggaaagcgcagccttcggcctcagcccaccgaactcaagtactcctggaaaacatggggcaaggcgaaaatgctgagcaccgagtctcataatcagacgttcctgatcgacgggcctgaaaccgccgagtgccccaacacaaatagagcttggaactccctcgaggtggaagattatggatttggcgtcttcaccacaaatatttggctgaaacttaaagagaagcaggacgccttttgtgacagcaagctgatgtctgctgccatcaaagataaccgcgcggtgcacgccgacatgggctactggatcgaatccgctctcaatgatacctggaagattgagaaagccagcttcatcgaggttaagaactgccattggcctaaatctcacacactgtggagcaatggggtgctggaatccgagatgattatccccaagaaccttgctggaccggtcagccaacacaactatcggcctggctaccatacccagacggccgggccctggcacctcggaaagctggaaatggacttcgatttttgtgacggcacaaccgtgattgtgaccgaggattgcgggaatagaggaccctctctgcgcacaaccacggcctccggcaaactcatcacagaatggtgctgtcggagctgcaccctgcctccgcttagataccggggcgaggacgggtgttggtatggaatggagattcgccccctgaaggaaaaagaggaaaacctcgtcaattccctggttacagctggccatggacaggtggataacttctctctgggagtgcttggcatggcgctctttctggaggaaatgctgagaacccgggtcgggacaaagcacgccatcctcctggtggctgttagcttcgtgacccttatcacgggaaatatgtcctttaaagacctgggcagagtcgtggttatggtgggcaccacaatgaccgatgacattgggatgggagtcacatacctcgccctgctggccgctttcaaggtgcgccctacctttgccgcgggccttctgctccggaagctgacgtctaaagagctcatgatgacaaccatcgggattgttctgcttagccaatccacaatccccgagaccattctggaactcaccgatgctctggccctgggaatgatggtgcttaagatcgtcagagacatggagaaatatcagctggccgtgacaatcatggctattctctgcgtgcctaacgccgtcatcctgcagaatgcgtggaaggtttcttgtacgattctcgctgtggtgagcgtcagccccctgcttctgaccagctctcagcagaagacagactggatccctctcgccctgaccattaagggcctgaaccccacagccatcttccttaccacgctgtcccgcacaaataaaaagagaagctggccgctcaacgaagctatcatggccgtggggatggtttctattctggcttccagcctcctgaagaatgatatccctatgaccggaccccttgtggccggcggcctgctgaccgtctgctacgtgctcacagggcggtctgcggacctggagcttgaacgcgccaccgatgttaaatgggaggaccaggctgagatttccggaagctcccctatcctgagcattacaatctctgaagatggcagcatgtccattaagaacgaggaagaggagcagacgctcaccatcctgatcagaacagggctcctggtgatttctggactttttcccgtcagcatcccgattaccgccgctgcctggtatctgtgggaagtgaaaaagcagcgggccggcgtcctgtgggacgtgccttctccccctcccatggggaaagctgagctcgaagatggagcgtaccgcatcaagcaaaagggcattctgggctatagccagatcggggccggagtttacaaagagggcacattccataccatgtggcacgtgacgagaggggctgtccttatgcacaagggaaaacggatcgaacccagctgggccgacgtgaagaaagatctgatttcctacggcgggggatggaagctcgagggcgagtggaaggaaggcgaggaagttcaggtgctggccctcgagcctgggaaaaatccgcgcgctgtccagaccaagcccggactgtttaaaacaaacaccggcacaatcggggccgtgtctcttgacttcagccctggaacctccggcagccccattatcgataagaaagggaaggtggttggactgtatggcaatggcgtcgtgacaagatctggggcgtacgtgtccgctattgcccaaacggaaaagagcatcgaggacaaccctgagatcgaagatgacatttttcggaaacgcagactgaccatcatggacctccatcccggagccggcaagacaaaacggtatctgcctgctattgtcagagaggccatcaagcgcgggcttcggaccctgattctcgcgccgaccagagtggttgctgccgaaatggaggaagccctgcgcggactccccatccggtaccagacccctgctattagagccgagcacacgggccgcgagatcgtggatctgatgtgtcatgctaccttcacaatgcggcttctgtctcccgtcagagtgcctaactataatctgatcattatggacgaagcccacttcaccgatcccgcgtccatcgccgctcgcgggtacattagcacacgggttgagatgggcgaagccgctggaatctttatgaccgccacgccgcctggctccagagaccccttcccccagtctaacgcccctattatcgatgaggagcgggaaatccccgagcgcagctggaatacagggcatgaatgggtgaccgactttaaaggaaagaccgtctggttcgtgccttccattaaggctggcaacgatatcgcggcctgcctccgcaagaatgggaagaaagttattcaactgagccggaagacatttgactctgagtatgtgaaaacccgcacaaacgattgggacttcgtcgtgaccacggatatctccgaaatgggagctaattttaaggccgagagagtgattgacccgcggagatgtatgaaacccgtcatccttacagacggcgaggaacgcgttatcctggccgggcctatgcccgtgacccacagctctgctgcccagcggagaggccgcattggacggaaccctaagaatgagaacgatcagtacatctacatgggcgaacccctcgagaatgacgaagattgcgcgcactggaaggaggctaaaatgctgctggacaacattaatacaccggaggggatcattcctagcatgttcgaacccgagagagaaaaggtggatgccatcgacggagagtatcgcctccggggcgaagccagaaaaacctttgtcgatcttatgcgcagaggggacctgcctgtgtggctggcttacaaggttgccgcggagggaattaactatgccgatcggcgctggtgtttcgacggcatcaaaaataaccagatcctcgaggaaaacgtggaggtcgaaatttggacgaaggagggggagagaaagaaactgaagccccggtggcttgatgctcgcatctactccgaccctctggccctcaaagaatttaaggagttcgctgccggcagaaaatctctgaccctgaatctcattacagaaatgggacggcttcccaccttcatgacacaaaagaccagagatgctctggacaacctggccgtgctccatacagcggaggccggcgggcgcgcttataatcacgccctgagcgaacttccggagaccctggagacgctcctgctgctcacacttctggctaccgttaccggaggcatctttctgttcctcatgtccgggcggggaattggcaagatgacactgggcatgtgctgcatcatcaccgcctctgtgcttctgtggtacgcccagattcagcctcattggatcgctgcgagcattatcctcgaatttttcctgattgtcctgctcatccccgagcccgaaaaacagagaacacctcaagacaaccagcttacgtatgtggtcatcgccattctgaccgtggttgctgccacaatggccaatgagatggggtttctggaaaagaccaaaaaggatctcggactgggctccatcgctacacagcagccggagagcaacattcttgacatcgatctgcgccccgcctctgcgtggaccctctacgccgtggctacgaccttcgtgacacctatgctgcggcactccattgagaatagctccgtcaacgtttctctgaccgccatcgctaatcaagccacagtgctcatggggcttggaaaaggctggcccctgagcaagatggacattggggtgcctctgctcgcgatcggatgttactcccaggtcaaccccatcaccctgacggccgcccttctgctcctggtggcccactatgctattatcggccctggcctgcaggccaaggctacaagagaagcccagaaacgggcggccgctgggattatgaagaatccgaccgttgatggaatcacagtgattgacctcgatcccatcccttacgaccccaaatttgagaagcaacttggccaggtcatgctgctgatcctctgcgtgacccaggtcctgatgatgcgcaccacatgggccctttgtgaagctctgacgctcgccaccgggcctatttctacactgtgggagggaaaccccggcagattctggaataccacaatcgccgtgagcatggcgaacatttttcgggggtcctatctggctggagccggcctccttttcagcatcatgaaaaataccacgaacacacgcagaggcaccgggaatattggagaaaccctgggcgagaagtggaaatctcggctgaacgctctcgggaagtccgagtttcaaacatacaagaaaagcggaatccaggaagttgatcgcaccctggccaaggagggcatcaaaagaggggaaacagaccatcacgccgtgtctcggggatccgctaaacttcgctggttcgtcgagagaaacatggtgacgccggagggcaaagttgtggatctgggctgcgggcggggaggctggagctattactgtgggggactcaagaatgtcagagaagtgaagggcctgaccaaagggggacctggccatgaggaacccattcccatgtctacatatggctggaacctggtgcgcctccagagcggggttgacgtctttttcatccctcccgagaagtgcgatacccttctgtgtgacattggagaatcctctcctaatccgacagtggaggccggccggaccctgagagtgctcaacctggtcgagaattggcttaacaataacacgcagttctgcatcaaagttctgaatccctacatgcctagcgtgattgaaaagatggaggcgctccaacgcaaatacgggggagccctggtgcggaaccccctgtccagaaatagcacccacgaaatgtattgggtctccaacgcttctggcaatatcgtgagctccgttaacatgatctctcgcatgctcattaatcggtttacaatgagacataagaaggccacctacgagcctgacgtggatcttgggagcggaacacgcaacatcggcattgaatccgagatccccaacctggacattatcggcaaacggattgagaagatcaaagaggagcacgaaacctcttggcactatgatcaggaccatccgtacaagacatgggcttatcacgggagctacgagaccaaacagacgggatccgccagctctatggtcaatggcgtggttagactgctcacaaagccttgggatgtgctgcccaccgtcacccagatggcgatgacagacacgacccctttcgggcaacagcgcgtgtttaaggaaaaagtggatacacggacccaggagcccaaggagggaaccaagaaacttatgaaaatcaccgccgaatggctgtggaaggagctcggcaaaaagaagacacctagaatgtgtacccgcgaagagttcacgagaaaagtccggtccaacgctgccctgggggctatttttaccgacgagaataagtggaaaagcgcccgcgaagctgttgaggattctagattctgggaactggtggacaaggagcggaacctccatctggaaggaaaatgcgagacatgtgtgtataatatgatgggcaagagagagaagaaacttggcgaatttgggaaggccaaaggatcccgggcgatctggtacatgtggctgggcgcccgcttcctcgagtttgaagctctggggttccttaacgaggatcactggtttagcagagaaaattctctgtccggagtcgagggcgaggggctccacaagctgggctacattctgcgggacgtgagcaaaaaggaaggaggcgccatgtatgctgacgataccgccgggtgggacacacgcatcaccctcgaggatctgaagaacgaagagatggttacgaatcatatggaaggagagcacaagaaacttgccgaggcgattttcaaactgacataccagaacaaagtggtcagagtgcaacggcccaccccgcgcggcacagttatggacatcatctccagacgggatcagcgcgggagcggacaggtgggcacctatgggctcaatacgtttaccaacatggaagctcaactgattagacagatggagggcgaaggagtcttcaaaaatatccagcatcttacagtgaccgaggaggccgccgttcagaactggctggctcgggtgggccgcgaaagactctctcggatggccattagcggggacgattgcgtcgtgaagcctctggacgatcgcttcgctaatgccctgacagcgctcaacgacatgggaaagatcagaaaagatattcaacagtgggagccctccaagggctggaacgactggacccaggtccccttttgctctcaccatttccacgaactgatcatgaaagatgggcgggtgcttgttgtgccttgtagaaatcaggacgagctgatcggacgcgcccggattagccaaggcgctgggtggtccctcagagaaacagcctgcctgggcaagtcttacgctcagatgtggagccttatgtattttcaccgccgggacctgagactcgccgcgaacgccatctgttccgctgtcccgtctcattgggtgcccaccagccgcacgacatggtccattcacgccaaacatgagtggatgaccaccgaggatatgctgacagtgtggaatcgggtttggatcagagaaaacccttggatggaggacaagacccccgtggaaagctgggaggaaattccttacctgggaaagcgcgaggatcagtggtgcggctctctcatcgggctgacatcccgggctacgtgggccaaaaatattcaggctgccatcaaccaagtcagaagccttatcggaaatgaggaatataccgactacatgccctctatgaagcgcttccggagagaggaagaggaagcgggcgtgctgtggtga

SEQ ID NO: 20312 - RNA, 9876 nt, synthetic construct
  misc_feature 1..9876: note = derived and/or modified CDS sequence (opt5) from DENV-2__JF260983__SS-prME
  source 1..9876: mol_type = other RNA
accgccggcttcctgatcatggtgattcccacagtcatggcttttcacctcacgaccagaaacggggagcctcatatgatcgttagcaagaatgaaaaaggaaagggcctgcttttcaaaacagagaacgggattaatatgtgcaccctgatggccatggacctcggagaactgtgtgaggatacagtgacctacaagtgcccgtttcttaaacagaacgaacccgaggacatcgattgttggtgcaattccacatctacctgggtgacgtatggcacctgtagctccacaggggagcaccggcgcgaaaagagatctgtcgcgctggtgcctcatgttggaatgggcctcgagacccggacagaaacctggatgagctccgagggcgcttggaagcaagcccagcgcattgagacgtggatcctgagacaccccgggttcacactgatggccgctgtgctcgcctacaccatcggaacaacccattttcagcgggctctgattttcatccttctgaccgccgtcgcgccttctatgacaatgcgctgcattggcatcagcaacagagactttgtggaaggggtttccggaggcagctgggtggatattgtcctcgagcacgggtcttgtgtgacgaccatggccaaaaataagcccacactggacttcgaacttatcaaaaccgaggctaagcagcctgccacactgcggaaattttgcattgaagctaagctcaccaacacgacaaccgagtcccgctgtccgacccaaggagagcccagcctggtggaagagcaggataagagattcgtctgccggcactctatggttgaccgcggctggggcaatgggtgtggactgtttggcaaagggggaatcgtgacatgcgccatgttcacctgcctcaagaaaatggaaggcaaggtggtccagcctgagaacctggaatatacaatcgtgattacgccccattccggggaggagcacgcggttggaaatgataccggcaaacatggcaaggaagtgaaaatcacacctcagagctctatttccgagaccgaacttacagactacgggaccatcacgatggagtgtagccccagaaccggactggattttaacgaaatggtcctcctgcaaatggagtccaaggcctggcttgtgcaccggcagtggttcctggacctcccgctgccttggctgcccggcgctgatacacaggggtctaattggattcagaaggagatgctcgttaccttcaaaaaccctcacgccaagcgccaagacgtggtcgtgctgggaagccaggaaggcgctatgcatacagcccttaccggggccacggagatccagatgtccctgggcaatatcctctttatgggacacctgaaatgcagacttcggatggacaagctgcaactcaaaggcatgagctattctatgtgtacagggaagttcaaggtcgtgaaagaaattgctgagacccagcatggaacaatcgttattagagtgcagtacgagggcgatgactccccctgcaagatcccctttgaaattatggatctggagaaaaagcacgtcctggggcgcctcatcaccgtgaaccctatcgttaccgaaaaagacagcccgattaacatcgaggcggaaccccctttcggagattcttatattgtgatcggcgtcgagcccgggcagctgaagcttaattggtttaagaaaggcagctccattggacaaatgttcgagacaacgatgcggggcgccaagagaatggctatcctgggggacaccgcctgggattttggatctattggcggggtgttcacaagcgtgggaaaagccctccatcaggtttttggcgctatctacggggccgcgttctccggcgtcagctggaccatgaagatcctgattggagtggtgatcacatggattggcatgaactctcgctccaccagcctgtctgtcacgcttgtgctcgttgggatcgtgacactgtacctgggagtcatggtgcaggctgactccggctgtgttgtgagctggaaaaataaggaactcaagtgcgggtccggaatttttgtcaccgataacgtgcacacctggacagagcagtataaattccaacctgactctcccagcaagctggcctccgccatccagaaagctcacgaagagggcatctgtgggattcggtctgttaccagacttgaaaatctgatgtggaagcagatcacaccggagctcaaccatattctgagcgagaatgaagtgaaactgacgatcatgaccggcgagattaagggaatcatgcaggccggccgccggtcccttaaacctcaacccacagaactcagatacagctggaagacctgggggaaggctaaagtcctgtctacagagctgcagaaccagacctttctcatcgatggacctgaaacgaccgagtgccccaattccaaccgcgcctggaatagcctggaggtggaagactatggcttcgggattttcacaaccaacatctggcttaagctgcgggagaaacaggacatgatttgtgattctaagctcatgtccgcggccgtgaaagacgatagagctgtccacgccgacatgggatactggatcgaaagccgcctgaatgatacatggaagatggagaaggcttcttttattgaggttaaaagctgctattggcctcggtcccataccctgtggagcaacggcgtgcttgaatctgagatgatcatccccaagaatctcgccggcccggtgtcccaacacaactacagacctgggtattacacacagaccgcgggaccctggcacctgggcaaactggaaatggacttcgagttttgtgaagggacgacagtcgtggttaccgaggattgcggaaaccggggccccagcctccgcaccacaaccgcctccgggaagctgattacggagtggtgctgtagatcttgcacacttcctccgctgcggtacagaggagaagacggctgttggtatggcatggagatccgccccctcaaagaacgggaggaaaatctggtgaacagcctggtcaccgctgggcatggacagattgataatttctcccttggcatcctcgggatggccctgctgctcgaggagatgctgagaacacgcgtgggaaccaagcacgctcttctgctcgttgccatttcttttgtgacactgatcaccggcaacatgagcttcaaggacctggggagagtcattatcatggtgggagccgctatgacggatgaaatgggcatgggcgttacctaccttgcgctgctcgccgcttttcgggtgcgccctacattcgccgtcgggctgctcctgagaaaacttacctccaaggagctgctcatggccacaatcggagtggtgctgctgtctcaaagcaatattcccggcaccgtccttgaactgacggacgctatcgccctcgggattatggttctgaaaatcatgcggtccatggagaagtatcagctcgcggtgacagtgatggctatgctgtgcattcctaacgtcatgatccttcagcatgcctggaaagtgggatgtaccatcctggccgctgttagcgtgtctcccctcctgctgacatccagccagcaaaagaccgattggattcctcttgccctgaccatcaagggcctcaatcccacagcgatttttctgacgaccctctctcgcccgtccaaaatcagaagctggcctctgaacgaagctattatggccgtcgggatggtgtctatccttgcctccagcctgctgaagaatgacatccccatgacaggacctctcgttgctggcggcctgcttaccgtgtgctacgtcctgacagggcggtccgccgacctcgagctggagaaagctgccgaagtgaagtgggaggatcaggcggaaattagcggatctagccccatcctctccattaccatctctgaggacggcagcatgtccattaaaaacgaggaagaggaacagacgctgacaatccttattcgcaccgggctgctggtcatctctggactcttcccggtgagcatccctattaccgccgctgcctggtatctgtgggagacaaagaaacagagagctggcgttctttgggatgtgccctcccctccccccatggggaaggccgaactggaggacggagcctaccggatcaagcaacgcggcatttttggctattctcagatcggggctggagtctacaaagagggcaccttccacacaatgtggcatgtgacgagaggggcggttctcgtgcacaagggaaaacggctggaacctagctgggccgatgtcaagaaagacctcatttcctacggcgggggatggaagctggagggcgaatggaaggatggcgaggaagtgcaggtgcttgctctggagccggggaaaaatcccagagccgttcagaccaagcctggactgtttaaaacaaacaccggcacaatcggggccgtcagcctcgacttctctcccggaacctccggcagccctatcattgatcgcaaggggaaagtggtgggactgtatggcaatggcgtcgtgacgcggtctgggacctacgtttccagcatcgctcaaacagagaagtccgtggaagacaaccccgagattgaagatgacatcttcagaaagaaacgccttaccattatggatctgcaccctggagccggcaagacaaaacggtatctcccggcgatcgtcagagaggctatccgccgggggctgagaaccctcattctggcccccacacgcgtggttgccgctgaaatggaggaggcccttcggggactgcctatcagataccagacgcccgcgattaaggctgaacataccggccgggagatcgtggacctgatgtgtcacgccacatttaccatgcgcctcctgtctcctattagagtccccaattataaccttatcattatggacgaagcccatttcaccgatccggctagcatcgccgctcgggggtacatctccacacgcgtggagatgggcgaggccgcgggaatttttatgacggccacccctcccggcagcagagaccccttccctcagtctaacgctcccatcatggatgaagagcgggaaattcctgagagatcctggaatagcgggcacgaatggatcacaaactttaaaggaaagaccgtttggttcgtgccgtctattcgcgccggcaatgacatcgctgcctgcctgcggaagaacgggaaaagagtcatccaactcagccgcaagacatttgataccgagtatacgaaaacacggaccaatgactgggatttcgtggtgaccacagacatttccgagatgggagccaactttaaggctgaaagagtcatcgatccccgccggtgtatgaaacctgttattctgaccgacggcgaggaaagagtggtgctggcggggcccatgcctgtcacacattctagcgccgctcagcgcagaggccggatcggacgcaatcccaagaacgagaatgatcagtacatttacatgggcgaaccgctcgagaacgacgaggactgcgcccactggaaggaagccaaaatgcttctggataatatcaacacccctgaggggatcattccctccatgttcgaacctgagagagaaaaggtggacgctatcgatggagagtatcggctgcgcggcgaggccagaaaaacgtttgttgacctcatgaagcggggggatctgcccgtgtggcttgcgtacaaagtcgcttctgaaggaattaattatgccgacagaaagtggtgtttcgatggcatccgcaacaatcagattctggaggaaaacatcgaggtggaggtttggacaaaagaaggggagcggaagaagctcaaacctagatggctggacgcccgcacctacagcgatcccctggctctcaaggaattcaaagagtttgccgcgggccggaagtcccttacactgagcctgattaccgaaatgggaagactcccgacgttcatgacccaaaaaacacgggacgccctggataaccttgctgtgctgcactctgccgagatgggcgggcgcgcttataatcatgccctctccgagctgcctgaaaccctggagacactccttctgctgggactcctggctaccgtcacaggcgggatctttcttttcctgatgagcggaagaggcgtgggcaagatgaccctcgggatgtgctgcatcattacggcctccggactgctgtggtacgcgcagatccagccccactggattgccgcttctatcattctcgaatttttccttatcgtcctgctgatccccgagcctgaaaagcagcggacaccgcaagacaaccagctcacctatgtggttattgccatcctgacccttgtggctgccacaatggccaatgagatgggctttctggagaaaaccaagaaagatctcgggctgggaggcttcacaatgcagcagcccgaaattaacatcctggacattgacctccgccctgctagcgcgtggacgctttacgccgtggctaccacatttgtcacccccatgctgagacattccatcgagaattctagcgttaacgtgtccctgacagccatcgccaatcaagctaccgtgctcatggggctgggaaagggctggcctcttagcaaaatggatattggcgtccccctgctcgccatcgggtgttactctcaggtgaaccctattacgctgaccgcggccctgctccttctggttgctcactatgccatcattggaccgggcctgcaggctaaggccacacgggaagcgcagaagcgcgccgctgccgggatcatgaaaaatcccaccgtggacggaattacagtcatcgatctcgagcctatcccctacgaccctaagttcgaaaaacaactgggccaggtgatgcttctggtcctctgcgtgacccaggttctgatgatgagaacgacatgggctctgtgtgaggccctcacccttgctacagggcccatttccaccctgtgggagggaaacccgggcaagttttggaataccacaatcgccgtgagcatggcgaacattttccggggctcttatctggccggggctggactcctgttttccatcatgcgcaatacgaccagcgccagacggggcacagggaccattggagaaacacttggcgagaaatggaagtctagactgaacgctctcgggcgcagcgaattccaaatctacaagaaatccggaatccaggaggtcgatcggaccctggccaaggagggcattaaaagaggcgaaacggaccaccatgccgtgtctcgcgggagcgcgaagctgcggtggttcgttgagagaaatatggtggctcctgaaggaaaagtcgtggatctcggctgcgggcgcggaggctggtcctattactgtgggggacttaagaacgtgcgggaggttaaaggcctgacaaagggcgggcccggacacgaagagcccatccctatgagcacctatggctggaatctggtcagactccagtccggggtggacgtgtttttcaccccccctgagcgctgcgatacactgctttgtgacattggagaatctagcccgaaccccaccgtcgaggccggccggacactgagagttctcaacctggtggaaaattggctggggtccaacacgcagttttgcatcaaggtgctcaatccttacatgccctctgtcattgagcgcatggaaacccttcaacggaaattcggaggcgctctggtgagaaaccctctgagccgcaattccacacatgagatgtactgggtttctaacgccagcggcaatatcgtgtccagcgtcaacatgatctctagaatgctcattaatcggtttaccatgcgccacaagaaagccacatatgagcccgatgtggacctggggtccggaaccagaaacatcggcattgaatgtgagacgccgaatatggatatcattgggaagcggatcgaaaaaatcaagcaggagcatgaagctagctggcactacgaccaggaccacccttataagacctgggcctaccatggatcttatgagacaaaacagaccggctccgcgagctctatggttaacggggtggtcagacttctgacaaagccctgggatgtgattcctatggtgacccaaatggccatgacagacaccacgcccttcggacagcagcgggtctttaaagagaaggttgatacacgcacccaggaacctaaagagggcaccaagaagctcatgagaatcacagctgaatggctgtggggcgagctggggcggcgcaaaaagcccagaatttgcacgcgggccgagttctgtaataaagtgcgctccaacgctgccctcggagcggtgtttaccgacgaaaataagtggaaaagcgccagagaggctgtcgaagatgagcggttctgggaactggtggagaaggagcgcaaccttcacctggacggcaagtgcgaaacatgcgtttacaacatgatggggaaaagagagaagaaactcggagaatttggcaaggccaaagggtcccgggctatctggtatatgtggctgggcgcccgcttccttgagtttgaagctctgggattcctcaatgaggatcattggttcagcagagagaactctctgagcggcgtggaaggggagggactgcacaagctcggctacattctgcgggacatctcccgcaaagccgggggagcgatgtacgccgatgacaccgctggctgggatacaagaattacctctgaagaccttaagaatgaggaaatgatcacagaccaaatggaggggcggcacaagaaactggccgaggctatctttagactcacctatcagaacaaggtcgtgcgcgttcagcggccgacgcctagaggcaccgtgatggatattatcagccgccgggaccaaagaggatccggccaggtcgggacatacggactgaataccttcacaaacatggaagcccagcttattcgccagatggagggcgaagggctgtttaaatctatcctccatctgaccccccaagaggagacggccgtgcacgcgtggctggttcgggaaggaagagagcgcctcgctcggatggccattagcggcgatgactgtgtggtcaagcccctggatgacagattcgcccgcgctcttacagccctgaatgatatggggaaagtgcggaaggacatccagcagtgggaaccttccaagggctggtctgattggacccaggtcccgttttgcagccatcacttccatgagctcatcatgaaagacggaagaaagctggtggttccctgtcggaaccaagatgaacttattggcagagctcgcatctcccagggggccggatggagcctgcgggagacagcgtgcctcggcaaatcttatgcccagatgtggtccctgatgtactttcacagacgcgacctgagactcgctgccaatgctatttgtagcgccgtgccttctcactgggtccccacctcccggacgacctggagcatccatgcgtcccacgagtggatgacaaccgaagatatgctggccgtgtggaaccgcgtgtggattcaggacaatccttggatggaggacaagacacccgttgaatcttgggaggatatcccttatcttgggaaaagagaagaccaatggtgcggaagcctgatcggcctcacctcccgggctacatgggccaagaacattcagaccgctatcaatcaggtgcgcgccctgattggggaggaggaatacatggattatatgcccagcatgaagagattccggtctgaggaagaggaatccggcgtcctttggtga

SEQ ID NO: 20313 - RNA, 9876 nt, synthetic construct
  misc_feature 1..9876: note = derived and/or modified CDS sequence (opt5) from DENV-2__AF119661__SS-prME
  source 1..9876: mol_type = other RNA
acagtgggcgtcatcattatgctgatccccacagccatggctttccacctcacgaccagaaatggggagcctcatatgattgttgggcggcaggaaaagggcaaatccctgctttttaagacagaggacggggtgaatatgtgcaccctgatggccatcgatctcggggaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgcagcgtcgcgctcgtgcctcatgttggaatgggcctggagaccagaacggaaacatggatgtcctctgagggcgcttggaaacacgcccagcggatcgagacctggattctgcgccatcccgggttcatcattatggccgctatcctcgcctacacaattggaaccacccactttcagagagctctgatcttcattcttctgacagccgtggcgcctagcatgacgatgcggtgcatcggcgtctccaaccgcgattttgtggaaggggtttctggaggcagctgggtggacatcgtcctcgagcacgggtcctgtgtgaccacaatggccaagaataagcccaccctggatttcgaacttattaaaacagaggctaagcagcctgtgaccctgagaaaatattgcatcaaggccaaactcacgaacacaaccaccgaaagccggtgtccgacacaaggagagccctctctgaatgaggaacaggacaagcgctttgtctgcaagcattccatggttgatagaggctggggcaacgggtgtggactgttcggcaaagggggaattgtgacctgcgctacatttacgtgcaagaaaaatatggagggcaagatcgtgcagcctgaaaacctcgagtacaccattgtcatcacaccccacagcggggaggaacatgccgtgggaaatgacaccggcaaacacggcaaggagatcaaaattacacctcagtcttccatcaccgaagcggagctgacggggtatggaaccgttacaatggaatgtagcccccggaccggccttgatttcaacgagatggtgctgctccaaatggaagacaaggcctggctggtccaccgccagtggtttcttgatctgccgctcccttggctgcccggggctgacacacagggatctaattggattcagaaggagaccctggtgacgttcaaaaaccctcatgccaagaaacaagacgttgtggtcctcggctcccaggagggggctatgcacacagccctgaccggcgccacagaaatccagatgagctccggaaatcttctgtttaccggccatctcaagtgcagactgcggatggataaacttcaactgaaggggatgtcttacagcatgtgtaccggaaagttcaaaattgtgaaggagatcgctgaaacacagcacggcacgatcgtcattagagtgcagtatgagggggacggatccccctgcaaaatccccttcgagattatggatctcgaaaagcgccatgttctgggccggctgatcaccgtgaaccctattgtcacagagaaagacagcccggtgaacatcgaagcggagcccccttttggggattcttacattatcatcggcgttgaacccggacagctcaagctgaattgggtgaagaaaggctccagcattgggcaaatgttcgagaccacaatgagaggagccaagcgcatggctatccttggcgacaccgcctgggattttgggtctctgggaggcgtcttcacgagcattgggaaagccctccaccaggtgtttggcgctatctacggagccgcgttctccggcgtgtcttggacaatgaagattctgatcggggttatcattacctggatcggaatgaacagccggtccaccagcctgtctgtctcccttgtgctcgtgggcgtcattacactgtatctgggggctatggtgcaggccgacagcggatgtgttgtgtcttggaaaaataaggagctcaagtgcggctccgggatctttattaccgataacgtccacacatggacggaacagtacaaattccaacctgagagcccctccaagctggcctctgctatccagaaagcccatgaagagggcatctgtggaattagaagcgtgacccgccttgaaaatctgatgtggaagcagatcacaccggagctcaaccacattctgtccgagaatgaagttaaactgaccatcatgacaggcgacattaaggggatcatgcaggctggaaaacggtctcttagacctcaacccaccgagctcaagtatagctggaagacgtggggcaaagccaagatgctgtccaccgaaagccataaccagacatttctgatcgatgggcctgagaccgcggaatgccccaatacaaaccgcgcctggaactctctcgaggtggaggactacggattcggcgtctttaccacaaacatttggctgaaacttcgggaaaagcaggacgtgttctgtgattccaaactgatgagcgctgccatcaaggacaatagagctgttcacgccgatatgggctattggattgagtctgcgctcaacgacacctggaagatggaaaaagcctcctttatcgaggtgaagtcctgccactggcctaaatctcatacgctgtggagcaatggggtcctggagtccgaaatgattatccccaagagcttcgctggaccggtgtctcagcacaactaccgccctggctattacacacaaaccgccgggccctggcatcttggaaaactcgagatggatttcgacttttgtgaaggcaccacagtggtcgttaccgaggattgcgggaaccggggaccctccctgagaacgacaaccgctagcggcaagctgattacagaatggtgctgtcggtcctgcaccctccctccgctgcgctacagaggcgaggacgggtgttggtatggaatggagatccggccccttaaggaaaaagaggaatctctggtggatagcctcgtgacagccggccacgggcagatcgacaatttctccctgggagtcctgggcatggccctttttctcgaggaaatgctgagaacccgcgtggggacgaagcatgctattctgctcgttgcggtgtctttcgtcaccctgatcacaggaaacatgagccttcgggatctgggcagagtgatggttatggtgggcgccaccatgacagacgatattgggatgggagtcacctacctcgctctgctggccgcctttaaagtgcgccctacgttcgctgccggccttctgctcagaaagctgacatccaaagagctcatgatggcgaccatcgggattgctctgctttctcagagcacaatccccgagaccatcctggaactcaccgacgccctggccctgggaatgatggttcttaagattgtgcggaatatggagaagtatcaactggctgtcacaatcatggccatttcctgcgtgcctaacgcggtgatcctccagaatgcttggaaagtcagctgtacgattctggccgccgtttctgtgagccccctcctgcttaccagctctcagcagaaggctgactggatccctctggccctcacaatcaaaggcctgaaccccaccgctatttttctgacaacccttgcccgcacgtccaagaaaagaagctggccgctgaatgaagcgatcatggccgtggggatggtctctattctcgcttccagcctgctcaagaacgatatccctatgacaggacccctggtggccggcggccttctgaccgtttgctacgtgctgaccgggcggtccgctgacctcgagctggaacgcgccacagatgtcaaatgggaggaccaagccgagattagcggatctagccctatcctttccattaccatctctgaagatggcagcatgtccatcaagaatgaggaagaggagcagacactgacgattctcatcagaaccgggctgctcgtgatttctggactgttccccgttagcatcccgattacagctgcggcctggtatctttgggaagtgaagaaacagcgggctggcgtcctgtgggacgtgccttctccccctcccgtcgagaaggccgaactggaggatggggcctaccgcatcaaacagaagggaatcctcggctatagccaaattggcaccggggtgtacaaagaaggaacatttcacaccatgtggcacgttacgagaggcgctgtgctgatgcatcgggggaagcgcatcgagcccagctgggccgacgtcaagaaagatcttatttcctacggaggcgggtggaagctggagggagaatggaaagagggcgaagaggtgcaggttctcgcgctggaacctggcaagaacccgagagctgtgcagaccaaacccggactcttcaagacaaataccggaacaatcggcgccgtcagcctggacttttctcctgggacctccggaagccccattgtggatcggaagggcaaagtggttgggctttatggaaacggcgtcgtgacaagatctggcgcctacgtgtccgctatcgcccagacggaaaagagcatcgaggacaatcctgaaattgaggatgacatcttccgcaaaaagcggctgaccattatggacctgcaccccggggcgggaaaaacaaagagatatctccctgctatcgtccgcgaagccattaagcggggcctgagaacccttatcctggccccgacccgcgtggttgctgccgagatggaagaggctctccgggggctgcccattagataccaaacccctgccatccgcgcggagcatacgggacgggaaatcgtggatctcatgtgtcacgccacctttacaatgagactgctttcccccgtccgggtgcctaactataatctgattatcatggacgaggctcatttcaccgatcccgccaacattgctgcccgcggctacatctctacaagagttgaaatgggggaggccgctggcattttcatgaccgcgacgccgcctggaagccgggacccctttccccagtccaacgcccctatcatggatgaggaacgcgagatccccgaaagaagctggaactctggccacgagtgggtgacagacttcaaagggaagaccgtctggtttgtgccttccattaaagctggaaacgatatcgccgcctgcctgcggaagaatggcaaaaaggttattcagctcagcagaaagaccttcgactctgaatatgtgaaaacacgcaccaacgattgggactttgtcgtgacaaccgatatcagcgagatgggggctaatttcaaggccgagcgggtgattgacccgagacgctgtatgaaacccgtcatcctgacggacggagaggagcgggttatccttgcgggccctatgcccgtgacacactcctctgctgcccaaagacgcgggcggattggcagaaaccctaagaatgaaaacgatcagtacatctacatgggagagcccctggaaaatgacgaggattgcgcccattggaaagaggctaagatgctcctggacaacattaataccccggaaggcatcattcctagcatgtttgagcccgaacgcgagaaagtggatgccatcgacggggaatatagactgcggggagaggcgcgcaagacattcgtcgatctcatgagacggggcgaccttcctgtgtggctggcctaccgcgttgctgccgaggggattaactatgctgatagacggtggtgttttgacggagtgaagaataaccagatcctggaagagaatgtcgaagtggagatctggaccaaagagggcgaaagaaagaaactcaagccccgctggctggatgcccggatttactccgaccctcttgctctgaaagagttcaaggaatttgccgcggggagaaagtctctcacgctgaacctgatcaccgagatgggccgcctccccacattcatgacccagaaagcccgggatgctcttgacaacctggccgttctgcacacagctgaagccggaggcagagcctataatcatgctctcagcgagctgccggagacccttgaaacactgctcctgctgaccctccttgcgacggtgacagggggaattttcctgtttctgatgtccggcaagggggtcggaaaaatgaccctcggcatgtgctgcatcattaccgccagcatcctgctttggtacgctcaaatccagcctcactggattgccgcctctatcattctggagttctttctcatggtgctgctgatccccgaacccgagaagcagcggacacctcaggacaaccaactcacctatgtcgtgattgctatccttacagttgtggccgcgacgatggccaatgaaatgggcttcctggagaaaaccaagaaggatctggggctcggatccatcgctacacaggagccggaaagcaacattctggacatcgatcttcgccccgcctccgcttggaccctgtacgccgtggcgacaacctttgtcacgcctatgctcagacactctattgagaatagctccgttaacgtgtctctgaccgccatcgctaatcaggccacagtgctgatgggcctcgggaaaggatggccccttagcaagatggacattggcgtccctctgctggctatcgggtgttactcccaggtgaaccccattaccctcacagccgctctgcttctgctcgttgcccattatgcgatcatcggacctggcctgcaagccaaagctacccgggaagcccagaagcgcgctgccgccggcattatgaaaaatccgacggtggatgggatcacagtcattgacctggatcccatcccttacgaccccaagttcgagaagcagctcggacaggtgatgcttctgattctgtgcgtcacccaagtgctcatgatgagaacaacctgggcgctgtgtgaagctcttaccctggccacaggccctatcagcacgctctgggaggggaaccccggacggttttggaataccacaatcgctgtttctatggccaacattttccgcggctcctatctggccggggctggactgctctttttcatcatgaaaaataccacaaacaccagacggggcacgggcaatattggggagacacttggagaaaagtggaaaagccgcctgaacgccctgggcaagtctgagtttcagatctacaaaaagtccgggattcaggaagtggatagaaccctcgcgaaagagggaatcaagcggggcgagaccgaccaccatgccgtcagcagagggtctgctaagctgcgctggttcgtggaacggaatatggttacaccggagggaaaagtggtcgatcttggctgcggcagagggggatggagctattactgtggcgggctgaagaacgtgcgcgaagtgaaaggactcaccaagggcgggcctggacacgaggaacccatccccatgtccacatatggctggaacctggttcggctgcaatctggcgtcgacgtgtttttcacgcctcccgagaaatgcgataccctcctttgtgacattggggagagctcccctaatccgacaatcgaagccggaagaaccctgcgcgtgctgagcctcgtcgagaactggctgaataacgacacacagttctgcattaaggttcttaatccctacatgccttccgtgatcgaaaagatggagaccctgcagcggaaatacggcggggctctcgtgagaaaccccctgtctcgcaatagcacgcatgaaatgtattgggtctccaacgccaccggaaatattgtgtctagcgttaacatgatctcccggatgctgatcaatagatttacaatgaagcacaaaaaggcgacctacgagcctgatgtggacctcggctctgggacacgcaacattggaatcgagagcgaaattcccaatcttgatatcattggcaaacggatcgagaagattaagcaggaacacgagacctcctggcattatgaccaagatcacccgtacaaaacatgggcctatcatggcagctacgaaaccaagcagacggggtctgcttccagcatggtcaacggagtggttagactgctgacaaaaccttgggacgtggtccccatggtgacccagatggccatgaccgatacaacgcctttcggccagcaacgcgtgtttaaggagaaagtcgacaccagaacacaggagcccaaggaagggaccaagaaactcatgaagatcacagctgagtggctgtggaaagaacttggaaagaaaaagacccctcggatgtgtacacgcgaggagttcaccagaaaagttcggtctaatgccgctctgggcgccatctttacggatgaaaacaagtggaagtccgcgagagaggccgtggaagacaaccggttctgggagctcgtggataaagaacgcaatctgcacctggaggggaagtgcgagacctgtgtctataacatgatgggaaaaagagaaaagaaactcggcgagtttggcaaggctaaggggagccgggccatttggtacatgtggctgggagctcgcttccttgaatttgaggccctgggcttcctcaatgaagaccactggttttctagagagaactccctgagcggggtggagggagaaggccttcataaactggggtacatcctccgggacgtttccaagaaagagggcggagccatgtatgcggatgacacagctggctgggatacccgcattacactggaagacctgaagaatgaggaaatggtgaccaaccacatggagggggagcataaaaagctcgccgaagccatcttcaagctgacgtaccagaataaagctgtcagagtgcagcggcccacaccgcgcggaaccgttatggatattatcagcagacgggaccaacgcggctctggacaggtgggaacatatggccttaacacctttacgaatatggaggcccagctgatcagacaaatggaaggggagggcattttcaagagcatccagcacctcaccgtcacagaggaaattgctgtgcagaactggctggcccgggttggacgcgagagactttcccggatggcgatctctggcgatgactgcgtggtcaaacctctggatgacagattcgccagcgctctcaccgccctgaatgatatggggaaggtgcgcaaagacattcagcaatgggaaccctcccggggatggaacgattggacacaggtccccttttgctctcatcacttccacgagctgatcatgaaggacggcagagtgctcgttgtgccttgtcgcaatcaggacgaactgatcgggcgggctagaattagccagggagccggctggtcccttaaggagaccgcgtgcctggggaaatcttacgcccaaatgtggagcctcatgtattttcatcgccgggatctgagacttgctgccaacgctatctgttccgccgtcccgagccactgggtgcccacatctcgcaccacgtggtccattcatgctaagcacgagtggatgacaaccgaagacatgctgaccgtgtggaatcgggtttggatccaggagaacccttggatggaagataaaacacccgtggagagctgggaagaggtcccttacctcggcaagagagaggaccagtggtgcggatctctgattggcctgacctcccgcgccacatgggcgaaaaacatccagacggccattaatcaagtgcggagcctcatcgggaacgaagagtataccgattacatgccctccatgaagagattccggagagaagaggaagaggctggagttctgtggtga

SEQ ID NO: 20314 - RNA, 9876 nt, synthetic construct
  misc_feature 1..9876: note = derived and/or modified CDS sequence (opt5) from DENV-2__EU056810__SS-prME
  source 1..9876: mol_type = other RNA
accgccggcatcattatcatgctgattcccacagtgatggctttccacctcacgaccagaaacggggagcctcatatgatcgtcagccggcaggaaaagggaaaatccctgctttttaagacagaggacggcgttaatatgtgcaccctgatggccatggatctcggggaactgtgtgaggacacaattacctacaactgcccgcttctgcgccaaaatgaacccgaggatatcgactgttggtgcaactctacaagcacctgggtgacgtatggaacctgtacagcgaccggcgagcacagacgggaaaaacgctccgtggctctcgtccctcatgtggggatgggactggagacaagaaccgaaacgtggatgtctagcgagggcgcctggaagcacgcccagcggatcgagacatggattctgcgccatcccggcttcaccatcatggctgccattctcgcttacacaatcgggaccacctattttcagagagttctgattttcatccttctgacagccgtggcgccttccatgacgatgcggtgcattggaatctctaatcgcgattttgtcgaaggcgtgagcgggggatcctgggttgacatcgtgctcgagcacggcagctgtgtcaccacaatggccaaaaacaagcccaccctggatttcgaacttattaagacagaggctaaacagcctgccaccctgagaaagtactgcatcgaagctaaactcacgaatacaaccaccgcctctcggtgtccgacacaaggggagccctccctgaacgaggaacaggacaagcgctttgtgtgcaaacacagcatggtggatagaggatggggcaatggctgtgggctgttcggaaagggcgggattgtcacctgcgcgatgtttacatgcaagaaaaacatggagggaaaggttgtgcagcctgaaaatctcgagtatacgatcgtgattaccccccattctggcgaagagaacgccgtcgggaatgacacaggaaaacacggcaaggagatcaaaatcacccctcagtccagcattacagaagctgagctgaccggctacgggacggtgaccatggaatgttctccccggacaggacttgatttcaacgagatggttctgctccaaatggaaaataaggcctggctggtgcatcgccagtggtttcttgacctgccgctcccttggctgcccggcgctgatacccaggggtccaactggatccagaaagagacactggtcaccttcaagaaccctcacgccaagaaacaagacgtggttgtgctcggaagccaggagggcgccatgcacacggctctgacaggggcgaccgaaattcagatgtcctctggcaatcttctgtttacaggacatctcaagtgcagactgcggatggacaaacttcaactgaagggcatgagctattccatgtgtaccgggaaattcaaggtcgtgaaggagatcgccgaaacccagcacggaacaattgtcgtgagagttcagtacgagggcgatgggagcccctgcaaaatccccttcgagatcatggacctcgaaaagcgccatgtgctgggacggctgattacggtcaaccctatcgtgaccgagaaagattctccggttaatattgaagctgagcccccttttggcgactcctacatcattatcggggtggaacccggccagctcaagctgaactggttcaaaaagggaagctctattggccaaatgtttgagacaaccatgagaggggccaagcgcatggccatccttggagatacagcttgggacttcggcagcctggggggagtctttacctccatcggcaaagccctccaccaggtgttcggggcgatttatggcgctgccttttctggagtgagctggacgatgaagatcctgattggcgttgtcatcacatggattgggatgaattcccggagcacctctctgtccgtgagccttgtgctcgtcggagtggttaccctgtacctgggcgtgatggtccaggccgattctgggtgtgtggtttcctggaaaaacaaggagctcaaatgcggaagcggcatcttcgtgacagacaatgtccatacctggacagaacagtataagtttcaacctgagtccccctctaagctggctagcgccatccagaaagctcacgaagaggggatttgtggcatcagatccgtgacgcgccttgaaaacctgatgtggaagcagattaccccggagctcaatcacatcctgtctgagaacgaagttaaactgacaattatgaccggagatatcaagggcatcatgcaggccgggaaacggagccttagacctcaacccacagagctcaagtactcctggaaaacctggggaaaggcgaagatgctgagcacggaactgcataatcagaccttcctcattgacggccctgagacagccgaatgccccaacaccaatcgcgcttggaactctctggaggtggaggattatgggtttggagtcttcacaaccaatatctggcttaaactgaaggaacggcaggacgtgttttgtgactccaaactcatgagcgccgctattaaggataacagagccgtgcacgcggacatgggctactggatcgagtctgccctgaacgatacatggaaaattgaaaaggcttccttcatcgaggtcaagagctgccattggcctaaatctcacaccctgtggagcaatggcgttcttgagtccgaaatgatcattcccaagaacttcgccgggccggtgagccagcacaattatcgccctggataccatacgcaaacagctggcccctggcacctcgggaaactggaggtggactttaacttctgtgaaggaaccaccgtcgtggttacaggcgattgcgggaatcggggaccctctctgagaaccacgacagcctccggcaagctcatcaccgagtggtgctgtcggagctgcacactgcctccgcttcgctacagaggcgaagacgggtgttggtatggaatggagattcggcccctgaaagagaaggaagagaacctcgtgaattccctggtcaccgccggccatgggcagatcgataacttttctctgggagtgcttggcatggctctcttcctggaagagatgctgagaacacgcgttgggaccaagcacgcgattctcctggtggccgtcagctttgtgacgcttatcaccggaaatatgtccttccgggacctgggcagagttatggtgatggtcggcgctacaatgaccgatgacattgggatgggagtgacatacctcgccctgctggccgcttttaaagtgcgccctaccttcgccgcgggccttctgctcagaaagctgacgtctaaagaactcatgatgacaaccatcgggatcgtcctgcttagccagtccacaattcccgagaccgttctggagctcaccgatgctctggccctgggaatgatggtgcttaagatcgtgcggaacatggaaaaatatcaactggccgtcacaattatggctatcctctgcgtgcctaatgccgttattctgcagaacgcgtggaaggtgtcttgtacgatcctcgctgtcgtgagcgtttcccccctgcttctgaccagctctcagcagaaggccgactggatccctctcgccctgacaattaaaggcctgaatcccaccgctatctttcttacaaccctgtcccgcacgagcaagaaaagatcttggccgctcaacgaggccattatggctgtggggatggtctccatcctggccagctctctcctgaagaatgatattcctatgacaggaccccttgtggcgggcggcctgctgaccgtctgctacgtgctcaccgggcggtccgccgacctggaacttgagcgcgctgccgacgttagatgggaagatcaagctgagatcagcggatccagccctatcctgtctattacaatcagcgaggacggctccatgtctattaaaaacgaagaggaagagcagaccctcacaatcctgattcggacggggctcctggtgatcagcggacttttccccgtctccattccgatcaccgccgccgcttggtatctgtgggaggtgaagaaacagcgcgcgggcgttctgtgggatgtgccttctccccctcccgtcgggaaggccgaactcgaggacggagcttacagaatcaagcagaaaggcattctgggctatagccaaatcggggccggagtgtacaaggaaggcacatttcataccatgtggcacgtgacacggggggccgttcttatgcacaaaggaaagcgcattgagccctcctgggctgatgtcaaaaaggacctgatctcttacggcgggggatggaagctcgaaggcgagtggaaagagggcgaagaggtgcaggtgctggccctcgaacctgggaagaacccgagagcggtccagaccaaacccggactgttcaagacgaataccggcacaattggggctgtgagccttgatttttcccctggaaccagcggctctcccatcgttgacaaaaaggggaaggtggtcggactgtatggcaacggcgtggttacacggtccgggacctacgtgagcgccatcgcccagacagagaaatctattgaagataatcctgagatcgaggacgatattttcagaaagaaacgcctgacgatcatggacctccatcccggagctggcaagaccaaacggtatctgcctgccattgtcagagaagcgatcaagcgcgggcttcggacactgatcctcgctccgaccagagtggttgccgccgagatggaagaggctctgcgcggactccccattcggtaccaaacccctgccatcagagctgaacacacaggccgcgagattgtggatctgatgtgtcatgccacgttcaccatgcggcttctgtcccccgtcagagtgcctaactataatctgatcattatggacgaggcgcactttacagaccccgccagcatcgctgcccgggggtacatttccacccgcgtggaaatgggcgaggctgccggaatcttcatgacagccaccccgcctggctctagagatccctttccccagagcaacgctcctatcatggacgaagagcgggagattcccgaacgctcctggaatagcgggcatgagtgggtcacggatttcaagggaaaaacagtttggtttgtgccttctatcaaggcgggcaacgacattgccgcttgcctcagaaaaaatgggaagaaagtgatccagctgtcccggaagaccttcgatagcgaatatattaagaccagaacaaacgactgggattttgtcgtgaccacagacatctctgagatgggagccaatttcaaagccgaacgcgttatcgatccgcggagatgtatgaagcccgtgattcttaccgacggcgaggagcgcgtcatcctggctgggcctatgcccgtgacgcacagctccgccgcgcaacggagaggccgcattggacggaaccctaaaaatgaaaacgatcagtacatctacatgggcgagcccctcgaaaatgacgaggactgcgctcactggaaggaagccaaaatgctgctggataacattaacacaccggaggggatcatcccttctatgtttgagcccgaaagagagaaggttgacgccattgatggagaatatcgcctcagaggcgaggctcggaaaaccttcgtggaccttatgcgcagaggggatctgcctgtctggctggcctaccgggtggcggccgaaggaatcaattatgctgaccgcagatggtgttttgatggcattaagaacaatcagatcctcgaggagaacgtcgaagtggagatttggacaaaggaaggggagcggaaaaagctgaaacccagatggcttgacgcccgcatctacagcgatcctctggctctcaaggagttcaaagaattcgccgctggccggaagtccctgaccctgaatctcattacggagatgggaagacttcccacctttatgacacagaaggcccgcaacgcgctggacaatctggccgttctccataccgctgaagccggcgggcgggcttataaccacgccctgtctgagcttccggaaacactggagaccctcctgctgctcacacttctggccaccgtgacgggaggcatcttcctgtttctcatgagcgggaaaggaatcggcaagatgacactgggcatgtgctgcattatcaccgcttccattcttctgtggtacgcgcaaatccagcctcattggattgccgctagcatcatcctcgagttctttctgattgtgctgctcatccccgaacccgagaaacagagaacccctcaggataatcaacttacatatgtcgttattgccatcctgaccgtggtggccgctacaatggccaacgaaatggggttcctggagaagacgaaaaaggactttggactcggctctattgcgacccagcagccggaatccaatatcctggatatcgaccttcggcccgccagcgcttggacactgtacgccgtcgctaccacattcattacccctatgctccgccactccatcgagaactctagcgtgaatgtttccctgacggccattgcgaaccaggccaccgtgctgatggggctcggaaagggctggcccctttctaaaatggacatcggggtccctctgctggctattggatgttacagccaagtgaatcccatcacactcaccgccgctctgcttctgctcgtcgcccactatgctattatcggccctggcctgcaggccaaggcgacaagagaggcccagaaacgggctgccgctgggatcatgaagaacccgaccgtggatggaattacggttatcgacctggatcccattccttacgaccccaaatttgaaaagcagctcggccaagtgatgcttctggtcctgtgcgtgacacaggttctcatgatgcgcaccacatgggccctgtgtgaggcccttaccctggcgaccgggcctatctccacactctgggaaggaaatcccggcagattctggaacacgaccattgctgtgagcatggccaacatctttcgggggtcttatctggctggagccggcctgctcttctccatcatgaagaatacagccaacacccgcagaggcacagggaataccggagagacgcttggcgaaaaatggaagaaccggctgaatgctctggggaaaagcgagtttcagatttacaagaaatctggaatccaagaggtcgatcgcacactcgccaaggaaggcattaaaagaggggagaccgaccatcacgcggtgtcccggggaagcgccaagctgagatggttcgtggaacgcaaccttgttaccccggagggcaaggtcgtggatctgggctgcgggcggggaggctggtcttattactgtgggggactcaaaaatgtgagagaggtcaagggcctgacaaaagggggacctggccatgaagagcccatccccatgagcacctatggctggaacctggttcgcctccagtccggggtggacgtgttctttacacctcccgaaaagtgcgatacgcttctgtgtgacattggagagtctagccctaatccgaccatcgaagctggccggacactgagagtcctcaacctggtggagaattggcttaacaataacacccagttctgcatcaaagttctgaatccctacatgccttccgtgattgagaagatggaagccctccagcgcaagtacgggggagctctggtccggaaccccctgagcagaaactccacacacgagatgtattgggtgtctaatgccagcggcaacatcgtttcctctgtgaatatgattagccgcatgctcatcaaccggtttaccatgagacataaaaaggcgacgtacgaacctgatgtcgaccttgggtccggaacccgcaatattggcatcgagtctgaaacacccaacctggatatcattggcaaacggatcgagaagattaaacaagagcacgaaaccagctggcactatgaccaggaccatccgtacaagacatgggcctatcacgggtcctacgagaccaagcagacaggaagcgcttcttccatggtgaatggcgtggtcagactgctcaccaaaccttgggatgttatccccacggtgacacagatggccatgaccgacaccacacctttcgggcaacagcgcgtgtttaaggaaaaagtcgatacgagaacccaggagcccaaggaaggaacaaaaaagctgatgaagattaccgctgagtggctttggaaagagctgggcaagaaaaagacacctcggatgtgtacccgcgaagagttcacaagaaaagtgcggagcaacgccgctctcggggccatctttaccgacgaaaataagtggaaatctgcgagagaggccgttgaggattcccggttctgggaactggtggacaaggagcgcaacctgcatctcgaaggaaagtgcgagacgtgtgtctataatatgatgggcaaaagagaaaagaaactgggcgagtttgggaaggctaaaggaagccgggccatttggtacatgtggcttggcgctcgcttcctggagtttgaagccctcgggttcctgaacgaggatcactggttttctagagaaaattcccttagcggagtggagggcgaagggctgcacaagctcggctacatcctgcgggacgtttccaagaaagagggaggcgccatgtatgcggatgacaccgctgggtgggatacacgcatcaccctggaggacctcaagaacgaagagatggtgacaaatcatatggaaggagagcacaaaaagctggccgaagccattttcaaacttacctaccagaacaaggtcgtgagagttcaacggcccacgccgcgcggcacagtgatggacatcattagcagacgggatcagcgcgggtctggacaggtcggcacctatgggctgaacacattcaccaatatggaggctcaactcatcagacagatggagggcgaaggagtgtttaagagcattcagcatctgacggtcaccgaggaaatcacagtgaaaaactggcttgcccgggttggccgcgagagactgtcccggatggctatctctggggacgattgcgtggtcaagcctctcgacgatagattcgccagcgcgctgaccgccctgaatgacatgggaaaagtgcgcaaggatattcagcaatgggagccctcccggggctggaacgactggacacaggtgcccttttgctctcaccatttccacgaactcatcatgaaagatgggagagttctggtggtcccttgtcgcaatcaggacgagcttattggacgggctagaatcagccagggcgccgggtggtccctgcgcgaaaccgcttgcctcggcaagtcttacgcccaaatgtggagcctgatgtattttcaccggagagatcttcgcctggcggccaacgctatttgttccgccgtgccgagccattgggttcccacatctcggaccacgtggtccatccacgctagacatgagtggatgacaaccgaagacatgctcaccgtgtggaatcgcgtctggatccaggagaacccttggatggaggataagacacccgtggaaagctgggaggaaattccttacctgggaaaacgggaggaccagtggtgcggctctctgatcgggctcacctccagagccacatgggctaagaatattcagacggccatcaaccaagtccggagcctgattggaaatgaagagtataccgactacatgccctccatgaaaagattccgccgggaggaagaggaagcgggcgtgctttggtga

SEQ ID NO: 20315 - RNA, 9876 nt, synthetic construct
  misc_feature 1..9876: note = derived and/or modified CDS sequence (opt5) from DENV-2__EU056811__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacaaaagacggcaccaatatgtgcacactgatggccatggatctcggggagctgtgtgaagacaccatcacatacaagtgcccgttccttaaacaaaacgagcccgaagatattgactgttggtgcaattctaccagcacgtgggttacctatggaacatgtaccacaaccggcgagcaccgcagagagaagcggtccgtggcgctggtgcctcatgtcgggatgggactcgaaacgcgcacagagacctggatgtctagcgaaggcgcttggaagcacgcccagagaatcgagacatggatcctgcggcatcccggctttaccattatggccgctatcctggcctacaccattgggacaacgcacttccagcgcgtgctcatctttattctgcttaccgctatcgccccttccatgacaatgagatgcattggaatctctaaccgggatttcgttgagggcgtgagcgggggatcctgggtcgacatcgtgctggaacacggcagctgtgttaccacaatggcgaaaaataagcccaccctcgattttgagctgattaaaacggaagccaagcagcctgctacacttcgcaaatattgcatcgaggccaagctgaccaacaccacaaccgactctagatgtccgacacaaggggaacccacgctcaatgaggagcaggataagcggttcgtgtgcaaacattccatggtcgaccgcggatggggcaacggctgtgggctgtttggaaagggcgggattgtgacctgcgctatgttcacatgcaaaaagaatatggaaggaaaaatcgtgcagcctgagaacctggaatacaccgtcgttattacaccccacagcggcgaggaacatgccgtggggaatgataccggaaagcacggcaaagaggtgaagatcacgcctcagtcttccatcaccgaggcggaactcacaggctatgggaccgtcacaatggagtgtagccccagaaccggactggactttaacgaaatggtgcttctgcaaatggaggataaggcctggctcgttcaccggcagtggttcctggaccttccgctgccttggctccccggcgctgacacgcaggggtctaattggattcagaaagaaacactggtgacctttaagaaccctcatgccaaaaagcaagatgtcgtggttctgggatcccaggagggcgctatgcacacagccctcaccggggccaccgagatccagatgagctccggcaatctgcttttcacaggacatctgaaatgccgcctcagaatggacaagctgcaacttaagggcatgtcttacagcatgtgtacggggaaattcaagattgtgaaagaaatcgctgagacccagcacggaacaattgtcatccgggtgcagtatgaaggcgatgggtccccctgcaagatcccctttgagattatggacctggagaaaagacatgtcctcggacgcctgatcaccgtgaaccctattgttacagaaaaggatagcccggtgaacatcgaggcggaaccccctttcggcgactcttacattatcattggggtcgagcccggccagctgaagctcgattggtttaaaaagggatccagcatcggccaaatgttcgaaaccacgatgcggggggccaaaagaatggctatcctgggagacacagcctgggattttggctctcttgggggagtgttcaccagcattggcaaggccctgcaccaggtttttggggctatctacggcgccgcgttctccggagtgtcttggaccatgaaaattctcatcggcgtcattatcacatggatcgggatgaatagccgctccaccagcctgtctgtgtccctggtgcttgttggaattgtcacactctatctgggcgtgatggtgcaggctgacagcgggtgtgtcgtgtcttggaagaacaaggagctgaaatgcggatccggcatctttgttacggataatgtgcacacctggacagagcagtacaagttccaacctgaaagcccctccaaactcgcctctgccattcagaaggctcatgaggaagggatctgtggcattcggagcgtcaccagactggagaaccttatgtggaaacagatcacatccgaactgaatcacatcctctctgagaacgaggtgaagctgaccattatgacgggagacatcaaaggcattatgcaggttgggaagcgcagcctgcggccgcaacctaccgaacttagatattcctggaagacatggggaaaagccaagatgctcagcaccgagctgcataatcagacatttctgatcgacggccccgaaaccgctgagtgccctaacacaaatcgcgcctggaactctctcgaagtggaggattacgggttcggagtctttaccacgaatatttggctgcggcttagagagaaacaggacgcgttctgtgattccaagctgatgagcgccgctatcaaagacaaccgcgccgtgcacgctgatatgggctattggatcgaatctgccctcaatgacacatggaagattgagaaggcgtccttcatcgaagttaaaagctgccactggcccaagtctcataccctgtggagcaacggcgtgctggagtccgagatggtcattcctaaaaatatcgccgggcccgtgagccagcacaacaaccggccgggataccatacccaaacagctggcccttggcaccttgggaagctcgaaatggattttgacttctgtgagggaaccacggtggtcgttacagaagagtgcggcaatagagggccctctctgcggaccacaaccgcctccggaaaactgattacagaatggtgctgtcgcagctgcaccctcccccctctgagatatcggggcgaggatggctgttggtacgggatggagatcagaccgcttaaggaaaaggaggaaaacctggtgtcctctctcgtgacggctggacatggccagattgacaattttagcctggggatcctgggaatggcccttttcctcgaggaaatgctgcgcacccgggtcggcacaaaacacgccatcctgctcgtggctgtttcctttctgacccttattacagggaacatgtctttcagagatctgggacgcgtgatggtcatggtgggcgcgaccatgacggacgatatcggcatgggggttacatacctcgccctgctggctgcctttaaggtgagacccaccttcgccgctggacttctgctccggaaactgacaagcaaggagctcatgatgaccaccattggcatcgtcctgctttcccagtctagcattcctgagacaatcctggaactcacggacgccctggcgctggggatgatggtgcttaaaatggttcgcaatatggagaagtatcaactggctgtgaccatcatggccattctctgcgtccccaacgccgtgatcctgcagaatgcttggaaggtgtcctgtacaaccctcgccgtcgttagcgtgtctcctctgcttctgacatccagccagcagaaagcggactggattcccctcgctctgaccatcaagggactgaaccctacggccatttttcttacaaccctgaccagaacatctaaaaagcggtcctggcccctcaatgaagccatcatggctgtgggcatggtcagcatcctggcctcttccctcctgaaaaacgatattccgatgaccgggcctcttgtggctggaggcctgctgacagtttgctacgtgctcacgggccgcagcgccgacctggagcttgaaagagcgaccgatgtcaagtgggacgatcaagccgagatctccgggagctctcccattctgagcatcacaatttccgaggacggatctatgagcatcaaaaatgaagaggaagagcagaccctcacaattctgatccggaccggcctcctggtgatctccgggcttttccctgtttctattcccatcacggctgccgcttggtatctgtgggaggtgaagaagcagcgcgccggagtcctgtgggatgtgccgagccctccccctgtcggcagagccgaactcgaggacggggcttaccggattaaacagaagggaatcctgggctattcccaaattggcgcgggggtgtacaaagaaggaacctttcacacaatgtggcatgttacccgcggcgccgtgcttatgcacaaggggaaaagaatcgagccctcttgggctgatgtcaagaaggacctgatcagctatggaggcgggtggaaactcgaaggagagtggaaggagggcgaagaggtgcaggttctggccctcgaacccggcaaaaaccctcgggccgtgcagacaaagccggggctgttcagaaccaatacaggaacgattggcgctgtctcccttgattttagccccgggacctctggatcccctatcgtggacaaaaagggcaaggtggttgggctgtacggaaacggcgtcgtgacacgcggcggggcctacgtgagcgcgattgctcagaccgagaaaggaatcgaagataatcccgagattgaggacgacatcttccggaagagacgcctgaccatcatggatctccatcctggcgccgggaaaacaaagcggtatctgcccgccattgtcagagaagctatcaaacgcggacttcggacgctgattctcgcccctaccagagtggttgcggctgagatggaagaggccctgcgcggcctcccgatccggtaccaaacacccgccattagagctgaacacaccgggcgggagatcgtggacctgatgtgtcatgccacattcaccatgcgccttctgtctcctattagagtccccaactataacctgatcatcatggatgaggctcactttacggaccctgcctccattgcggcccggggctacatcagcacacgcgtggaaatgggagaggctgccggcattttcatgaccgctacccccccggggtccagagatccttttccccagtctaatgcccccatcatggacgaagagcgggagattcctgaaagaagctggaactccggacacgagtgggttacagatttcaagggcaagaccgtgtggtttgtccccagcatcaaaacagggaatgacatcgccgcttgcctccgcaagaacggaaaacgggtgattcagctgtctagaaagaccttcgattccgaatatgttaaaacgcgcacaaatgactgggattttgtggtcaccacagacatcagcgagatgggcgcgaacttcaaggccgaacgggtgattgaccctagacgctgtatgaagccggtgatccttaccgatggggaggagcgggtcattctggctggccccatgcctgttacgcattctagcgccgcccaaagacgcggaagaatcggccggaatccccgcaacgaaaatgaccagtacatctatatgggggagcctctcgaaaacgatgaggactgcgctcactggaaagaagccaagatgctgctggataatattaacacccccgagggaatcattccgtccatgtttgagcctgaaagagagaaagtggacgcgatcgatggcgaataccggctccgcggggaggctagaaagacattcgtggaccttatgcggagaggagatctgcccgtctggctggcctacaaagtggccgctgaaggcattaattatgccgaccgccggtggtgttttgatgggaccagaaacaatcagatcctcgaggagaacgttgaagtggagatttggacaaaggaaggcgagcgcaaaaagctgaagcctcggtggcttgacgcgagaatctactctgatcccctggccctcaaagagttcaaggaattcgctgccggacggaaaagcctgaccctgaacctcatcacagagatgggccgccttcctacctttatgacgcagaaggctagagacgccctggacaatctggctgtcctccatacagccgaagcggggggaaaagcctataaccacgctctgtccgagcttcccgaaaccctggagaccctcctgctgctcacacttctggccaccgtgacaggcgggattttcctgtttctcatgtctggacggggcatcggcaagatgacgctggggatgtgctgcattatcaccgctagcattcttctgtggtacgcccaaatccagccgcactggatcgccgcttccattatcctcgagttctttctgattgttctgctcatccctgaacccgagaagcagcgcacaccccaggataatcaacttacctatgtgattatcgcgatcctgacagtcgtggccgctaccatggccaacgaaatgggattcctggagaaaacgaagaaagacctcggcctggggcatattgccacccagcagcctgaaagcaatatccttgatattgacctgagaccggcttctgcctggacactctacgcggtcgccaccacatttatcacccccatgctgcggcactccattgagaacagctccgtgaatgtttctctgacggctatcgccaaccaggctacagtgctcatgggacttggcaaggggtggcctctgagcaaaatggatattggagtgcccctgctcgccatcggctgttattcccaagtcaatcctatcaccctgacagcggcccttctgatgctcgttgctcattacgccattatcggccccgggctgcaggctaaggccacccgcgaggctcagaagagagccgcggccggaattatgaaaaaccctaccgtggacggcatcacagtgattgatctggacccgatcccctacgatcctaagttcgaaaaacagctcgggcaagtcatgcttctggtgctgtgcgttacgcaggtgctcatgatgcggaccacatgggctctgtgtgaggcccttaccctggctacaggacccgtctctaccctctgggaaggcaatcctgggcgcttttggaacacgacaatcgccgtgagcatggccaatattttcagaggatcctatctggcgggcgctggcctgctctttagcatcatgaagaacaccacctctacacggagagggaccggaaatatgggcgagacacttggggaaaaatggaagaaccgcctgaatgccctgggaaagtccgagttccagatttacaaaaagagcggcatccaagaggtcgaccggacgctcgctaaagaagggattaagagaggagagaccgatcaccatgccgtgtctcgcggctccgccaaactgcggtggtttgttgaaagaaaccttgtgacacccgagggcaaggtcgtggacctggggtgcggacgcggcgggtggagctattactgtggaggcctcaaaaacgttcgggaggtgaaggggctgaccaagggaggcccgggccacgaagagcctatccccatgtctacatatgggtggaatctggtcagactccagagcggagtggatgtgttcttcgttccccctgaaaaatgcgacacccttctgtgtgacatcggcgagtcctctcccaaccctacggtcgaagctgggcgcaccctgcgggtgctcaatctggtggagaactggcttaataacaatacacagttttgcgtcaaggttctgaacccgtacatgcccagcgtgattgagagaatggaaaccctccagcgcaaatatggaggcgccctggtgcggaatcctctgtccagaaacagcacacacgagatgtactgggtctccaatgcgtctgggaacatcgtgagctccgttaatatgatttctcgcatgctcatcaacagattcaccatgcggcataagaaagccacatacgaacccgatgtggaccttggaagcggcacccgcaatattggcatcgagtccgaaacgcctaacctggatatcattgggaagagaatcgagaagattaaacaagagcacgaaacatcttggcattatgaccaggatcacccctacaagacctgggcttatcacggaagctacgagaccaaacagacaggctccgccagctctatggtcaacggggtggttcggctgctcacgaagccgtgggacgtgatccctatggtcacccagatggctatgacagataccacaccctttggacaacagagagtgttcaaagaaaaggtggacacccggacacaggagcctaaggaaggcaccaaaaagctgatgaaaattacggccgagtggctttggaaggagctggggaaaaagaagaccccccgcatgtgtacaagagaagagtttaccaaaaaggtccggtccaatgcggccctcggagctatcttcacagatgaaaacaaatggaagagcgcccgcgaggctgttgaggacaatagattttgggaactggtggataaagagcggaacctgcatctcgaaggcaagtgcgagacctgtgtgtataatatgatgggcaaacgcgaaaagaagctgggggagttcggaaaagccaagggctctagagctatttggtacatgtggcttggggcccggtttctggagttcgaagcgctcggatttctgaacgaggaccactggttctcccgcgaaaatagcctttctggcgtcgagggggaaggcctgcataaactcggatatatcctgagagaggtgtccaagaaagagggcggggccatgtacgctgacgatacggccggatgggacacacggatcaccattgaagatctgaagaacgaggaaatgatcacaaatcacatggctggcgagcataagaaactcgccgaagccatttttaagctgacctaccagaacaaagttgtgcgcgtccaaagacctacgccccgggggaccgtgatggacatcattagccgcagagatcagcggggatccggccaggttgtgacatatgggcttaataccttcacaaacatggaggcgcaactgatcagacagatggagggcgaaggagtcttcaagagcatccagcacctcaccgcttctgaggaaattgccgtgcaggactggctggttcgcgtgggccgggagagacttagccgcatggccatctccggggatgactgcgtcgtgaaaccgctggatgaccggtttgctaaggccctcacagctctgaatgatatgggaaaggtcagaaaagacattcaacagtgggagccttctcgcggctggaacgattggacccaggtgcccttctgcagccaccattttcacgaactgatcatgaaggacgggcggacgctcgttgtgccctgtagaaatcaggacgagctgattggacgcgcccggatctcccaaggcgcggggtggtctcttagagaaacagcctgcctgggcaaaagctacgctcagatgtggtccctcatgtatttccatcgccgggatctgagacttgccgctaacgccatctgttctgcggtccctagccactgggtgccgacctcccggaccacatggagcattcacgcctctcatgagtggatgaccacagaagacatgctgacggtgtggaacagagtttggatcctcgagaatccctggatggaggataagacccctgtggaatcctgggaggaaattccctacctgggaaaacgcgaggaccagtggtgcggcagcctgatcgggctcacatctcgggctacctgggccaagaacattcagacagctatcaatcaagtcagatccctgattggaaacgaagagtataccgattacatgcctagcatgaagcgctttagacgggaggaagaggaagccggcgtgctttggtga

SEQ ID NO: 20316 - RNA, 9876 nt, synthetic construct
  misc_feature 1..9876: note = derived and/or modified CDS sequence (opt5) from DENV-2__DQ645545__SS-prME
  source 1..9876: mol_type = other RNA
accgccggcgtgatcattatgatgatccccacagtcgttgctttccacctgacgacccggaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttagacaaaacgaacccgaggacattgattgttggtgcaattctacaagcacctgggtcacgtatggaacctgtacagcgaccggcgagcaccggcgggaaaaacgctccgtggctctggttcctcatgtggggatgggactcgagacaagaaccgaaacgtggatgtctagccagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggagggcgtcagcgggggatcctgggtggatattgtgctggaacacggcagctgtgtcaccacaatggccaaaaataagcccaccctcgacttcgagctgatcaagacagaagctaaacaccctgccacccttagaaagtactgcatcgaggctaaactgacgaacacaaccaccgcctctcggtgtccgacacaaggggaaccctccctcaatgaggagcaggataagcgctttgtttgcaaacatagcatggtggacagaggatggggcaacggctgtgggctgttcggaaagggcgggattgtgacctgcgcgatgtttacatgcaagaaaaatatggaaggaaaggtcgtgcagcctgagaacctggaatatacgatcgttattacaccccactctggcgaggaaaatgccgtggggaacgatacaggaaaacatggcaaggagatcaaagtcacccctcagtccagcattacagaggctgaactcaccggctacgggacggtgaccatggagtgttctccccggacaggactggacttcaatgaaatggttcttctgcaaatggaggataaggcctggctcgtgcaccgccagtggtttctggaccttccgctgccttggctccccggcgctgatacccaggggtccaactggatccagaaagaaacactggtcaccttcaagaaccctcacgccaagaaacaagacgtggtcgtgctgggaagccaggagggcgccatgcatacggctctcacaggggcgaccgagatccagatgtcctctggcaatctgctttttacaggacacctgaagtgcagactccggatggacaaactgcaacttaagggcatgagctattccatgtgtaccgggaaattcaaggttgtgaaggaaattgccgagacccagcatggaacaatcgtcattagagtgcagtacgaaggcgatgggagcccctgcaaaatccccttcgagattatggacctggagaagcgccacgttctcggacggctgatcacggtgaaccctatcgtcaccggcaaagattctccggtgaatattgaagctgagcccccttttggggactcctacatcattatcggcgtggaacccggacagctgaagctcagctggttcaaaaagggctctagcattgggcaaatgtttgagacaaccatgagaggagccaagcgcatggccatcctgggcgatacagcttgggacttcgggtcccttggaggcgtttttacctctattgggaaagccctgcatcaggtcttcggcgcgatctatggagctgcctttagcggcgtgtcctggacgatgaagatcctcattggggtggtcatcacatggattggaatgaacagccggtctacctccctgagcgtgtctctggttcttgtgggcgtcgtgaccctctacctgggggttatggtgcaggccgattccggatgtgtcgtgagctggaaaaataaggaactgaaatgcggctccgggatcttcattacagacaacgttcacacctggacagagcagtataagtttcaacctgagtctcccagcaagctcgcttccgccatccagaaagctcacgaagagggcatctgtggaattagatctgtgacgcgcctggaaaatcttatgtggaagcagatcaccccggagctgaaccatattctcagcgaaaatgaggtcaaactgacaatcatgaccggcgatattaaggggatcatgcaggccggaaaacggtccctgagacctcaacccacagagcttaagtacagctggaaagcgtggggcaaggccaagatgctctctaccgaactgcacaaccatacgttcctgatcgacgggcctgagaccgctgaatgccccaatacaaaccgcgcctggaatagcctcgaggtggaagattatggatttggcgtgttcaccacaaacatttggctgaaacttaaggagcggcaggacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggggtgctggaaagcgagatgatcatccccaagaatttcgctggaccggtctctcagcacaactatcgccctggctaccatacccagacggccgggccctggcaccttggaaaactcgagatggactttgatttctgtgaaggcacaaccgtggttgtgaccgaggactgcgggaatcggggaccctccctgagaacaaccacggccagcggcaagctgattacagaatggtgctgtcggtcctgcaccctccctccgctgcgctacagaggcgaggatgggtgttggtatggaatggaaatccggccccttaaagagaaggaggaaaacctggtcaattctctcgtgacagctggccatgggcaaattgacaactttagcctgggagttctgggcatggcgcttttcctcgaggaaatgctgagaacccgcgtggggacaaagcacgccatcctgctcgtcgctgtgtcctttgttaccctgattacgggaaatatgtctttccgggatcttggcagagtgatggtcatggtgggcgccaccatgacagacgatatcgggatgggagtgacctacctggccctcctggctgcctttaaagtccgccctacattcgcggctggcctgcttctgagaaagctcaccagcaaagagctgatgatgacgacaattgggatcgttctcctgtcccagtctaccatccccgaaacaattcttgagctgaccgacgccctcgccctgggaatgatggtgctgaagatcgtgcggaacatggagaaatatcagcttgctgtcaccattatggccatcctgtgcgtgcctaatgcggttattctccaaaacgcttggaaggtgagctgtacaatcctggccgtcgtgtccgttagccccctcctgcttacgtcttcccagcagaaggccgattggatccctctggctctcaccattaaaggcctgaatcccacagccatctttctgaccacacttagccgcacctctaagaaaagatcctggccgctgaacgaagctattatggccgtggggatggtcagcatcctcgcgtcttccctgctcaagaatgacattcctatgacgggacccctggtggccggcggccttctgacagtctgctacgtgctgaccgggcggagcgctgacctcgagctggaacgcgccgctgatgttagatgggaggaacaggccgagatctccggaagctctcctatccttagcattaccatctccgaggacggctctatgagcattaaaaacgaagaggaggaacaaacactgaccatcctcattcggacagggctgctcgtgatctccggactgttccccgtctctattccgatcacggccgctgcgtggtatctttgggaggtgaagaaacagcgcgccggcgttctgtgggatgtgccttctccccctcccgtcgggaaggctgaactggaggacggagcctacagaatcaagcagaaaggcattctcggctattcccagatcggggccggagtgtacaaggaaggcacctttcacacaatgtggcatgtgaccagaggggctgttctgatgcacaaaggaaagcgcattgagccctcctgggccgatgtcaaaaaggaccttatcagctacggcgggggatggaagctggaaggcgagtggaaagagggcgaagaggtgcaagtgctcgcgctggaacctgggaagaatccgagagctgtccagacaaaacccggactcttcaagaccaacacgggcaccattggggccgtgtccctggattttagccctggaacatctggctcccccatcgttgacaaaaaggggaaggtggtcggactttatggcaacggcgtggttacccggagcgggacatacgtgtctgccatcgctcagaccgagaaatccattgaagataatcctgagatcgaggacgatattttcagaaagaaacgcctgacaatcatggacctgcatcccggagccggcaagacgaaacggtatctccctgcgattgtcagagaagctatcaagcgcgggctgcggacccttatcctggccccgacaagagtggttgccgctgagatggaagaggccctccgcggactgcccattcggtaccagacccctgctatcagagccgaacacaccggccgcgagattgtggatctcatgtgtcatgcgacattcacgatgcggctgcttagccccatcagagtccctaactataatctgattatcatggacgaggcccactttaccgaccccgcttccattgccgctcgggggtacatctctacacgcgtggaaatgggcgaggccgccggaatcttcatgaccgctacaccgcctggcagcagagatccctttccccaatccaacgcgcctattatggacgaagaacgggagatccccgaacgcagctggaactctgggcacgagtgggtgaccgatttcaagggaaaaacggtctggtttgttccttccattaaggccggcaacgacatcgctgcctgcctgcgcaaaaatgggaagaaagtgattcagctcagccggaagacattcgattctgaatatgtgaagaccagaaccaacgactgggattttgtcgtgacaaccgacatcagcgagatgggagccaatttcaaagctgaacgcgttatcgatccgcggagatgtatgaagcccgtgattctgacagacggcgaggagcgcgtcatccttgccgggcctatgcccgtgacccattcctctgcggctcagcggagaggccgcgttggacggaaccctaaaaatgaaaacgatcaatacatttacatgggcgagcccctggaaaatgacgaggactgcgcccactggaaggaagccaaaatgctcctggataacatcaatacgccggaggggattatccctagcatgtttgagcccgaaagagagaaggtggacgctatcgatggagaatatcgcctgagaggcgaggcccggaaaacattcgtcgacctcatgcgcagaggggatcttcctgtgtggctggcgtaccgggtcgccgctgaaggaattaactatgccgaccgcagatggtgttttgatggcgtgaagaacaatcagatcctggaggagaacgttgaagtggagatttggaccaaggaaggggagcggaaaaagctcaaacccagatggctggacgctcgcatctactccgatcctcttgccctgaaggagttcaaagagttcgctgccggccggaagtctctcacactgaatctgattaccgagatgggaagactccccacgtttatgacccagaaggcgcgcaacgcccttgacaatctggctgtgctgcatacagccgaagctggcgggcgggcctataaccacgccctcagcgagctgccggaaacccttgagacactgctcctgctgaccctccttgctacagtcaccggaggcatcttcctgtttctgatgtccgggaaaggaattggcaagatgacgctcggcatgtgctgcatcatcacagcgagcgttctgctttggtacgcccagattcaacctcactggatcgctgcctctattatcctggagttctttctcattgtgctgctgatccccgaacccgagaaacagagaacccctcaggataatcagctcacctatgtggtcatcgccattcttacagtggttgctgccaccatggcgaacgaaatggggttcctggagaagaccaaaaaggactttggactgggcgggatcgccacgcaacagccggaatccaatattctcgatatcgacctgcggcccgctagcgcctggaccctttacgctgtggccacaaccttcattacacctatgctgcgccattccatcgagaactctagcgtcaatgtgtccctcaccgcgatcgccaaccaggctacggtcctgatgggactgggcaaggggtggcccctctctaaaatggacattggagtgcctcttctggccatcggctgttacagccaggttaatcccattaccctgacagctgccctcctgcttctggtggctcactatgccatcattggccctgggctccaagcgaaggccaccagagaggctcagaaacgggccgctgccggaatcatgaagaacccgacagtcgatggcattaccgtgatcgacctggatcccatcccttacgaccccaaatttgaaaagcagctggggcaggttatgctccttgtgctgtgcgtcacgcaagtgctgatgatgcgcacaacctgggccctctgtgaggcgctgacacttgctaccggacctatttccaccctgtgggaaggcaatcccgggagattctggaacacaacgatcgccgtgagcatggctaatatttttcggggatcttatctcgccggcgccggcctgctgttctccatcatgaagaacaccgctaacacacgcagagggaccggaaatacaggcgagaccctcggggaaaaatggaagaaccggcttaatgccctgggaaaaagcgagtttcagatttacaagaaatctggcatccaggaggttgatcgcacgctggcgaaggaagggatcaaaagaggagagacagaccatcacgccgtctcccggggcagcgctaagctcagatggttcgtggaacgcaacctggtgaccccggagggcaaggtcatggatcttgggtgcggacggggcgggtggtcttattactgtggaggcctgaaaaatgttaaggaggtgaaagggctcaccaagggaggccctggccatgaggaacccattcccatgagcacatatgggtggaacctggtgagactgcaatccggagtcgacgtgttctttacccctcccgaaaaatgcgatacactcctttgtgacatcggcgagtctagccctaatccgacggttgaagccgggcgcaccctgcgggtgctgaacctcgtcgagaattggctgaacaataacacacagttctgcattaaggtgcttaatccctacatgccttccgttatcgagaagatggaagctctgcagagaaaatacggaggcgccctcgtgcgcaaccccctgagcagaaattccacccacgagatgtattgggtctctaacgcgagcgggaacattgtgtcctctgtgaatatgatcagcagaatgctgatcaaccgctttacaatgcggcacaagaaagccacctacgaacctgatgtcgacctcggatccggcacgagaaatattggcatcgagtctgaaacccccaaccttgatattatcgggaagcgcattgagaaaatcaagcaggagcatgaaacaagctggcactatgaccaagaccatccgtacaagacctgggcttatcacggatcctacgagacaaaacagaccggcagcgcctcttccatggttaatggggtggtgcggctgctgacaaagccttgggatgtcatccccatggtgacccagatggctatgacggacacaacccctttcggacagcaaagagtttttaaagaaaaggtggatacccgcacacaggagcccaaagaaggcacgaagaagctcatgaaaattaccgccgagtggctgtggaaggagcttgggaaaaagaaaacacctagaatgtgtacccgggaagagttcacacgcaaggtcagaagcaacgctgccctgggagcgatctttaccgacgaaaataaatggaagtctgcccgggaggctgtggaggattccggcttctgggaactcgttgacaaggagagaaacctgcacctggaaggcaaatgcgagacatgtgtgtataatatgatggggaagcgggagaaaaagctcggagagtttggcaaagccaaggggagccgcgctatttggtacatgtggctgggagccagattccttgagtttgaagccctgggcttcctcaacgaggatcattggttttctcgggaaaattccctgagcggggtcgagggcgaaggacttcacaagctgggctacatcctccgcgacgtgtccaaaaaggaaggcggggcgatgtatgctgatgacaccgccgggtgggatacgagaattaccctggaggacctgaaaaacgaagagatggttacaaatcatatggaaggggagcacaagaaactcgccgaagctatcttcaagctgacctaccagaacaaggtggtccgggtgcagcgccccacaccgagaggaaccgtcatggacattatcagccggcgcgatcaaagaggctctggacaggtggttacgtatggccttaatacattcaccaacatggaggcccagctgatccggcaaatggagggagaaggcgtgtttaaaagcattcagcagctcacagctaccgaggaaatcgccgtcaagaactggctggcgcgcgtggggagagagcggctttcccgcatggccatttctggagacgattgcgtggttaaacctctggacgatagattcgctagcgccctcacggctctgaatgacatgggcaaggtgcggaaagatatccagcaatgggagccctccagagggtggaacgactggacccaggtccccttttgctctcatcacttccacgaactgattatgaaggatggacgcgtgctcgttgtgccttgtcggaatcaggacgagctgatcggcagagcccgcatcagccagggggcgggctggtcccttcgggaaacagcctgcctgggaaagtcttacgctcaaatgtggagcctcatgtattttcatagacgcgatctgcggcttgccgctaacgccatttgttccgctgtcccgagccactgggtgcccacctctagaacaacctggtccatccatgccacacacgagtggatgaccacggaagacatgctgacagtctggaatcgcgtgtggattcaggagaacccttggatcgaggataaaacccccgttgaaagctgggaggaaattccttacctcggcaagcgggaggaccagtggtgcgggtctctgatcggactgacctccagagcgacatgggccaaaaatatccagaccgctattaaccaagtgcgcagcctcatcggcaatgaagagtatacagactacatgccctccatgaagcggttcagacgggaggaagaggaagccggggtcctgtggtga

SEQ ID NO: 20317 - RNA, 9876 nt, synthetic construct
  misc_feature 1..9876: note = derived and/or modified CDS sequence (opt5) from DENV-2__DQ645546__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaatatcagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctacgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtatctttgggaggtgaagaaacaacgcgccggagttctgtgggatgtgccttctccccctcccgtcggcaaggctgaactggaggacggggcctacagaatcaagcagaaaggcattctcggctattcccagatcggcgccggggtgtacaaggaaggaacctttcacacaatgtggcatgtgacccggggcgctgttctgatgcacaaagggaagcgcattgagccctcctgggccgatgtcaaaaaggaccttatcagctacggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgagaaatccattgaggataatcctgaaatcgaggacgatattttcagaaagaaacgcctgacaatcatggacctgcatcccggggccggaaagacgaaacggtatctccctgcgattgtcagagaagctatcaagcgcggcctgcggacccttatcctggccccgacaagagtggttgccgctgagatggaagaggccctccgcgggctgcccattcggtaccagacccctgctatcagagccgagcacaccggacgcgaaattgtggatctcatgtgtcatgcgacattcacgatgcggctgcttagccccatcagagtccctaactataatctgattatcatggacgaggcccactttaccgaccccgcttccattgccgctcggggctacatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatatgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccattcctctgcggctcagcggagagggcgcgttggccggaaccctaaaaatgaaaacgatcagtacatttacatgggagagcccctggaaaatgacgaggactgcgcccactggaaggaggccaaaatgctcctggataacatcaatacgccggaaggcattatccctagcatgtttgagcccgaaagagagaaggtggacgctatcgatggggaatatcgcctgagaggagaggcccggaaaacattcgtcgacctcatgcgcagaggcgatcttcctgtgtggctggcgtaccgggtcgccgctgaggggattaactatgccgaccgcagatggtgttttgatggagtgaagaacaatcaaatcctggaagagaacgttgaagtggagatttggaccaaggagggcgaacggaaaaagctcaaacccagatggctggacgctcgcatctactccgatcctcttgccctgaaggagttcaaagagttcgctgccgggcggaagtctctcacactgaatctgattaccgagatgggcagactccccacgtttatgacccagaaggcgcgcaacgcccttgacaatctggctgtgctgcatacagccgaagctggaggccgggcctataaccacgccctcagcgagctgccggagacccttgaaacactgctcctgctgaccctccttgctacagtcaccgggggaatcttcctgtttctgatgtccggcaaagggattggaaagatgacgctcggcatgtgctgcatcatcacagcgagcgttctgctttggtacgcccagattcagcctcactggatcgctgcctctattatcctggagttctttctcattgtgctgctgatccccgaacccgagaaacaaagaacccctcaggataatcagctcacctatgtggtcatcgccattcttacagtggttgctgccaccatggcgaacgaaatgggcttcctggagaagaccaaaaaggactttgggctgggaggcatcgccacgcagcaaccggagtccaatattctcgatatcgacctgcggcccgctagcgcctggaccctttacgctgtggccacaaccttcattacacctatgctgcgccattccatcgaaaactctagcgtcaatgtgtccctcaccgcgatcgccaaccaggctacggtcctgatggggctgggaaagggctggcccctctctaaaatggacattggggtgcctcttctggccatcggatgttacagccaggttaatcccattaccctgacagctgccctcctgcttctggtggctcactatgccatcattggccctggcctccaggcgaaggccaccagagaggctcaaaaacgggccgctgccgggatcatgaagaacccgacagtcgatggaattaccgtgatcgacctggatcccatcccttacgaccccaaatttgaaaagcagctgggccaggttatgctccttgtgctgtgcgtcacacaggtgctgatgatgcgcacaacctgggccctctgtgaggcgctgacacttgctaccgggcctatttccaccctgtgggaaggaaatcccggcagattctggaacacaacgatcgccgtgagcatggctaatatttttcgggggtcttatctcgccggagccggcctgctgttctccatcatgaagaacaccgctaacacacgcagaggcaccgggaatacaggagagaccctcggcgagaaatggaagaaccggcttaatgccctggggaaaagcgaatttcaaatttacaagaaatctggaatccaggaggttgatcgcacgctggcgaaggaaggcatcaaaagaggggagacagaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcaccaaaggcgggcctgggcatgaagaacccattcccatgagcacatatggctggaacctggtgagactgcagtccggggtcgacgtgttctttacccctcccgaaaaatgcgatacactcctttgtgacatcggagagtctagccctaatccgacggttgaggccggccgcaccctgcgggtgctgaacctcgtcgaaaattggctgaacaataacacacaattctgcattaaggtgcttaatccctacatgccttccgttatcgagaagatggaagctctgcagagaaaatacgggggagccctcgtgcgcaaccccctgagcagaaattccacccacgagatgtattgggtctctaacgcgagcggcaacattgtgtcctctgtgaatatgatcagcagaatgctgatcaaccgctttacaatgcggcacaagaaagccacctacgaacctgatgtcgacctcgggtccggaacgagaaatattggcatcgagtctgagacccccaaccttgatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagaaaaggtggatacccgcacacaagagcccaaagagggaacgaagaagctcatgaaaattaccgccgaatggctgtggaaggagcttggcaaaaagaaaacacctagaatgtgtacccgggaagagttcacacgcaaggtcagaagcaacgctgccctgggggcgatctttaccgacgagaataaatggaagtctgcccgggaagctgtggaggattccggattctgggaactcgttgacaaggagagaaacctgcacctggaaggcaaatgcgagacatgtgtgtataatatgatgggcaagcgggagaaaaagctcggggaatttggaaaagccaagggcagccgcgctatttggtacatgtggctgggggccagattccttgagtttgaagccctgggattcctcaacgaggatcattggttttctcgggaaaattccctgagcggcgtcgagggggagggccttcacaagctgggatacatcctccgcgacgtgtccaaaaaggaaggcggggcgatgtatgctgatgacaccgccggatgggatacgagaattaccctggaggacctgaaaaacgaagagatggttacaaatcatatggaaggcgagcacaagaaactcgccgaggctatcttcaagctgacctaccagaacaaggtggtccgggtgcagcgccccacaccgagagggaccgtcatggacattatcagccggcgcgatcagagaggatctggccaagtggttacgtatgggcttaatacattcaccaacatggaagcccagctgatccggcagatggagggcgaaggagtgtttaaaagcattcaacagctcacagctaccgaggagatcgccgtcaagaactggctggcgcgcgtgggcagagaacggctttcccgcatggccatttctggggacgattgcgtggttaaacctctggacgatagattcgctagcgccctcacggctctgaatgacatgggaaaggtgcggaaagatatccagcagtgggagccctccagaggctggaacgactggacccaagtccccttttgctctcatcacttccacgaactgattatgaaggatgggcgcgtgctcgttgtgccttgtcggaatcaggacgagctgatcggacgggcccgcatcagccagggcgcggggtggtcccttcgggaaacagcctgcctgggcaagtcttacgctcagatgtggagcctcatgtattttcatagacgcgatctgcggcttgccgctaacgccatttgttccgctgtcccgagccactgggtgcccacctctagaacaacctggtccatccatgccacacacgagtggatgaccacggaggacatgctgacagtctggaatcgcgtgtggattcaagaaaacccttggatcgaggataaaacccccgttgaaagctgggaggaaattccttacctcggaaagcgggaggaccagtggtgcggctctctgatcgggctgacctccagagcgacatgggccaaaaatatccagaccgctattaaccaggtgcgcagcctcatcggaaatgaggaatatacagactacatgccctccatgaagcggttcagacgggaggaagaggaagccggcgtcctgtggtga

SEQ ID NO: 20318 - RNA, 9876 nt, synthetic construct
  misc_feature 1..9876: note = derived and/or modified CDS sequence (opt5) from DENV-2__DQ645547__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagtacgccatcctgctcgtcgctgtgtcctttgttaccctgattacggggaatatgtctttccgggatcttggaagagtgatggtcatggtgggcgccaccatgacagacgatatcggcatgggggtgacctatctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaataccagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctatgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtacctttgggaggtgaagaaacaacgcgccggagttctgtgggatgtgccttctccccctcccgtcggcaaggctgaactggaggacggggcctatagaatcaagcagaaaggcattctcggctactcccagatcggcgccggggtgtacaaggaaggaacctttcacacaatgtggcacgtgacccggggcgctgttctgatgcataaagggaagcgcattgagccctcctgggccgatgtcaaaaaggaccttatcagctatggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttacggaaacggcgtggttacccggagcggcacatatgtgtctgccatcgctcagaccgagaaatccattgaggataatcctgaaatcgaggacgatattttcagaaagaaacgcctgacaatcatggacctgcaccccggggccggaaagacgaaacggtacctccctgcgattgtcagagaagctatcaagcgcggcctgcggacccttatcctggccccgacaagagtggttgccgctgagatggaagaggccctccgcgggctgcccattcggtatcagacccctgctatcagagccgagcataccggacgcgaaattgtggatctcatgtgtcacgcgacattcacgatgcggctgcttagccccatcagagtccctaactacaatctgattatcatggacgaggcccattttaccgaccccgcttccattgccgctcggggctatatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatacgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccactcctctgcggctcagcggagagggcgcgttggccggaaccctaaaaatgaaaacgatcagtacatttatatgggagagcccctggaaaatgacgaggactgcgcccattggaaggaggccaaaatgctcctggataacatcaatacgccggaaggcattatccctagcatgtttgagcccgaaagagagaaggtggacgctatcgatggggaataccgcctgagaggagaggcccggaaaacattcgtcgacctcatgcgcagaggcgatcttcctgtgtggctggcgtatcgggtcgccgctgaggggattaactacgccgaccgcagatggtgttttgatggagtgaagaacaatcaaatcctggaagagaacgttgaagtggagatttggaccaaggagggcgaacggaaaaagctcaaacccagatggctggacgctcgcatctattccgatcctcttgccctgaaggagttcaaagagttcgctgccgggcggaagtctctcacactgaatctgattaccgagatgggcagactccccacgtttatgacccagaaggcgcgcaacgcccttgacaatctggctgtgctgcacacagccgaagctggaggccgggcctacaaccatgccctcagcgagctgccggagacccttgaaacactgctcctgctgaccctccttgctacagtcaccgggggaatcttcctgtttctgatgtccggcaaagggattggaaagatgacgctcggcatgtgctgcatcatcacagcgagcgttctgctttggtatgcccagattcagcctcactggatcgctgcctctattatcctggagttctttctcattgtgctgctgatccccgaacccgagaaacaaagaacccctcaggataatcagctcacctacgtggtcatcgccattcttacagtggttgctgccaccatggcgaacgaaatgggcttcctggagaagaccaaaaaggactttgggctgggaggcatcgccacgcagcaaccggagtccaatattctcgatatcgacctgcggcccgctagcgcctggaccctttacgctgtggccacaaccttcattacacctatgctgcgccactccatcgaaaactctagcgtcaatgtgtccctcaccgcgatcgccaaccaggctacggtcctgatggggctgggaaagggctggcccctctctaaaatggacattggggtgcctcttctggccatcggatgttatagccaggttaatcccattaccctgacagctgccctcctgcttctggtggctcattacgccatcattggccctggcctccaggcgaaggccaccagagaggctcaaaaacgggccgctgccgggatcatgaagaacccgacagtcgatggaattaccgtgatcgacctggatcccatcccttatgaccccaaatttgaaaagcagctgggccaggttatgctccttgtgctgtgcgtcacacaggtgctgatgatgcgcacaacctgggccctctgtgaggcgctgacacttgctaccgggcctatttccaccctgtgggaaggaaatcccggcagattctggaacacaacgatcgccgtgagcatggctaatatttttcgggggtcttacctcgccggagccggcctgctgttctccatcatgaagaacaccgctaacacacgcagaggcaccgggaatacaggagagaccctcggcgagaaatggaagaaccggcttaatgccctggggaaaagcgaatttcaaatttataagaaatctggaatccaggaggttgatcgcacgctggcgaaggaaggcatcaaaagaggggagacagaccaccatgccgtctcccggggaagcgctaagctcagatggttcgtggagcgcaacctggtgaccccggaaggcaaggtcatggatcttggctgcgggcggggaggctggtcttactattgtgggggactgaaaaatgttaaggaggtgaaaggcctcaccaaaggcgggcctgggcacgaagaacccattcccatgagcacatacggctggaacctggtgagactgcagtccggggtcgacgtgttctttacccctcccgaaaaatgcgatacactcctttgtgacatcggagagtctagccctaatccgacggttgaggccggccgcaccctgcgggtgctgaacctcgtcgaaaattggctgaacaataacacacaattctgcattaaggtgcttaatccctacatgccttccgttatcgagaagatggaagctctgcagagaaaatatgggggagccctcgtgcgcaaccccctgagcagaaattccacccatgagatgtactgggtctctaacgcgagcggcaacattgtgtcctctgtgaatatgatcagcagaatgctgatcaaccgctttacaatgcggcacaagaaagccacctatgaacctgatgtcgacctcgggtccggaacgagaaatattggcatcgagtctgagacccccaaccttgatattatcggcaagcgcattgagaaaatcaagcaggagcacgaaacaagctggcattacgaccaggaccacccgtataagacctgggcttaccatgggtcctatgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagaaaaggtggatacccgcacacaagagcccaaagagggaacgaagaagctcatgaaaattaccgccgaatggctgtggaaggagcttggcaaaaagaaaacacctagaatgtgtacccgggaagagttcacacgcaaggtcagaagcaacgctgccctgggggcgatctttaccgacgagaataaatggaagtctgcccgggaagctgtggaggattccggattctgggaactcgttgacaaggagagaaacctgcacctggaaggcaaatgcgagacatgtgtgtacaatatgatgggcaagcgggagaaaaagctcggggaatttggaaaagccaagggcagccgcgctatttggtacatgtggctgggggccagattccttgagtttgaagccctgggattcctcaacgaggatcactggttttctcgggaaaattccctgagcggcgtcgagggggagggccttcataagctgggatatatcctccgcgacgtgtccaaaaaggaaggcggggcgatgtacgctgatgacaccgccggatgggatacgagaattaccctggaggacctgaaaaacgaagagatggttacaaatcacatggaaggcgagcataagaaactcgccgaggctatcttcaagctgacctatcagaacaaggtggtccgggtgcagcgccccacaccgagagggaccgtcatggacattatcagccggcgcgatcagagaggatctggccaagtggttacgtacgggcttaatacattcaccaacatggaagcccagctgatccggcagatggagggcgaaggagtgtttaaaagcattcaacagctcacagctaccgaggagatcgccgtcaagaactggctggcgcgcgtgggcagagaacggctttcccgcatggccatttctggggacgattgcgtggttaaacctctggacgatagattcgctagcgccctcacggctctgaatgacatgggaaaggtgcggaaagatatccagcagtgggagccctccagaggctggaacgactggacccaagtccccttttgctctcaccatttccacgaactgattatgaaggatgggcgcgtgctcgttgtgccttgtcggaatcaggacgagctgatcggacgggcccgcatcagccagggcgcggggtggtcccttcgggaaacagcctgcctgggcaagtcttatgctcagatgtggagcctcatgtactttcacagacgcgatctgcggcttgccgctaacgccatttgttccgctgtcccgagccattgggtgcccacctctagaacaacctggtccatccacgccacacatgagtggatgaccacggaggacatgctgacagtctggaatcgcgtgtggattcaagaaaacccttggatcgaggataaaacccccgttgaaagctgggaggaaattccttatctcggaaagcgggaggaccagtggtgcggctctctgatcgggctgacctccagagcgacatgggccaaaaatatccagaccgctattaaccaggtgcgcagcctcatcggaaatgaggaatacacagactacatgccctccatgaagcggttcagacgggaggaagaggaagccggcgtcctgtggtga

SEQ ID NO: 20319 - RNA, 9876 nt, synthetic construct
  misc_feature 1..9876: note = derived and/or modified CDS sequence (opt5) from DENV-2__DQ645549__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaatatcagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctacgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtatctttgggaggtgaagaaacaacgcgccggagttctgtgggatgtgccttctccccctcccgtcggcaaggctgaactggaggacggggcctacagaatcaagcagaaaggcattctcggctattcccagatcggcgccggggtgtacaaggaaggaacctttcacacaatgtggcatgtgacccggggcgctgttctgatgcacaaagggaagcgcattgagccctcctgggccgatgtcaaaaaggaccttatcagctacggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgagaaatccattgaggataatcctgaaatcgaggacgatattttcagaaagaaacgcctgacaatcatggacctgcatcccggggccggaaagacgaaacggtatctccctgcgattgtcagagaagctatcaagcgcggcctgcggacccttatcctggccccgacaagagtggttgccgctgagatggaagaggccctccgcgggctgcccattcggtaccagacccctgctatcagagccgagcacaccggacgcgaaattgtggatctcatgtgtcatgcgacattcacgatgcggctgcttagccccatcagagtccctaactataatctgattatcatggacgaggcccactttaccgaccccgcttccattgccgctcggggctacatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatatgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccattcctctgcggctcagcggagagggcgcgttggccggaaccctaaaaatgaaaacgatcagtacatttacatgggagagcccctggaaaatgacgaggactgcgcccactggaaggaggccaaaatgctcctggataacatcaatacgccggaaggcattatccctagcatgtttgagcccgaaagagagaaggtggacgctatcgatggggaatatcgcctgagaggagaggcccggaaaacattcgtcgacctcatgcgcagaggcgatcttcctgtgtggctggcgtaccgggtcgccgctgaggggattaactatgccgaccgcagatggtgttttgatggagtgaagaacaatcaaatcctggaagagaacgttgaagtggagatttggaccaaggagggcgaacggaaaaagctcaaacccagatggctggacgctcgcatctactccgatcctcttgccctgaaggagttcaaagagttcgctgccgggcggaagtctctcacactgaatctgattaccgagatgggcagactccccacgtttatgacccagaaggcgcgcaacgcccttgacaatctggctgtgctgcatacagccgaagctggaggccgggcctataaccacgccctcagcgagctgccggagacccttgaaacactgctcctgctgaccctccttgctacagtcaccgggggaatcttcctgtttctgatgtccggcaaagggattggaaagatgacgctcggcatgtgctgcatcatcacagcgagcgttctgctttggtacgcccagattcagcctcactggatcgctgcctctattatcctggagttctttctcattgtgctgctgatccccgaacccgagaaacaaagaacccctcaggataatcagctcacctatgtggtcatcgccattcttacagtggttgctgccaccatggcgaacgaaatgggcttcctggagaagaccaaaaaggactttgggctgggaggcatcgccacgcagcaaccggagtccaatattctcgatatcgacctgcggcccgctagcgcctggaccctttacgctgtggccacaaccttcattacacctatgctgcgccattccatcgaaaactctagcgtcaatgtgtccctcaccgcgatcgccaaccaggctacggtcctgatggggctgggaaagggctggcccctctctaaaatggacattggggtgcctcttctggccatcggatgttacagccaggttaatcccattaccctgacagctgccctcctgcttctggtggctcactatgccatcattggccctggcctccaggcgaaggccaccagagaggctcaaaaacgggccgctgccgggatcatgaagaacccgacagtcgatggaattaccgtgatcgacctggatcccatcccttacgaccccaaatttgaaaagcagctgggccaggttatgctccttgtgctgtgcgtcacacaggtgctgatgatgcgcacaacctgggccctctgtgaggcgctgacacttgctaccgggcctatttccaccctgtgggaaggaaatcccggcagattctggaacacaacgatcgccgtgagcatggctaatatttttcgggggtcttatctcgccggagccggcctgctgttctccatcatgaagaacaccgctaacacacgcagaggcaccgggaatacaggagagaccctcggcgagaaatggaagaaccggcttaatgccctggggaaaagcgaatttcaaatttacaagaaatctggaatccaggaggttgatcgcacgctggcgaaggaaggcatcaaaagaggggagacagaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcaccaaaggcgggcctgggcatgaagaacccattcccatgagcacatatggctggaacctggtgagactgcagtccggggtcgacgtgttctttacccctcccgaaaaatgcgatacactcctttgtgacatcggagagtctagccctaatccgacggttgaggccggccgcaccctgcgggtgctgaacctcgtcgaaaattggctgaacaataacacacaattctgcattaaggtgcttaatccctacatgccttccgttatcgagaagatggaagctctgcagagaaaatacgggggagccctcgtgcgcaaccccctgagcagaaattccacccacgagatgtattgggtctctaacgcgagcggcaacattgtgtcctctgtgaatatgatcagcagaatgctgatcaaccgctttacaatgcggcacaagaaagccacctacgaacctgatgtcgacctcgggtccggaacgagaaatattggcatcgagtctgagacccccaaccttgatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagtgaaggtcgatacccgcacacaagaacccaaagagggaacgaagaagctcatgaaaattaccgccgagtggctgtggaaggaacttggcaaaaagaaaacacctagaatgtgtacccgggaggagttcacacgcaaggtgagaagcaacgctgccctgggggcgatctttaccgacgagaataaatggaagtctgcccgggaggctgttgaagattccggattctgggagctcgtggacaaggaaagaaacctgcacctggagggcaaatgcgaaacatgtgtctataatatgatgggcaagcgggagaaaaagctcggggagtttggaaaagccaagggcagccgcgctatttggtacatgtggctgggggccagattccttgaatttgaggccctgggattcctcaacgaagatcattggttttctcgggaaaattccctgagcggcgtggaaggggagggccttcacaagctgggatacatcctccgcgacgtttccaaaaaggagggcggggcgatgtatgctgatgacaccgccggatgggatacgagaattaccctggaagacctgaaaaacgaggaaatggtgacaaatcatatggagggcgaacacaagaaactcgccgaggctatcttcaagctgacctaccagaacaaggtcgtgcgggtccagcgccccacaccgagagggaccgtgatggacattatcagccggcgcgatcagagaggatctggccaagttgtgacgtatgggcttaatacattcaccaacatggaggcccagctgatccggcagatggaaggcgagggagtctttaaaagcattcaacagctcacagctaccgaagagatcgccgtgaagaactggctggcgcgcgtgggcagagagcggctttcccgcatggccatttctggggacgattgcgttgtgaaacctctggacgatagattcgctagcgccctcacggctctgaatgacatgggaaaggtccggaaagatatccagcagtgggaaccctccagaggctggaacgactggacccaagtgcccttttgctctcatcacttccacgagctgattatgaaggatgggcgcgttctcgtggtcccttgtcggaatcaggacgaactgatcggacgggcccgcatcagccagggcgcggggtggtcccttcgggagacagcctgcctgggcaagtcttacgctcagatgtggagcctcatgtattttcatagacgcgatctgcggcttgccgctaacgccatttgttccgctgtgccgagccactgggtccccacctctagaacaacctggtccatccatgccacacacgaatggatgaccacggaggacatgctgacagtgtggaatcgcgtttggattcaagagaacccttggatcgaagataaaacccccgtggagagctgggaagagattccttacctcggaaagcgggaagaccagtggtgcggctctctgatcgggctgacctccagagcgacatgggccaaaaatatccagaccgctattaaccaggtccgcagcctcatcggaaatgaggagtatacagactacatgccctccatgaagcggttcagacgggaagaggaagaggccggcgtgctgtggtga

SEQ ID NO: 20320 - RNA, 9876 nt, synthetic construct
  misc_feature 1..9876: note = derived and/or modified CDS sequence (opt5) from DENV-2__DQ645550__SS-prME
  source 1..9876: mol_type = other RNA
accgccggagtgatcattatgatgatccccacggtggttgctttccacctgacgaccagaaatggggaacctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaatatcagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctacgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtatctttgggaggtgaagaaacaacgcgccggagttctgtgggatgtgccttctccccctcccgtcggcaaggctgaactggaggacggggcctacagaatcaagcagaaaggcattctcggctattcccagatcggcgccggggtgtacaaggaaggaacctttcacacaatgtggcatgtgacccggggcgctgttctgatgcacaaagggaagcgcattgagccctcctgggccgatgtcaaaaaggaccttatcagctacggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgagaaatccattgaggataatcctgaaatcgaggacgatattttcagaaagaaacgcctgacaatcatggacctgcatcccggggccggaaagacgaaacggtatctccctgcgattgtcagagaagctatcaagcgcggcctgcggacccttatcctggccccgacaagagtggttgccgctgagatggaagaggccctccgcgggctgcccattcggtaccagacccctgctatcagagccgagcacaccggacgcgaaattgtggatctcatgtgtcatgcgacattcacgatgcggctgcttagccccatcagagtccctaactataatctgattatcatggacgaggcccactttaccgaccccgcttccattgccgctcggggctacatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatatgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccattcctctgcggctcagcggagagggcgcgttggccggaaccctaaaaatgaaaacgatcagtacatttacatgggagagcccctggaaaatgacgaggactgcgcccactggaaggaggccaaaatgctcctggataacatcaatacgccggaaggcattatccctagcatgtttgagcccgaaagagagaaggtggacgctatcgatggggaatatcgcctgagaggagaggcccggaaaacattcgtcgacctcatgcgcagaggcgatcttcctgtgtggctggcgtaccgggtcgccgctgaggggattaactatgccgaccgcagatggtgttttgatggagtgaagaacaatcaaatcctggaagagaacgttgaagtggagatttggaccaaggagggcgaacggaaaaagctcaaacccagatggctggacgctcgcatctactccgatcctcttgccctgaaggagttcaaagagttcgctgccgggcggaagtctctcacactgaatctgattaccgagatgggcagactccccacgtttatgacccagaaggcgcgcaacgcccttgacaatctggctgtgctgcatacagccgaagctggaggccgggcctataaccacgccctcagcgagctgccggagacccttgaaacactgctcctgctgaccctccttgctacagtcaccgggggaatcttcctgtttctgatgtccggcaaagggattggaaagatgacgctcggcatgtgctgcatcatcacagcgagcgttctgctttggtacgcccagattcagcctcactggatcgctgcctctattatcctggagttctttctcattgtgctgctgatccccgaacccgagaaacaaagaacccctcaggataatcagctcacctatgtggtcatcgccattcttacagtggttgctgccaccatggcgaacgaaatgggcttcctggagaagaccaagaaggactttgggctgggaggcatcgccacgcagcaaccggagtccaatattctcgatatcgacctgcggcccgctagcgcctggaccctttacgctgtggccacaaccttcattacacctatgctgcgccattccatcgaaaactctagcgtcaatgtgtccctcaccgcgatcgccaaccaggctacggtcctgatggggctgggaaagggctggcccctctctaaaatggacattggggtgcctcttctggccatcggatgttacagccaggttaatcccattaccctgacagctgccctcctgcttctggtggctcactatgccatcattggccctggcctccaggcgaaggccaccagagaggctcaaaaacgggccgctgccgggatcatgaagaacccgacagtcgatggaattaccgtgatcgacctggatcccatcccttacgaccccaaatttgaaaagcagctgggccaggttatgctccttgtgctgtgcgtcacacaggtgctgatgatgcgcacaacctgggccctctgtgaggcgctgacacttgctaccgggcctatttccaccctgtgggaaggaaatcccggcagactctggaacacaacgatcgccgtgagcatggctaatattttccgggggtcttatctggccggagccggcctgctcttttccatcatgaagaacaccgctaacacacgcagaggcaccgggaatacaggagagacccttggcgagaaatggaagaaccggctgaatgccctggggaaaagcgagttccaaatttacaagaaatctggaatccaggaggttgatcgcacgctcgcgaaggaaggcatcaaaagaggggagacagaccatcacgccgtctcccggggaagcgctaagctgagatggtttgtggagcgcaaccttgtgaccccggaaggcaaggtcatggatctgggctgcgggcggggaggctggtcttattactgtgggggactcaaaaatgttaaggaggtgaaaggcctgaccaaaggcgggcctgggcatgaagaacccattcccatgagcacatatggctggaacctggtgagactccagtccggggtcgacgtgttcttcacccctcccgaaaaatgcgatacacttctgtgtgacatcggagagtctagccctaatccgacggttgaggccggccgcaccctgcgggtgctcaacctggtcgaaaattggcttaacaataacacacaattttgcattaaggtgctgaatccctacatgccttccgttatcgagaagatggaagctctccagagaaaatacgggggagccctggtgcgcaaccccctgagcagaaattccacccacgagatgtattgggtctctaacgcgagcggcaacattgtgtcctctgtgaatatgatcagcagaatgctcatcaaccgcttcacaatgcggcacaagaaagccacctacgaacctgatgtcgaccttgggtccggaacgagaaatattggcatcgagtctgagacccccaacctggatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctcacaaagccttgggatgtcatccccatggtgacccagatggctatgacggacacaaccccttttgggcagcagagagttttcaaagtgaaggtcgatacccgcacacaagaacccaaagagggaacgaagaagctgatgaaaattaccgccgagtggctttggaaggaactgggcaaaaagaaaacacctagaatgtgtacccgggaggaatttacacgcaaggtgagaagcaacgctgccctcggggcgatcttcaccgacgagaataaatggaagtctgcccgggaggctgttgaagattccggattttgggagctggtggacaaggaaagaaacctgcacctcgagggcaaatgcgaaacatgtgtctataatatgatgggcaagcgggagaaaaagctgggggagttcggaaaagccaagggcagccgcgctatttggtacatgtggcttggggccagatttctggagttcgaggccctcggatttctgaacgaagatcattggttctctcgggaaaattcccttagcggcgtggaaggggagggcctgcacaagctcggatacatcctgcgcgacgtttccaaaaaggagggcggggcgatgtatgctgatgacaccgccggatgggatacgagaattaccctggaagacctcaaaaacgaggaaatggtgacaaatcatatggagggcgaacacaagaaactggccgaggctatctttaaacttacctaccagaacaaggtcgtgcgggtccagcgccccacaccgagagggaccgtgatggacattatcagccggcgcgatcagagaggatctggccaagttgtgacgtatgggctgaatacattcaccaacatggaggcccagctcatccggcagatggaaggcgagggagtcttcaaaagcattcaacagctgacagctaccgaagagatcgccgtgaagaactggcttgcgcgcgtgggcagagagcggctgtcccgcatggccatttctggggacgattgcgttgtgaaacctctcgacgatagatttgctagcgccctgacggctctgaatgacatgggaaaggtccggaaagatatccagcagtgggaaccctccagaggctggaacgactggacccaagtgcccttctgctctcatcactttcacgagctcattatgaaggatgggcgcgttctggtggtcccttgtcggaatcaggacgaacttatcggacgggcccgcatcagccagggcgcggggtggtccctgcgggagacagcctgcctcggcaagtcttacgctcagatgtggagcctgatgtatttccatagacgcgatcttcggctggccgctaacgccatttgttccgctgtgccgagccactgggtccccacctctagaacaacctggtccatccatgccacacacgaatggatgaccacggaggacatgctcacagtgtggaatcgcgtttggattcaagagaacccttggatcgaagataaaacccccgtggagagctgggaagagattccttacctgggaaagcgggaagaccagtggtgcggctctctgatcgggctcacctccagagcgacatgggccaaaaatatccagaccgctattaaccaggtccgcagcctgatcggaaatgaggagtatacagactacatgccctccatgaagcggtttagacgggaagaggaagaggccggcgtgctttggtga

SEQ ID NO: 20321 - RNA, 9876 nt, synthetic construct
  misc_feature 1..9876: note = derived and/or modified CDS sequence (opt5) from DENV-2__DQ645551__SS-prME
  source 1..9876: mol_type = other RNA
accgccggagtgatcattatgatgatccccaccgtggttgctttccacctgacgaccagaaatggggagcctcatatgattgtgagccggcaggaaaagggaaaatccctcctgtttaagacggagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaatatcagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctacgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtatctttgggaggtgaagaaacaacgcgccggagttctgtgggatgtgccttctccccctcccgtcggcaaggctgaactggaggacggggcctacagaatcaagcagaaaggcattctcggctattcccagatcggcgccggggtgtacaaggaaggaacctttcacacaatgtggcatgtgacccggggcgctgttctgatgcacaaagggaagcgcattgagccctcctgggccgatgtcaaaaaggaccttatcagctacggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgagaaatccattgaggataatcctgaaatcgaggacgatattttcagaaagaaacgcctgacaatcatggacctgcatcccggggccggaaagacgaaacggtatctccctgcgattgtcagagaagctatcaagcgcggcctgcggacccttatcctggccccgacaagagtggttgccgctgagatggaagaggccctccgcgggctgcccattcggtaccagacccctgctatcagagccgagcacaccggacgcgaaattgtggatctcatgtgtcatgcgacattcacgatgcggctgcttagccccatcagagtccctaactataatctgattatcatggacgaggcccactttaccgaccccgcttccattgccgctcggggctacatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatatgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccattcctctgcggctcagcggagagggcgcgttggccggaaccctaaaaatgaaaacgatcagtacatttacatgggagagcccctggaaaatgacgaggactgcgcccactggaaggaggccaaaatgctcctggataacatcaatacgccggaaggcattatccctagcatgtttgagcccgaaagagagaaggtggacgctatcgatggggaatatcgcctgagaggagaggcccggaaaacattcgtcgacctcatgcgcagaggcgatcttcctgtgtggctggcgtaccgggtcgccgctgaggggattaactataccgaccgcagatggtgttttgatggagtgaagaacaatcaaatcctggaagagaacgttgaagtggagatttggacaaaggagggcgaacggaaaaagctcaaacccagatggctggacgcccgcatctactccgatcctcttgctctgaaggagttcaaagagttcgccgctgggcggaagtctctcaccctgaatctgattacggagatgggcagactccccacctttatgacacagaaggcccgcaacgcgcttgacaatctggccgtgctgcataccgctgaagccggaggccgggcttataaccacgccctcagcgagctgccggagacacttgaaaccctgctcctgctgacactccttgccaccgtcacaggcgggatcttcctgtttctgatgtccgggaaagggattggaaagatgacactcggcatgtgctgcatcatcaccgctagcgttctgctttggtacgcgcagattcagcctcactggatcgccgcttctattatcctggagttctttctcattgtgctgctgatccccgaacccgagaaacaaagaacccctcaggataatcagctcacatatgtggtcatcgccattcttaccgtggttgccgctacaatggccaacgaaatgggcttcctggagaagacgaaaaaggactttgggctgggaggcatcgcgacccagcaaccggagtccaatattctcgatatcgacctgcggcccgccagcgcttggacactttacgccgtggctaccacattcattacccctatgctgcgccattccatcgaaaactctagcgtcaatgtgtccctcacggccatcgcgaaccaggccaccgtcctgatggggctgggaaagggctggcccctctctaaaatggacattggggtgcctcttctggctatcggatgttacagccaggttaatcccattacactgaccgccgctctcctgcttctggtggcccactatgctatcattggccctggcctccaggccaaggcgacaagagaggcccaaaaacgggctgccgctgggatcatgaagaacccgaccgtcgatggaattacggtgatcgacctggatcccatcccttacgaccccaaatttgaaaagcagctgggccaggttatgctccttgtgctgtgcgtcacacaggtgctgatgatgcgcaccacatgggccctctgtgaggccctgacccttgcgaccgggcctatttccacactgtgggaaggaaatcccggcagattctggaacacgaccatcgctgtgagcatggccaatatttttcgggggtcttatctcgctggagccggcctgctgttctccatcatgaagaacacagccaacacccgcagaggcacagggaataccggagagacgctcggcgagaaatggaagaaccggcttaatgctctggggaaaagcgaatttcaaatttacaagaaatctggaatccaggaggttgatcgcacactggccaaggaaggcatcaaaagaggggagaccgaccatcacgcggtctcccggggaagcgccaagctcagatggttcgtggagcgcaacctggtgaccccggaaggcaaggtcatggatcttggctgcgggcggggaggctggtcttattactgtgggggactgaaaaatgttaaggaggtgaaaggcctcacaaaagggggacctggccatgaagaacccattcccatgagcacctatggctggaacctggtgagactgcagtccggggtcgacgtgttctttacacctcccgaaaaatgcgatacgctcctttgtgacatcggagagtctagccctaatccgaccgttgaggctggccgcacactgcgggtgctgaacctcgtcgaaaattggctgaacaataacacccaattctgcattaaggtgcttaatccctacatgccttccgttatcgagaagatggaagccctgcagagaaaatacgggggagctctcgtgcgcaaccccctgagcagaaattccacacacgagatgtattgggtctctaacgccagcggcaacattgtgtcctctgtgaatatgatcagcagaatgctgatcaaccgctttaccatgcggcacaagaaagcgacgtacgaacctgatgtcgacctcgggtccggaaccagaaatattggcatcgagtctgagacacccaaccttgatattatcggcaagcgcattgagaaaatcaagcaggagcatgaaaccagctggcactatgaccaggaccatccgtacaagacatgggcctatcacgggtcctacgagaccaaacaaacaggaagcgcttcttccatggttaatggcgtggtgcggctgctgaccaagccttgggatgtcatccccatggtgacgcagatggccatgacagacaccacccctttcgggcagcagagagtttttaaagaaaaggtggatacacgcacgcaagagcccaaagagggaaccaagaagctcatgaaaattacagctgaatggctgtggaaggagcttggcaaaaagaaaacccctagaatgtgtacacgggaagagttcacccgcaaggtcagaagcaacgccgctctgggggccatctttacagacgagaataaatggaagtctgcgcgggaagccgtggaggattccggattctgggaactcgttgacaaggagagaaacctgcacctggaaggcaaatgcgagacctgtgtgtataatatgatgggcaagcgggagaaaaagctcggggaatttggaaaagctaagggcagccgcgccatttggtacatgtggctgggggctagattccttgagtttgaagccctgggattcctcaacgaggatcattggttttctcgggaaaattccctgagcggcgtcgagggggagggccttcacaagctgggatacatcctccgcgacgtgtccaaaaaggaaggcggggccatgtatgcggatgacacggctggatgggataccagaattacactggaggacctgaaaaacgaagagatggttaccaatcatatggaaggcgagcacaagaaactcgccgaggccatcttcaagctgacataccagaacaaggtggtccgggtgcagcgccccaccccgagagggacggtcatggacattatcagccggcgcgatcagagaggatctggccaagtggttacatatgggcttaataccttcacaaacatggaagctcagctgatccggcagatggagggcgaaggagtgtttaaaagcattcaacagctcaccgccacggaggagatcgctgtcaagaactggctggcccgcgtgggcagagaacggctttcccgcatggcgatttctggggacgattgcgtggttaaacctctggacgatagattcgccagcgctctcaccgccctgaatgacatgggaaaggtgcggaaagatatccagcagtgggagccctccagaggctggaacgactggacacaagtccccttttgctctcatcacttccacgaactgattatgaaggatgggcgcgtgctcgttgtgccttgtcggaatcaggacgagctgatcggacgggctcgcatcagccagggcgccgggtggtcccttcgggaaaccgcgtgcctgggcaagtcttacgcccagatgtggagcctcatgtattttcatagacgcgatctgcggcttgctgccaacgctatttgttccgccgtcccgagccactgggtgcccacatctagaaccacatggtccatccatgctacccacgagtggatgacgacagaggacatgctgaccgtctggaatcgcgtgtggattcaagaaaacccttggatcgaggataaaacccccgttgaaagctgggaggaaattccttacctcggaaagcgggaggaccagtggtgcggctctctgatcgggctgacatccagagccacctgggcgaaaaatatccagacagccattaaccaggtgcgcagcctcatcggaaatgaggaatatacggactacatgccctccatgaagcggttcagacgggaggaagaggaagctggcgtcctgtggtga

SEQ ID NO: 20322 - RNA, 9876 nt, synthetic construct
  misc_feature 1..9876: note = derived and/or modified CDS sequence (opt5) from DENV-2__DQ645552__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaatatcagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctacgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtatctttgggaggtgaagaaacaacgcgccggagttctgtgggatgtgccttctccccctcccgtcggcaaggctgaactggaggacggggcctacagaatcaagcagaaaggcattctcggctattcccagatcggcgccggggtgtacaaggaaggaacctttcacacaatgtggcatgtgacccggggcgctgttctgatgcacaaagggaagcgcattgagccctcctgggccgatgtcaaaaaggaccttatcagctacggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgagaaatccattgaggataatcctgaaatcgaggacgatattttcagaaagaaacgcctgacaatcatggacctgcatcccggggccggaaagacgaaacggtatctccctgcgattgtcagagaagctatcaagcgcggcctgcggacccttatcctggccccgacaagagtggttgccgctgagatggaagaggccctccgcgggctgcccattcggtaccagacccctgctatcagagccgagcacaccggacgcgaaattgtggatctcatgtgtcatgcgacattcacgatgcggctgcttagccccatcagagtccctaactataatctgattatcatggacgaggcccactttaccgaccccgcttccattgccgctcggggctacatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatatgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccattcctctgcggctcagcggagagggcgcgttggccggaaccctaaaaatgaaaacgatcagtacatttacatgggagagcccctggaaaatgacgaggactgcgcccactggaaggaggccaaaatgctcctggataacatcaatacgccggaaggcattatccctagcatgtttgagcccgaaagagagaaggtggacgctatcgatggggaatatcgcctgagaggagaggcccggaaaacattcgtcgacctcatgcgcagaggcgatcttcctgtgtggctggcgtaccgggtcgccgctgaggggattaactatgccgaccgcagatggtgttttgatggagtgaagaacaatcaaatcctggaagagaacgttgaagtggagatttggaccaaggagggcgaacggaaaaagctcaaacccagatggctggacgctcgcatctactccgatcctcttgccctgaaggagttcaaagagttcgctgccgggcggaagtctctcacactgaatctgattaccgagatgggcagactccccacgtttatgacccagaaggcgcgcaacgcccttgacaatctggctgtgctgcatacagccgaagctggaggccgggcctataaccacgccctcagcgagctgccggagacccttgaaacactgctcctgctgaccctccttgctacagtcaccgggggaatcttcctgtttctgatgtccggcaaagggattggaaagatgacgctcggcatgtgctgcatcatcacagcgagcgttctgctttggtacgcccagattcagcctcactggatcgctgcctctattatcctggagttctttctcattgtgctgctgatccccgaacccgagaaacaaagaacccctcaggataatcagctcacctatgtggtcatcgccattcttacagtggttgctgccaccatggcgaacgaaatgggcttcctggagaagaccaaaaaggactttgggctgggaggcatcgccacgcagcaaccggagtccaatattctcgatatcgacctgcggcccgctagcgcctggaccctttacgctgtggccacaaccttcattacacctatgctgcgccattccatcgaaaactctagcgtcaatgtgtccctcaccgcgatcgccaaccaggctacggtcctgatggggctgggaaagggctggcccctctctaaaatggacattggggtgcctcttctggccatcggatgttacagccaggttaatcccattaccctgacagctgccctcctgcttctggtggctcactatgccatcattggccctggcctccaggcgaaggccaccagagaggctcaaaaacgggccgctgccgggatcatgaagaacccgacagtcgatggaattaccgtgatcgacctggatcccatcccttacgaccccaaatttgaaaagcagctgggccaggttatgctccttgtgctgtgcgtcacacaggtgctgatgatgcgcacaacctgggccctctgtgaggcgctgacacttgctaccgggcctatttccaccctgtgggaaggaaatcccggcagattctggaacacaacgatcgccgtgagcatggctaatatttttcgggggtcttatctcgccggagccggcctgctgttctccatcatgaagaacaccgctaacacacgcagaggcaccgggaatacaggagagaccctcggcgagaaatggaagaaccggcttaatgccctggggaaaagcgaatttcaaatttacaagaaatctggaatccaggaggttgatcgcacgctggcgaaggaaggcatcaaaagaggggagacagaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcaccaaaggcgggcctgggcatgaagaacccattcccatgagcacatatggctggaacctggtgagactgcagtccggggtcgacgtgttctttacccctcccgaaaaatgcgatacactcctttgtgacatcggagagtctagccctaatccgacggttgaggccggccgcaccctgcgggtgctgaacctcgtcgaaaattggctgaacaataacacacaattctgcattaaggtgcttaatccctacatgccttccgttatcgagaagatggaagctctgcagagaaaatacgggggagccctcgtgcgcaaccccctgagcagaaattccacccacgagatgtattgggtctctaacgcgagcggcaacattgtgtcctctgtgaatatgatcagcagaatgctgatcaaccgctttacaatgcggcacaagaaagccacctacgaacctgatgtcgacctcgggtccggaacgagaaatattggcatcgagtctgagacccccaaccttgatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagaaaaggtggatacccgcacacaagagcccaaagagggaacgaagaagctcatgaaaattaccgccgaatggctgtggaaggagcttggcaaaaagaaaacacctagaatgtgtacccgggaagagttcacacgcaaggtcagaagcaacgctgccctgggggcgatctttaccgacgagaataaatggaagtctgcccgggaagctgtggaggattccggattctgggaactcgttgacaaggagagaaacctgcacctggaaggcaaatgcgagacatgtgtgtataatatgatgggcaagcgggagaaaaagctcggggaatttggaaaagccaagggcagccgcgctatttggtacatgtggctgggggccagattccttgagtttgaagccctgggattcctcaacgaggatcattggttttctcgggaaaattccctgagcggcgtcgagggggagggccttcacaagctgggatacatcctccgcgacgtgtccaaaaaggaaggcggggcgatgtatgctgatgacaccgccggatgggatacgagaattaccctggaggacctgaaaaacgaagagatggttacaaatcatatggaaggcgagcacaagaaactcgccgaggctatcttcaagctgacctaccagaacaaggtggtccgggtgcagcgccccacaagcagagggaccgtcatggacattatctctcggcgcgatcagagaggaagcggccaagtggttacgtatgggcttaatacattcaccaacatggaagcccagctgatccggcagatggagggcgaaggagtgtttaaatccattcaacagctcacagctaccgaggagatcgccgtcaagaactggctggcgcgcgtgggcagagaacggctttctcgcatggccattagcggggacgattgcgtggttaaaccgctggacgatagattcgcttccgccctcacggctctgaatgacatgggaaaggtgcggaaagatatccagcagtgggagccttctagaggctggaacgactggacccaagtccccttttgcagccatcacttccacgaactgattatgaaggatgggcgcgtgctcgttgtgccctgtcggaatcaggacgagctgatcggacgggcccgcatctcccagggcgcggggtggtctcttcgggaaacagcctgcctgggcaagagctacgctcagatgtggtccctcatgtattttcatagacgcgatctgcggcttgccgctaacgccatttgtagcgctgtcccttctcactgggtgccgacctccagaacaacctggagcatccatgccacacacgagtggatgaccacggaggacatgctgacagtctggaatcgcgtgtggattcaagaaaacccctggatcgaggataaaacccctgttgaatcttgggaggaaattccctacctcggaaagcgggaggaccagtggtgcggctccctgatcgggctgaccagcagagcgacatgggccaaaaatatccagaccgctattaaccaggtgcgctccctcatcggaaatgaggaatatacagactacatgccttctatgaagcggttcagacgggaggaagaggaagccggcgtcctgtggtga

SEQ ID NO: 20323 - RNA, 9876 nt, synthetic construct
  misc_feature 1..9876: note = derived and/or modified CDS sequence (opt5) from DENV-2__DQ645553__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagaccgagaatggcgtgaatatgtgcacccttatggccatggacctgggggaactctgtgaggatacaatcacctacaattgccccctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccctgggggagtttttacctctattggcaaagcccttcatcaagtcttcggggcgatctatggcgctgcctttagcggagtgtcctggacgatgaagatcctgattggcgtggtcatcacatggattgggatgaacagccggtctacctccctcagcgtgtctctggttctggtgggagtcgtgaccctttacctcggcgttatggtgcaggccgattccgggtgtgtcgtgagctggaaaaataaggagctgaaatgcggatccggcatcttcattacagacaacgttcacacctggacagaacagtataagtttcagcccgagtctccgagcaagctggcttccgccatccaaaaagctcacgaagaggggatctgtggcattagatctgtgacgcgcctcgaaaatctgatgtggaagcagatcacccctgagcttaaccatattctgagcgagaatgaagtcaaactcacaatcatgaccggagatattaagggcatcatgcaggccgggaaacggtccctgagaccccagcctacagagctgaagtacagctggaaagcgtggggaaaggccaagatgctttctaccgaactccacaaccatacgttcctgatcgacggccccgagaccgctgaatgccctaatacaaaccgcgcctggaactccctggaggtggaggattatgggtttggagtgttcaccacaaacatttggctcaaactgaaggaacggcaagacgtcttttgtgacagcaaacttatgtctgctgccatcaaggataatagagcggttcacgccgacatgggctactggattgagtccgctctgaacgatacctggaaaatcgaaaaggccagcttcattgaggtgaagtcttgccactggcccaaaagccatacactctggtccaacggcgtgctggagagcgaaatgatcatcccgaagaatttcgctgggcctgtctctcagcacaactatcgccccggataccatacccagacggccggcccctggcacctggggaaacttgagatggactttgatttctgtgaaggaacaaccgtggttgtgaccgaggactgcggcaatcgggggccttccctcagaacaaccacggccagcggaaagctgattacagaatggtgctgtcggtcctgcaccctgccgcccctccgctacagaggcgaggatggctgttggtatgggatggagatccggcctctgaaagaaaaggaggaaaaccttgtcaattctctggtgacagctggacatggccagattgacaactttagcctcggggttctgggaatggcgctgttccttgaggaaatgctcagaacccgcgtgggcacaaagcacgccatcctgctggtcgctgtgtcctttgttaccctcattacggggaatatgtctttccgggatctgggaagagtgatggtcatggtgggcgccaccatgacagacgatatcggcatgggggtgacctaccttgccctgctcgctgcctttaaagtccgccccacattcgcggctggactgctgcttagaaagctgaccagcaaagagctcatgatgacgacaattggcatcgttctgctctcccaatctaccatccctgagacaattctggaacttaccgacgccctggccctcgggatgatggtgctgaagatcgtgcggaacatggagaaatatcagctggctgtcaccattatggccatcctttgcgtgcccaatgcggttattctgcagaacgcttggaaggtgagctgtacaatcctcgccgtcgtgtccgttagccctctgctcctgacgtcttcccaacagaaggccgattggatcccccttgctctgaccattaaaggactcaatccgacagccatctttctgaccacactgagccgcacctctaagaaaagatcctggcctcttaacgaagctattatggccgtgggcatggtcagcatcctggcgtcttccctcctgaagaatgacattcccatgacggggcctctcgtggccggaggcctgcttacagtctgctacgtgctgaccggccggagcgctgacctggagctcgaacgcgccgctgatgttagatgggaggagcaggccgaaatctccgggagctctcccatcctgagcattaccatctccgaggacggatctatgagcattaaaaacgaagaggaggaacagacacttaccatcctgattcggacaggcctcctggtgatctccggactcttcccggtctctattcctatcacggccgctgcgtggtatctgtgggaggtgaagaaacaacgcgccggagttctttgggatgtgcccagccctccgcccgtcggcaaggctgaactggaggacggggcctacagaatcaagcagaaaggcattctgggctattcccagatcggcgccggggtgtacaaggaaggaacctttcacacaatgtggcatgtgacccggggcgctgttctcatgcacaaagggaagcgcattgagccttcttgggccgatgtcaaaaaggacctgatcagctacggaggcgggtggaaacttgagggagaatggaaagagggcgaagaggtccaggtgctggcgctcgaaccgggcaagaatcccagagctgtccaaacaaaacctgggctgttcaagaccaacacgggaaccattggcgccgtgtccctcgattttagccccgggacatctggatcccctatcgttgacaaaaagggcaaggtggtcgggctgtatggaaacggcgtggttacccggagcggcacatacgtgtctgccatcgctcagaccgagaaatccattgaggataatcccgaaatcgaggacgatattttcagaaagaaacgccttacaatcatggacctgcatcctggggccggaaagacgaaacggtatctgccggcgattgtcagagaagctatcaagcgcggcctccggaccctgatccttgcccccacaagagtggttgccgctgagatggaagaggccctgcgcgggctccctattcggtaccagacccccgctatcagagccgagcacaccggacgcgaaattgtggatctgatgtgtcatgcgacattcacgatgcggctcctgagccctatcagagtccccaactataatcttattatcatggacgaggcccactttaccgacccggcttccattgccgctcggggctacatctctacacgcgtggaaatgggggaggccgccggcatcttcatgaccgctacacctcccggaagcagagatccctttcctcagtccaacgcgcccattatggacgaggaacgggagatccctgaacgcagctggaactctggccacgagtgggtgaccgatttcaaggggaaaacggtctggtttgttccgtccattaaggccggaaacgacatcgctgcctgcctgcgcaagaatggcaagaaagtgattcaactgagccggaagacattcgattctgaatatgtgaagaccagaaccaacgactgggattttgtcgtgacaaccgacatcagcgagatgggggccaatttcaaagctgagcgcgttatcgatccccggagatgtatgaagcctgtgattctcacagacggagaagaaagagtcatcctggccggccccatgcctgtgacccattcctctgcggctcagcggagagggcgcgttggccggaaccccaaaaatgaaaacgatcagtacatttacatgggagagccgcttgaaaatgacgaggactgcgcccactggaaggaggccaaaatgctgctcgataacatcaatacgcctgaaggcattatccccagcatgtttgagcctgaaagagagaaggtggacgctatcgatggggaatatcgcctgagaggagaggcccggaaaacattcgtcgacctgatgcgcagaggcgatctccccgtgtggcttgcgtaccgggtcgccgctgaggggattaactatgccgaccgcagatggtgttttgatggagtgaagaacaatcaaatcctggaagagaacgttgaagtggagatttggaccaaggagggcgaacggaaaaagctgaaacctagatggctcgacgctcgcatctactccgatcccctggcccttaaggagttcaaagagttcgctgccgggcggaagtctctgacactcaatctgattaccgagatgggcagactgccgacgtttatgacccagaaggcgcgcaacgccctcgacaatcttgctgtgctgcatacagccgaagctggaggccgggcctataaccacgccctgagcgagctccctgagaccctggaaacacttctgctcctgaccctgctcgctacagtcaccgggggaatcttcctttttctgatgtccggcaaagggattggaaagatgacgctgggcatgtgctgcatcatcacagcgagcgttctcctgtggtacgcccagattcagccccactggatcgctgcctctattatccttgagttctttctgattgtgctcctgatccccgaacctgagaaacaaagaaccccgcaggataatcagctgacctatgtggtcatcgccattctcacagtggttgctgccaccatggcgaacgaaatgggcttccttgagaagaccaagaaggactttgggctgggaggcatcgccacgcagcaacccgagtccaatattctggatatcgacctccggcctgctagcgcctggaccctgtacgctgtggccacaaccttcattacacccatgcttcgccattccatcgaaaactctagcgtcaatgtgtccctgaccgcgatcgccaaccaggctacggtcctcatggggctgggaaagggctggcctctgtctaaaatggacattggggtgcccctccttgccatcggatgttacagccaggttaatcctattaccctgacagctgccctgctcctgcttgtggctcactatgccatcattggcccgggcctgcaggcgaaggccaccagagaggctcaaaaacgggccgctgccgggatcatgaagaaccccacagtcgatggaattaccgtgatcgacctcgatcctatcccctacgaccctaaatttgaaaagcagctgggccaggttatgctgctcgtgctttgcgtcacacaggtgctgatgatgcgcacaacctgggccctgtgtgaggcgctcacactggctaccgggcccatttccaccctttgggaaggaaatccgggcagattctggaacacaacgatcgccgtgagcatggctaatatttttcgggggtcttatctggccggagccggcctcctgttctccatcatgaagaacaccgctaacacacgcagaggcaccgggaatacaggagagaccctgggcgagaaatggaagaaccggctcaatgcccttgggaaaagcgaatttcaaatttacaagaaatctggaatccaggaggttgatcgcacgctggcgaaggaaggcatcaaaagaggggagacagaccatcacgccgtctcccggggaagcgctaagctgagatggttcgtggagcgcaacctcgtgacccctgaaggcaaggtcatggatctgggctgcgggcggggaggctggtcttattactgtgggggacttaaaaatgttaaggaggtgaaaggcctgaccaaaggcgggcccgggcatgaagaacccattcctatgagcacatatggctggaacctcgtgagactgcagtccggggtcgacgtgttctttacaccccctgaaaaatgcgatacactgctctgtgacatcggagagtctagcccgaatcccacggttgaggccggccgcacccttcgggtgctgaacctggtcgaaaattggctcaacaataacacacaattctgcattaaggtgctgaatccttacatgccctccgttatcgagaagatggaagcccttcagagaaaatacgggggagccctggtgcgcaaccctctcagcagaaattccacccacgagatgtattgggtctctaacgcgagcggcaacattgtgtcctctgtgaatatgatcagcagaatgctgatcaaccgctttacaatgcggcacaagaaagccacctacgaacccgatgtcgacctggggtccggaacgagaaatattggcatcgagtctgagaccccgaacctcgatattatcggcaagcgcattgagaagatcaagcaggagcatgaaacaagctggcactatgaccaggaccatccttacaagacctgggcttatcacgggtcctacgagacaaaacaaaccggaagcgcctcttccatggttaatggcgtggtgcggcttctgacaaagccctgggatgtcatccctatggtgacccagatggctatgacggacacaacccccttcgggcagcagagagtttttaaagaaaaggtggatacccgcacacaagagcctaaagagggaacgaagaagctgatgaaaattaccgccgaatggctctggaaggagctgggcaaaaagaaaacacccagaatgtgtacccgggaagagttcacacgcaaggtcagaagcaacgctgcccttggggcgatctttaccgacgagaataaatggaagtctgcccgggaagctgtggaggattccggattctgggaactggttgacaaggagagaaacctccacctggaaggcaaatgcgagacatgtgtgtataatatgatgggcaagcgggagaaaaagctgggggaatttggaaaagccaagggcagccgcgctatttggtacatgtggctcggggccagattcctggagtttgaagcccttggattcctgaacgaggatcattggttttctcgggaaaattccctcagcggcgtcgagggggagggcctgcacaaacttggatacatcctgcgcgacgtgtccaaaaaggaaggcggggcgatgtatgctgatgacaccgccggatgggatacgagaattaccctcgaggacctgaaaaacgaagagatggttacaaatcatatggaaggcgagcacaagaaactggccgaggctatcttcaagctcacctaccagaacaaggtggtccgggtgcagcgcccgacacctagagggaccgtcatggacattatcagccggcgcgatcagagaggatctggccaagtggttacgtatgggctgaatacattcaccaacatggaagcccagcttatccggcagatggagggcgaaggagtgtttaaaagcattcaacagctgacagctaccgaggagatcgccgtcaagaactggctcgcgcgcgtgggcagagaacggctgtcccgcatggccatttctggggacgattgcgtggttaaaccccttgacgatagattcgctagcgccctgacggctctcaatgacatgggaaaggtgcggaaagatatccagcagtgggagccctccagaggctggaacgactggacccaagtccctttttgctctcatcacttccacgaactgattatgaaggatgggcgcgtgctggttgtgccgtgtcggaatcaggacgagctcatcggacgggctcgcatcagccagggcgcggggtggtccctgcgggaaacagcctgccttggcaagtcttacgctcagatgtggagcctgatgtattttcatagacgcgatctccggctggccgctaacgccatttgttccgctgtccccagccactgggtgcctacctctagaacaacctggtccatccatgccacacacgagtggatgaccacggaggacatgcttgcggtctggaatcgcgtgtggattcaagaaaacccctggatcgaggataaaacacctgttgaaagctgggaggaaattccctacctgggaaagcgggaggaccagtggtgcggctctctcatcgggctgacctccagagccacctgggctaaaaatatccagacagccattaaccaggtgcgcagcctgatcggaaatgaggaatataccgactacatgccttccatgaagcggttcagacgggaggaagaggaagccggcgtcctctggtga

SEQ ID NO: 20324 - RNA, 9876 nt, synthetic construct
  misc_feature 1..9876: note = derived and/or modified CDS sequence (opt5) from DENV-2__DQ645554__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaatatcagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctacgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtatctttgggaggtgaagaaacaacgcgccggagttctgtgggatgtgccttctccccctcccgtcggcaaggctgaactggaggacggggcctacagaatcaagcagaaaggcattctcggctattcccagatcggcgccggggtgtacaaggaaggaacctttcacacaatgtggcatgtgacccggggcgctgttctgatgcacaaagggaagcgcattgagccctcctgggccgatgtcaaaaaggaccttatcagctacggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgagaaatccattgaggataatcctgaaatcgaggacgatattttcagaaagaaacgcctgacaatcatggacctgcatcccggggccggaaagacgaaacggtatctccctgcgattgtcagagaagctatcaagcgcggcctgcggacccttatcctggccccgacaagagtggttgccgctgagatggaagaggccctccgcgggctgcccattcggtaccagacccctgctatcagagccgagcacaccggacgcgaaattgtggatctcatgtgtcatgcgacattcacgatgcggctgcttagccccatcagagtccctaactataatctgattatcatggacgaggcccactttaccgaccccgcttccattgccgctcggggctacatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatatgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccattcctctgcggctcagcggagagggcgcgttggccggaaccctaaaaatgaaaacgatcagtacatttacatgggagagcccctggaaaatgacgaggactgcgcccactggaaggaggccaaaatgctcctggataacatcaatacgccggaaggcattatccctagcatgtttgagcccgaaagagagaaggtggacgctatcgatggggaatatcgcctgagaggagaggcccggaaaacattcgtcgacctcatgcgcagaggcgatcttcctgtgtggctggcgtaccgggtcgccgctgaggggattaactatgccgaccgcagatggtgttttgatggagtgaagaacaatcaaatcctggaagagaacgttgaagtggagatttggaccaaggagggcgaacggaaaaagctcaaacccagatggctggacgctcgcatctactccgatcctcttgccctgaaggagttcaaagagttcgctgccgggcggaagtctctcacactgaatctgattaccgagatgggcagactccccacgtttatgacccagaaggcgcgcaacgcccttgacaatctggctgtgctgcatacagccgaagctggaggccgggcctataaccacgccctcagcgagctgccggagacccttgaaacactgctcctgctgaccctccttgctacagtcaccgggggaatcttcctgtttctgatgtccggcaaagggattggaaagatgacgctcggcatgtgctgcatcatcacagcgagcgttctgctttggtacgcccagattcagcctcactggatcgctgcctctattatcctggagttctttctcattgtgctgctgatccccgaacccgagaaacaaagaacccctcaggataatcagctcacctatgtggtcatcgccattcttacagtggttgctgccaccatggcgaacgaaatgggcttcctggagaagaccaaaaaggactttgggctgggaggcatcgccacgcagcaaccggagtccaatattctcgatatcgacctgcggcccgctagcgcctggaccctttacgctgtggccacaaccttcattacacctatgctgcgccattccatcgaaaactctagcgtcaatgtgtccctcaccgcgatcgccaaccaggctacggtcctgatggggctgggaaagggctggcccctctctaaaatggacattggggtgcctcttctggccatcggatgttacagccaggttaatcccattaccctgacagctgccctcctgcttctggtggctcactatgccatcattggccctggcctccaggcgaaggccaccagagaggctcaaaaacgggccgctgccgggatcatgaagaacccgacagtcgatggaattaccgtgatcgacctggatcccatcccttacgaccccaaatttgaaaagcagctgggccaggttatgctccttgtgctgtgcgtcacacaggtgctgatgatgcgcacaacctgggccctctgtgaggcgctgacacttgctaccgggcctatttccaccctgtgggaaggaaatcccggcagattctggaacacaacgatcgccgtgagcatggctaatatttttcgggggtcttatctcgccggagccggcctgctgttctccatcatgaagaacaccgctaacacacgcagaggcaccgggaatacaggagagaccctcggcgagaaatggaagaaccggcttaatgccctggggaaaagcgaatttcaaatttacaagaaatctggaatccaggaggttgatcgcacgctggcgaaggaaggcatcaaaagaggggagacagaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcaccaaaggcgggcctgggcatgaagaacccattcccatgagcacatatggctggaacctggtgagactgcagtccggggtcgacgtgttctttacccctcccgaaaaatgcgatacactcctttgtgacatcggagagtctagccctaatccgacggttgaggccggccgcaccctgcgggtgctgaacctcgtcgaaaattggctgaacaataacacacaattctgcattaaggtgcttaatccctacatgccttccgttatcgagaagatggaagctctgcagagaaaatacgggggagccctcgtgcgcaaccccctgagcagaaattccacccacgagatgtattgggtctctaacgcgagcggcaacattgtgtcctctgtgaatatgatcagcagaatgctgatcaaccgctttacaatgcggcacaagaaagccacctacgaacctgatgtcgacctcgggtccggaacgagaaatattggcatcgagtctgagacccccaaccttgatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagaaaaggtggatacccgcacacaagagcccaaagagggaacgaagaagctcatgaaaattaccgccgaatggctgtggaaggagcttggcaaaaagaaaacacctagaatgtgtacccgggaagagttcacacgcaaggtcagaagcaacgctgccctgggggcgatctttaccgacgagaataaatggaagtctgcccgggaagctgtggaggattccggattctgggaactcgttgacaaggagagaaacctgcacctggaaggcaaatgcgagacatgtgtgtataatatgatgggcaagcgggagaaaaagctcggggaatttggaaaagccaagggcagccgcgctatttggtacatgtggctgggggccagattccttgagtttgaagccctgggattcctcaacgaggatcattggttttctcgggaaaattccctgagcggcgtcgagggggagggccttcacaagctgggatacatcctccgcgacgtgtccaaaaaggaaggcggggcgatgtatgctgatgacaccgccggatgggatacgagaattaccctggaggacctgaaaaacgaagagatggttacaaatcatatggaaggcgagcacaagaaactcgccgaggctatcttcaagctgacctaccagaacaaggtggtccgggtgcagcgccccacaccgagagggaccgtcatggacattatcagccggcgcgatcagagaggatctggccaagtggttacgtatgggcttaatacattcaccaacatggaagcccagctgatccggcagatggagggcgaaggagtgtttaaaagcattcaacagctcacagctaccgaggagatcgccgtcaagaactggctggcgcgcgtgggcagagaacggctttcccgcatggccatttctggggacgattgcgtggttaaacctctggacgatagattcgctagcgccctcacggctctgaatgacatgggaaagatccggaaagatattcagcagtgggagccctccagaggctggaacgactggacccaagtgcccttttgctctcatcacttccacgaactgatcatgaaggatgggcgcgtcctcgtggttccttgtcggaatcaggacgagctgatcggacgggcccgcattagccagggcgcggggtggtcccttcgggaaacagcctgcctgggcaagtcttacgctcagatgtggagcctcatgtattttcatagacgcgatctgcggcttgccgctaacgccatctgttccgctgtgccgagccactgggtccccacctctagaacaacctggtccattcatgccacacacgagtggatgaccacggaggacatgctgacagtgtggaatcgcgtctggatccaagaaaacccttggattgaggataaaacccccgtggaaagctgggaggaaatcccttacctcggaaagcgggaggaccagtggtgcggctctctgatcgggctgacctccagagcgacatgggccaaaaatattcagaccgctatcaaccaggttcgcagcctcattggaaatgaggaatatacagactacatgccctccatgaagcggttcagacgggaggaagaggaagccggcgtgctgtggtga

SEQ ID NO: 20325 - RNA, 9876 nt, synthetic construct
  misc_feature 1..9876: note = derived and/or modified CDS sequence (opt5) from DENV-2__DQ645555__SS-prME
  source 1..9876: mol_type = other RNA
accgccggagtgatcattatgatgatccccacagtcgttgctttccacctgacgaccagaaatggggaacctcatatgattgtgagccggcaggaaaagggaaaatccctcctgtttaagacagagaatggcgtgaacatgtgcacccttatggccatggacctgggggaactctgtgaggatacaatcacctacaattgcccgctgcttagacaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagccagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggagggcgtcagcgggggatcctgggtggatattgtgctggaacacggcagctgtgtcaccacaatggccaaaaataagcccaccctcgacttcgagctgatcaagacagaagctaaacaccctgccacccttagaaagtactgcatcgaggctaaactgacgaacacaaccaccgcctctcggtgtccgacacaaggggaaccctccctcaatgaggagcaggataagcgctttgtttgcaaacatagcatggtggacagaggatggggcaacggctgtgggctgttcggaaagggcgggattgtgacctgcgcgatgtttacatgcaagaaaaatatggaaggaaaggtcgtgcagcctgagaacctggaatatacgatcgttattacaccccactctggcgaggaaaatgccgtggggaacgatacaggaaaacatggcaaggagatcaaagtcacccctcagtccagcattacagaggctgaactcaccggctacgggacggtgaccatggagtgttctccccggacaggactggacttcaatgaaatggttcttctgcaaatggaggataaggcctggctcgtgcaccgccagtggtttctggaccttccgctgccttggctccccggcgctgatacccaggggtccaactggatccagaaagaaacactggtcaccttcaagaaccctcacgccaagaaacaagacgtggtcgtgctgggaagccaggagggcgccatgcatacggctctcacaggggcgaccgagatccagatgtcctctggcaatctgctttttacaggacacctgaagtgcagactccggatggacaaactgcaacttaagggcatgagctattccatgtgtaccgggaaattcaaggttgtgaaggaaattgccgagacccagcatggaacaatcgtcattagagtgcagtacgaaggcgatgggagcccctgcaaaatccccttcgagattatggacctggagaagcgccacgttctcggacggctgatcacggtgaaccctatcgtcaccgaaaaagattctccggtgaatattgaggctgaacccccttttggcgactcctacatcattatcggggtggagcccggccagctgaagctcagctggttcaaaaagggatctagcattggccaaatgtttgaaacaaccatgagaggggccaagcgcatggccatcctgggagatacagcttgggacttcggctcccttgggggagtttttacctctattggcaaagccctgcatcaggtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagagcagtataagtttcaacctgaatctcccagcaagctcgcttccgccatccagaaagctcacgaggaagggatctgtggcattagatctgtgacgcgcctggagaatcttatgtggaagcagatcaccccggaactgaaccatattctcagcgagaatgaggtcaaactgacaatcatgaccggagatattaagggcatcatgcaggccgggaaacggtccctgagacctcaacccacagaacttaagtacagctggaaagcgtggggaaaggccaagatgctctctaccgagctgcacaaccatacgttcctgatcgacggccctgaaaccgctgagtgccccaatacaaaccgcgcctggaatagcctcgaagtggaggattatgggtttggagtgttcaccacaaacatttggctgaaacttaaggagcggcaggacgtcttttgtgacagcaaactgatgtctgctgccatcaaggataatagagcggttcacgccgacatgggctactggattgaatccgctctcaacgatacctggaaaatcgagaaggccagcttcattgaagtgaagtcttgccactggcctaaaagccatacactgtggtccaacggcgtgctggagagcgagatgatcatccccaagaatttcgctgggccggtctctcagcacaactatcgccctggataccatacccagacggccggcccctggcaccttgggaaactcgaaatggactttgatttctgtgagggaacaaccgtggttgtgaccgaagactgcggcaatcgggggccctccctgagaacaaccacggccagcggaaagctgattacagagtggtgctgtcggtcctgcaccctccctccgctgcgctacagaggcgaagatggctgttggtatgggatggagatccggccccttaaagagaaggaagagaacctggtcaattctctcgtgacagctggacatggccaaattgacaactttagcctgggggttctgggaatggcgcttttcctcgaagagatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagaactgatgatgacgacaattggcatcgttctcctgtcccagtctaccatccccgagacaattcttgagctgaccgacgccctcgccctggggatgatggtgctgaagatcgtgcggaacatggaaaaatatcagcttgctgtcaccattatggccatcctgtgcgtgcctaatgcggttattctccaaaacgcttggaaggtgagctgtacaatcctggccgtcgtgtccgttagccccctcctgcttacgtcttcccagcagaaggccgattggatccctctggctctcaccattaaaggactgaatcccacagccatctttctgaccacacttagccgcacctctaagaaaagatcctggccgctgaacgaggctattatggccgtgggcatggtcagcatcctcgcgtcttccctgctcaagaatgacattcctatgacggggcccctggtggccggaggccttctgacagtctgctacgtgctgaccggccggagcgctgacctcgaactggagcgcgccgctgatgttagatgggaagaacaggccgagatctccgggagctctcctatccttagcattaccatctccgaagacggatctatgagcattaaaaacgaggaagaggagcaaacactgaccatcctcattcggacaggcctgctcgtgatctccgggctgttccccgtctctattccgatcacggccgctgcgtggtatctttgggaagtgaagaaacagcgcgccggagttctgtgggatgtgccttctccccctcccgtcggcaaggctgagctggaagacggggcctacagaatcaagcagaaaggcattctcggctattcccagatcggcgccggggtgtacaaggagggaacctttcacacaatgtggcatgtgacccggggcgctgttctgatgcacaaagggaagcgcattgaaccctcctgggccgatgtcaaaaaggaccttatcagctacggaggcgggtggaagctggagggagagtggaaagaaggcgaggaagtgcaagtgctcgcgctggagcctggcaagaatccgagagctgtccagacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgaaaaatccattgaggataatcctgagatcgaagacgatattttcagaaagaaacgcctgacaatcatggacctgcatcccggggccggaaagacgaaacggtatctccctgcgattgtcagagaggctatcaagcgcggcctgcggacccttatcctggccccgacaagagtggttgccgctgaaatggaggaagccctccgcgggctgcccattcggtaccagacccctgctatcagagccgagcacaccggacgcgagattgtggatctcatgtgtcatgcgacattcacgatgcggctgcttagccccatcagagtccctaactataatctgattatcatggacgaagcccactttaccgaccccgcttccattgccgctcggggctacatctctacacgcgtggagatgggggaagccgccggcatcttcatgaccgctacaccgcctggaagcagagatccctttccccaatccaacgcgcctattatggacgaggagcgggaaatccccgagcgcagctggaactctggccacgaatgggtgaccgatttcaaggggaaaacggtctggtttgttccttccattaaggccggaaacgacatcgctgcctgcctgcgcaagaatggcaagaaagtgattcagctcagccggaagacattcgattctgagtatgtgaagaccagaaccaacgactgggattttgtcgtgacaaccgacatcagcgaaatgggggccaatttcaaagctgagcgcgttatcgatccgcggagatgtatgaagcccgtgattctgacagacggagaggaacgcgtcatccttgccggccctatgcccgtgacccattcctctgcggctcagcggagagggcgcgttggccggaaccctaaaaatgagaacgatcaatacatttacatgggagaacccctggagaatgacgaagactgcgcccactggaaggaggccaaaatgctcctggataacatcaatacgccggagggcattatccctagcatgtttgaacccgagagagaaaaggtggacgctatcgatggggagtatcgcctgagaggagaagcccggaaaacattcgtcgacctcatgcgcagaggcgatcttcctgtgtggctggcgtaccgggtcgccgctgaggggattaactatgccgaccgcagatggtgttttgatggagtgaagaacaatcagatcctggaggaaaacgttgaggtggaaatttggaccaaggagggcgagcggaaaaagctcaaacccagatggctggacgctcgcatctactccgatcctcttgccctgaaggagttcaaagagttcgctgccgggcggaagtctctcacactgaatctgattaccgaaatgggcagactccccacgtttatgacccagaaggcgcgcaacgcccttgacaatctggctgtgctgcatacagccgaggctggaggccgggcctataaccacgccctcagcgaactgccggagacccttgagacactgctcctgctgaccctccttgctacagtcaccgggggaatcttcctgtttctgatgtccggcaaagggattggaaagatgacgctcggcatgtgctgcatcatcacagcgagcgttctgctttggtacgcccagattcaacctcactggatcgctgcctctattatcctggagttctttctcattgtgctgctgatccccgagcccgaaaaacagagaacccctcaggataatcagctcacctatgtggtcatcgccattcttacagtggttgctgccaccatggcgaacgagatgggcttcctggaaaagaccaaaaaggactttgggctgggaggcatcgccacgcaacagccggagtccaatattctcgatatcgacctgcggcccgctagcgcctggaccctttacgctgtggccacaaccttcattacacctatgctgcgccattccatcgagaactctagcgtcaatgtgtccctcaccgcgatcgccaaccaggctacggtcctgatggggctgggaaagggctggcccctctctaaaatggacattggggtgcctcttctggccatcggatgttacagccaggttaatcccattaccctgacagctgccctcctgcttctggtggctcactatgccatcattggccctggcctccaagcgaaggccaccagagaagctcagaaacgggccgctgccgggatcatgaagaacccgacagtcgatggaattaccgtgatcgacctggatcccatcccttacgaccccaaatttgagaagcagctgggccaggttatgctccttgtgctgtgcgtcacgcaagtgctgatgatgcgcacaacctgggccctctgtgaagcgctgacacttgctaccgggcctatttccaccctgtgggagggaaatcccggcagattctggaacacaacgatcgccgtgagcatggctaatatttttcgggggtcttatctcgccggagccggcctgctgttctccatcatgaagaacaccgctaacacacgcagaggcaccgggaatacaggagaaaccctcggcgagaaatggaagaaccggcttaatgccctggggaaaagcgagtttcagatttacaagaaatctggaatccaggaagttgatcgcacgctggcgaaggagggcatcaaaagaggggaaacagaccatcacgccgtctcccggggaagcgctaagctcagatggttcgtggagcgcaacctggtgaccccggagggcaaggtcatggatcttggctgcgggcggggaggctggtcttattactgtgggggactgaaaaatgttaaggaagtgaaaggcctcaccaaaggcgggcctgggcatgaggaacccattcccatgagcacatatggctggaacctggtgagactgcaatccggggtcgacgtgttctttacccctcccgagaaatgcgatacactcctttgtgacatcggagaatctagccctaatccgacggttgaggccggccgcaccctgcgggtgctgaacctcgtcgagaattggctgaacaataacacacagttctgcattaaggtgcttaatccctacatgccttccgttatcgaaaagatggaggctctgcagagaaaatacgggggagccctcgtgcgcaaccccctgagcagaaattccacccacgaaatgtattgggtctctaacgcgagcggcaacattgtgtcctctgtgaatatgatcagcagaatgctgatcaaccgctttacaatgcggcacaagaaagccacctacgagcctgatgtcgacctcgggtccggaacgagaaatattggcatcgaatctgagacccccaaccttgatattatcggcaagcgcattgagaaaatcaagcaggaacatgagacaagctggcactatgaccaagaccatccgtacaagacctgggcttatcacgggtcctacgaaacaaaacagaccggaagcgcctcttccatggttaatggcgtggtgcggctgctgacaaagccttgggatgtcatccccatggtgacccagatggctatgacggacacaacccctttcgggcagcaaagagtttttaaagagaaggtggatacccgcacacaggaacccaaagagggaacgaagaagctcatgaaaattaccgccgagtggctgtggaaggaacttggcaaaaagaaaacacctagaatgtgtacccgggaggagttcacacgcaaggtcagaagcaacgctgccctgggggcgatctttaccgacgagaataaatggaagtctgcccgggaggctgtggaagattccggattctgggagctcgttgacaaggaaagaaacctgcacctggagggcaaatgcgaaacatgtgtgtataatatgatgggcaagcgggagaaaaagctcggggagtttggaaaagccaagggcagccgcgctatttggtacatgtggctgggggccagattccttgaatttgaggccctgggattcctcaacgaagatcattggttttctcgggaaaattccctgagcggcgtcgaaggggagggccttcacaagctgggatacatcctccgcgacgtgtccaaaaaggagggcggggcgatgtatgctgatgacaccgccggatgggatacgagaattaccctggaagacctgaaaaacgaggaaatggttacaaatcatatggagggcgaacacaagaaactcgccgaggctatcttcaagctgacctaccagaacaaggtggtccgggtgcagcgccccacaccgagagggaccgtcatggacattatcagccggcgcgatcaaagaggatctggccaggtggttacgtatgggcttaatacattcaccaacatggaggcccagctgatccggcaaatggaaggcgagggagtgtttaaaagcattcagcagctcacagctaccgaagagatcgccgtcaagaactggctggcgcgcgtgggcagagagcggctttcccgcatggccatttctggggacgattgcgtggttaaacctctggacgatagattcgctagcgccctcacggctctgaatgacatgggaaaggtgcggaaagatatccagcaatgggaaccctccagaggctggaacgactggacccaggtccccttttgctctcatcacttccacgagctgattatgaaggatgggcgcgtgctcgttgtgccttgtcggaatcaggacgaactgatcggacgggcccgcatcagccagggcgcggggtggtcccttcgggagacagcctgcctgggcaagtcttacgctcaaatgtggagcctcatgtattttcatagacgcgatctgcggcttgccgctaacgccatttgttccgctgtcccgagccactgggtgcccacctctagaacaacctggtccatccatgccacacacgaatggatgaccacggaggacatgctgacagtctggaatcgcgtgtggattcaggagaacccttggatcgaagataaaacccccgttgagagctgggaagagattccttacctcggaaagcgggaagaccagtggtgcggctctctgatcgggctgacctccagagcgacatgggccaaaaatatccagaccgctattaaccaagtgcgcagcctcatcggaaatgaggagtatacagactacatgccctccatgaagcggttcagacgggaagaggaagaggccggcgtcctgtggtga

SEQ ID NO: 20326 - RNA, 9876 nt, synthetic construct
  misc_feature 1..9876: note = derived and/or modified CDS sequence (opt5) from DENV-2__DQ645556__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtttgcaaacatagcatggtggacagaggatggggcaacggctgtgggctgttcggaaagggcgggattgtgacctgcgcgatgtttacatgcaagaaaaatatggagggaaaggtcgtgcagcctgaaaacctggagtatacgatcgttattacaccccactctggcgaagagaatgccgtggggaacgatacaggaaaacatggcaaggagatcaaagtcacccctcagtccagcattacagaagctgagctcaccggctacgggacggtgaccatggaatgttctccccggacaggactggacttcaatgagatggttcttctgcagatggaagataaggcctggctcgtgcaccgccaatggtttctggaccttccgctgccttggctccccggcgctgatacccaggggtccaactggatccagaaagagacactggtcaccttcaagaaccctcacgccaagaaacaggacgtggtcgtgctgggaagccaagagggcgccatgcatacggctctcacaggggcgaccgaaatccagatgtcctctggcaatctgctttttacaggacacctgaagtgcagactccggatggacaaactgcagcttaagggcatgagctattccatgtgtaccgggaaattcaaggttgtgaaggagattgccgaaacccaacatggaacaatcgtcattagagtgcagtacgagggcgatgggagcccctgcaaaatccccttcgagattatggacctggaaaagcgccacgttctcggacggctgatcacggtgaaccctatcgtcaccgagaaagattctccggtgaatattgaagctgagcccccttttggcgactcctacatcattatcggggtggaacccggccagctgaagctcagctggttcaaaaagggatctagcattggccagatgtttgagacaaccatgagaggggccaagcgcatggccatcctgggagatacagcttgggacttcggctcccttgggggagtttttacctctattggcaaagccctgcatcaagtcttcggggcgatctatggcgctgcctttagcggagtgtcctggacgatgaagatcctcattggcgtggtcatcacatggattgggatgaacagccggtctacctccctgagcgtgtctctggttcttgtgggagtcgtgaccctctacctgggcgttatggtgcaggccgattccgggtgtgtcgtgagctggaaaaataaggagctgaaatgcggatccggcatcttcattacagacaacgttcacacctggacagaacagtataagtttcagcctgagtctcccagcaagctcgcttccgccatccaaaaagctcacgaagaggggatctgtggcattagatctgtgacgcgcctggaaaatcttatgtggaagcagatcaccccggagctgaaccatattctcagcgagaatgaagtcaaactgacaatcatgaccggagatattaagggcatcatgcaggccgggaaacggtccctgagacctcagcccacagagcttaagtacagctggaaagcgtggggaaaggccaagatgctctctaccgaactgcacaaccatacgttcctgatcgacggccctgagaccgctgaatgccccaatacaaaccgcgcctggaatagcctcgaggtggaggattatgggtttggagtgttcaccacaaacatttggctgaaacttaaggaacggcaagacgtcttttgtgacagcaaactgatgtctgctgccatcaaggataatagagcggttcacgccgacatgggctactggattgagtccgctctcaacgatacctggaaaatcgaaaaggccagcttcattgaggtgaagtcttgccactggcctaaaagccatacactgtggtccaacggcgtgctggagagcgaaatgatcatccccaagaatttcgctgggccggtctctcagcacaactatcgccctggataccatacccagacggccggcccctggcaccttgggaaactcgagatggactttgatttctgtgaaggaacaaccgtggttgtgaccgaggactgcggcaatcgggggccctccctgagaacaaccacggccagcggaaagctgattacagaatggtgctgtcggtcctgcaccctccctccgctgcgctacagaggcgaggatggctgttggtatgggatggagatccggccccttaaagaaaaggaggaaaacctggtcaattctctcgtgacagctggacatggccagattgacaactttagcctgggggttctgggaatggcgcttttcctcgaggaaatgctgagaacccgcgtgggcacaaagcacgccatcctgctcgtcgctgtgtcctttgttaccctgattacggggaatatgtctttccgggatcttggaagagtgatggtcatggtgggcgccaccatgacagacgatatcggcatgggggtgacctacctggccctcctggctgcctttaaagtccgccctacattcgcggctggactgcttctgagaaagctcaccagcaaagagctgatgatgacgacaattggcatcgttctcctgtcccaatctaccatccccgagacaattcttgaactgaccgacgccctcgccctggggatgatggtgctgaagatcgtgcggaacatggagaaatatcagcttgctgtcaccattatggccatcctgtgcgtgcctaatgcggttattctccagaacgcttggaaggtgagctgtacaatcctggccgtcgtgtccgttagccccctcctgcttacgtcttcccaacagaaggccgattggatccctctggctctcaccattaaaggactgaatcccacagccatctttctgaccacacttagccgcacctctaagaaaagatcctggccgctgaacgaagctattatggccgtgggcatggtcagcatcctcgcgtcttccctgctcaagaatgacattcctatgacggggcccctggtggccggaggccttctgacagtctgctacgtgctgaccggccggagcgctgacctcgagctggaacgcgccgctgatgttagatgggaggagcaggccgaaatctccgggagctctcctatccttagcattaccatctccgaggacggatctatgagcattaaaaacgaagaggaggaacagacactgaccatcctcattcggacaggcctgctcgtgatctccgggctgttccccgtctctattccgatcacggccgctgcgtggtatctttgggaggtgaagaaacaacgcgccggagttctgtgggatgtgccttctccccctcccgtcggcaaggctgaactggaggacggggcctacagaatcaagcagaaaggcattctcggctattcccagatcggcgccggggtgtacaaggaaggaacctttcacacaatgtggcatgtgacccggggcgctgttctgatgcacaaagggaagcgcattgagccctcctgggccgatgtcaaaaaggaccttatcagctacggaggcgggtggaagctggagggagaatggaaagagggcgaagaggtccaggtgctcgcgctggaacctggcaagaatccgagagctgtccaaacaaaacccggactcttcaagaccaacacgggaaccattggcgccgtgtccctggattttagccctgggacatctggatcccccatcgttgacaaaaagggcaaggtggtcgggctttatggaaacggcgtggttacccggagcggcacatacgtgtctgccatcgctcagaccgagaaatccattgaggataatcctgaaatcgaggacgatattttcagaaagaaacgcctgacaatcatggacctgcatcccggggccggaaagacgaaacggtatctccctgcgattgtcagagaagctatcaagcgcggcctgcggacccttatcctggccccgacaagagtggttgccgctgagatggaagaggccctccgcgggctgcccattcggtaccagacccctgctatcagagccgagcacaccggacgcgaaattgtggatctcatgtgtcatgcgacattcacgatgcggctgcttagccccatcagagtccctaactataatctgattatcatggacgaggcccactttaccgaccccgcttccattgccgctcggggctacatctctacacgcgtggaaatgggggaggccgccggcatcttcatgaccgctacaccgcctggaagcagagatccctttccccagtccaacgcgcctattatggacgaggaacgggagatccccgaacgcagctggaactctggccacgagtgggtgaccgatttcaaggggaaaacggtctggtttgttccttccattaaggccggaaacgacatcgctgcctgcctgcgcaagaatggcaagaaagtgattcaactcagccggaagacattcgattctgaatatgtgaagaccagaaccaacgactgggattttgtcgtgacaaccgacatcagcgagatgggggccaatttcaaagctgagcgcgttatcgatccgcggagatgtatgaagcccgtgattctgacagacggagaagaaagagtcatccttgccggccctatgcccgtgacccattcctctgcggctcagcggagagggcgcgttggccggaaccctaaaaatgaaaacgatcagtacatttacatgggagagcccctggaaaatgacgaggactgcgcccactggaaggaggccaaaatgctcctggataacatcaatacgccggaaggcattatccctagcatgtttgagcccgaaagagagaaggtggacgctatcgatggggaatatcgcctgagaggagaggcccggaaaacattcgtcgacctcatgcgcagaggcgatcttcctgtgtggctggcgtaccgggtcgccgctgaggggattaactatgccgaccgcagatggtgttttgatggagtgaagaacaatcaaatcctggaagagaacgttgaagtggagatttggaccaaggagggcgaacggaaaaagctcaaacccagatggctggacgctcgcatctactccgatcctcttgccctgaaggagttcaaagagttcgctgccgggcggaagtctctcacactgaatctgattaccgagatgggcagactccccacgtttatgacccagaaggcgcgcaacgcccttgacaatctggctgtgctgcatacagccgaagctggaggccgggcctataaccacgccctcagcgagctgccggagacccttgaaacactgctcctgctgaccctccttgctacagtcaccgggggaatcttcctgtttctgatgtccggcaaagggattggaaagatgacgctcggcatgtgctgcatcatcacagcgagcgttctgctttggtacgcccagattcagcctcactggatcgctgcctctattatcctggagttctttctcattgtgctgctgatccccgaacccgagaaacaaagaacccctcaggataatcagctcacctatgtggtcatcgccattcttacagtggttgctgccaccatggcgaacgaaatgggcttcctggagaagaccaaaaaggactttgggctgggaggcatcgccacgcagcaaccggagtccaatattctcgatatcgacctgcggcccgctagcgcctggaccctttacgctgtggccacaaccttcattacacctatgctgcgccattccatcgaaaactctagcgtcaatgtgtccctcaccgcgatcgccaaccaggctacggtcctgatggggctgggaaagggctggcccctctctaaaatggacattggggtgcctcttctggccatcggatgttacagccaggttaatcccattaccctgacagctgccctcctgcttctggtggctcactatgccatcattggccctggcctccaggcgaaggccaccagagaggctcaaaaacgggccgctgccgggatcatgaagaacccgacagtcgatggaattaccgtgatcgacctggatcccatcccttacgaccccaaatttgaaaagcagctgggccaggttatgctccttgtgctgtgcgtcacacaggtgctgatgatgcgcacaacctgggccctctgtgaggcgctgacacttgctaccgggcctatttccaccctgtgggaaggaaatcccggcagattctggaacacaacgatcgccgtgagcatggctaatatttttcgggggtcttatctcgccggagccggcctgctgttctccatcatgaagaacaccgctaacacacgcagaggcaccgggaatacaggagagaccctcggcgagaaatggaagaaccggcttaatgccctggggaaaagcgaatttcaaatttacaagaaatctggaatccaggaggttgatcgcacgctggcgaaggaaggcatcaaaagaggggagacagaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcaccaaaggcgggcctgggcatgaagaacccattcccatgagcacatatggctggaacctggtgagactgcagtccggggtcgacgtgttctttacccctcccgaaaaatgcgatacactcctttgtgacatcggagagtctagccctaatccgacggttgaggccggccgcaccctgcgggtgctgaacctcgtcgaaaattggctgaacaataacacacaattctgcattaaggtgcttaatccctacatgccttccgttatcgagaagatggaagctctgcagagaaaatacgggggagccctcgtgcgcaaccccctgagcagaaattccacccacgagatgtattgggtctctaacgcgagcggcaacattgtgtcctctgtgaatatgatcagcagaatgctgatcaaccgctttacaatgcggcacaagaaagccacctacgaacctgatgtcgacctcgggtccggaacgagaaatattggcatcgagtctgagacccccaaccttgatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagaaaaggtggatacccgcacacaagagcccaaagagggaacgaagaagctcatgaaaattaccgccgaatggctgtggaaggagcttggcaaaaagaaaacacctagaatgtgtacccgggaagagttcacacgcaaggtcagaagcaacgctgccctgggggcgatctttaccgacgagaataaatggaagtctgcccgggaagctgtggaggattccggattctgggaactcgttgacaaggagagaaacctgcacctggaaggcaaatgcgagacatgtgtgtataatatgatgggcaagcgggagaaaaagctcggggaatttggaaaagccaagggcagccgcgctatttggtacatgtggctgggggccagattccttgagtttgaagccctgggattcctcaacgaggatcattggttttctcgggaaaattccctgagcggcgtcgagggggagggccttcacaagctgggatacatcctccgcgacgtgtccaaaaaggaaggcggggcgatgtatgctgatgacaccgccggatgggatacgagaattaccctggaggacctgaaaaacgaagagatggttacaaatcatatggaaggcgagcacaagaaactcgccgaggctatcttcaagctgacctaccagaacaaggtggtccgggtgcagcgccccacaccgagagggaccgtcatggacattatcagccggcgcgatcagagaggatctggccaagtggttacgtatgggcttaatacattcaccaacatggaagcccagctgatccggcagatggagggcgaaggagtgtttaaaaacattcaacagctcacagctaccgaggagatcgccgtcaagaattggctggcgcgcgtgggcagagaacggcttagccgcatggccatttccggggacgattgcgtggttaaacctctggacgatagattcgcttctgccctcacggctctgaacgacatgggaaaggtgcggaaagatgtccagcagtgggagcccagcagaggctggaatgactggacccaagtgcccttttgctcccatcacttccacgaactgatcatgaaggatgggcgcgttctcgtggtcccttgtcggaaccaggacgagctgattggacgggcccgcatctctcagggcgcggggtggagccttcgggaaacagcctgcctgggcaagtcctacgctcagatgtggtctctcatgtattttcatagacgcgatctgcggcttgccgctaatgccatctgtagcgctgtgccgtcccactgggtccccaccagcagaacaacctggtctattcatgccacacacgagtggatgaccacggaggacatgctgacagtgtggaaccgcgtttggatccaagaaaatccttggattgaggataaaacccccgtggaatcctgggaggaaatcccttacctcggaaagcgggaggaccagtggtgcggcagcctgattgggctgacctctagagcgacatgggccaaaaacatccagaccgctatcaatcaggtccgctccctcattggaaacgaggaatatacagactacatgcccagcatgaagcggttcagacgggaggaagaggaagccggcgtgctgtggtga

SEQ ID NO: 20327 - RNA, 9876 nt, synthetic construct
  misc_feature 1..9876: note = derived and/or modified CDS sequence (opt5) from DENV-2__AF204178__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacaggcgacggggttaatatgtgcaccctgatggccatggatccgggagagctctgtgaagacacaatcacctacaaatgccccctgcttaagcaaaacgagcctgaagatattgactggtggtgtaattctacaagcacctgggtgacgtatggcacctgcacaaccacaggggagcaccgcagagagaaacggtccgtggcgctggtcccccatgtgggaatgggcctcgaaacccgcacggagacatggatgtctagcgaaggcgcttggaagcacgcccagagaatcgagacctggatcctgcggcatcctgggttcacaatgatggccgctattctggcctacaccatcggaaccacacactttcagcgcgctctcattttcatcctgcttacggccgttgcgccctccatgaccatgagatgtattggcatctctaaccgggattttgtggagggggtcagcggaggctcctgggtggacattgttctggaacacgggagctgcgtgacaaccatggccaagaataaacctacactcgatttcgagctgatcaagaccgaagctaaacagccggccacgcttcgcaagtattgtatcgaggctaaactgacaaacaccaccacagactctagatgccccacccaaggagaaccttccctcaatgaggagcaggataagcggtttgtctgtaagcatagcatggtggaccgcggctggggcaacgggtgcggactgttcggcaaagggggaattgtgacatttgccatgttcacgtgtaagaaaaatatgaagggcaaagtcgttcagcccgaaaacctggagtacaccatcgtgattacacctcactctggggaagagcatgcggtgggaaatgataccggcaagcacggcaaagaaatcaagattacaccccagtccagcatcaccgaggccgagctcacggggtatggaaccgtcacaatgaagtgctctccgagaaccggcctggactttaacgaaatggtgcttctgcaaatggagaataaagcttggctcgttcaccggcagtggttcctggatcttcctctgccctggctccctggggccgacacacagggatccaactggatccagaaggaaaccctggtgacgtttaaaaatccccatgctaagaaacaagacgtcgtggttctgggcagccaggagggggccatgcacacagccctcaccggcgctacagaaattcagatgtcctctggaaacctgcttttcaccggccatctgaagtgccgcctcagaatggataagctgcaacttaaagggatgagctactccatgtgtaccggaaagttcaaagtggtcaaggagatcgcggagacacagcacggcacgattgtgatccgggtccagtatgaaggggacggaagcccctgcaaaattccttttgagatcatggatctggaaaagagacatgtgctcggccgcctgatcaccgttaacccgattgtgacagagaaggactctcccgtcaatatcgaggccgaacctcccttcggggattcctacattatcattggcgtggagcctggacagctgaaactcaactggtttaagaaaggcagctctatcgggcaaatgttcgaaaccacaatgcggggagctaagagaatggccattctgggcgacaccgcctgggattttgggagccttggaggcgttttcacgtccatcgggaaagctctgcaccaggtgtttggcgccatctacggagcggctttctctggcgtcagctggacaatgaagattctcatcggggtgattatcacctggattggaatgaattcccgcagcacctctctgtccgtgagcctggttcttgtcggcgtggtgacactctatctgggggtcatggtgcaggccgactctggatgtgttgtgtcctggaagaacaaagagctgaagtgcggcagcgggatctttatcaccgatgacgtccacacatggacggaacagtacaaattccaacccgagtccccgtctaagctcgccagcgctattcagaaagcccatgaggaaggcatctgtggaattcggtccgtgaccagactggagaatcttatgtggaagcagatcacacctgaactgaaccacattctctctgagaatgaagttaaactgaccatcatgacaggcgatatcaaggggattatgcaggctggaaagcgcagcctgcggccccaacctaccgagcttaaatattcctggaagacgtggggcaaagccaagatgctcagcaccgagtctcataaccagacatttctgatcgacgggcccgaaaccgcggagtgccctaatacaaacagagcctggaattccctggaagtggaggactacggattcggcgtctttaccacaaacatttggctcaaactgcgcgaaaagcaggatgtgttctgtgacagcaagcttatgtctgctgttatcaaagataatcgggccgctcacgccgacatgggctattggattgagtccgcgctgaacgatacctggaagatcgagaaagccagcttcatcgaagtgaagtcttgccactggcccaaaagccatacgctctggtccaatggggtcctggagagcgaaatgattatcccgaagaactttgctggacctgtgtctcagcacaactacagacccggctatcatacacaaaccgccgggccctggcacctgggaaagcttgagatggacttcgatttttgtgagggcaccacagtggtcgttaccgaagactgcgggaatcgcggaccttccctccggacgacaaccgctagcggcaaactgattacagagtggtgttgcagatcctgcaccctgccgcccctccggtaccgcggcgaagatgggtgttggtacggaatggagatcagacctctgaaggaaaaagaggagaaccttgtgaattctctggtgacagccggccatgggcagattgacaacttcagcctcggagtcctgggcatggccctgtttcttgaagagatgctccggaccagagtggggacgaagcacgctatcctgctggttgcggtgtccttcgtcaccctcattacaggaaatatgtcttttcgcgatctgggccgggtgatggttatggtgggcgccaccatgacagacgatatcgggatgggagtcacctatcttgctctgctcgccgccttcaaagtgagacccacgtttgctgccggcctgctgcttcgcaagctgacaagcaaggaactcatgatgaccacaatcgggattgttctgctctcccagtctaccatccctgagaccattctggaacttacagacgcgctggctctcggaatgatggtgctgaaaatggtcagaaagatggagaaataccaactggccgtgacgatcatggccattctttgcgtgcccaacgctgtcatcctgcagaatgcctggaaggttagctgtaccatcctcgcggtggtgtccgtcagccctctgttcattacatcttcccagcagaaagctgactggatccccctcgccctgaccattaagggccttaacccgacagccatctttctgaccacgctcagccggacaaataaaaagcgctcttggcctctgaacgaggctattatggccgtggggatggtttccatcctggctagctctcttctgaagaatgatatccccatgaccggacctctcgtggccggcggcctgctcaccgtctgctatgtgctgacagggagatccgcggaccttgaactggagcgggccgctgatgttaaatgggaagaccaagccgagattagcggatccagccccatcctgtctattaccatcagcgaagatggctccatgtctattaagaacgaggaggaagagcagatcctcacaattctgatccgcacggggcttctggtgatcagcggactcttcccggtctccattcctatcaccgctgccgcctggtacctgtgggaagtgaaaaagcagagagctggcgtcctctgggacgtgccctctcctccccccgttgggaaagcggagctggaggatggagcctatcggattaagcagaagggcatccttggctacagccaaattggggctggagtgtataaagaaggcacatttcacaccatgtggcatgtcacacgcggggccgtgctgatgcacaagggaaaaagaatcgagccttcctgggccgacgttaagaaagatctgatctcttacggcgggggatggaagctcgaaggcgagtggaaggaaggcgaggaggtgcaggtcctggctcttgaaccggggaaaaatccccgggccgtgcagaccaagcctggactgttcaaaacgaacgcgggcaccattggggctgtgagcctcgacttctcccccggaacaagcggctctcctatcattgataagaaagggaaggttgtcggactgtacggcaatggcgtggtgacccgctccggggcctatgtcagcgccatcgctcagacagagaagtctattgaagacaaccccgagatcgaagatgacatctttagaaaacggaagctcaccattatggacctgcatcctggagccggcaaaacaaagagataccttccggcgatcgtgcgcgaggctattaaacgggggctgagaacgctgatcctcgcccccacccgcgttgtggccgctgagatggaagaggccctgcggggacttcctattagatatcaaacacccgctatccgcgccgaacacaccggccgggagattgtcgatctgatgtgtcatgcgaccttcacaatgagactcctgtcccctgtgcgcgttcccaactacaatctcatcatcatggacgaagcccactttacggatccggctagcattgccgctcgggggtatatctccaccagagtggagatgggcgaggccgccggaattttcatgacagctacccctcccggctctcgggacccctttcctcagagcaacgcgcccatcatggatgaagagcgcgaaattcctgagagatcctggagctctgggcacgagtgggtcacagacttcaagggaaagaccgtgtggtttgttccgtccatcaaagccggcaatgatatcgctgcctgcctgcggaagaacgggaaaaaggtgattcagcttagccgcaaaacgttcgactctgaatacgtcaagacaagaaccaatgattgggactttgtggtgaccacagatatcagcgagatgggagccaacttcaaagctgaacgggtcattgaccccagacgctgtatgaagcctgttatcctgaccgacggcgaggaacgggtgattctggccgggcccatgcctgtgacacattcctctgcggctcaaagacgcggccggatcggaagaaatcccaagaacgagaatgatcagtatatctacatgggcgagccgctcgaaaacgacgaggattgcgcccactggaaagaagccaagatgctgcttgacaatattaacacccctgaggggatcattcccagcatgtttgaacctgagcgcgagaaagtcgatgctatcgacggagaataccggctgagaggcgaggcccgcaagacgttcgtggatctcatgagacggggggacctgcccgtttggctggcgtatcgcgtggccgctgaaggaattaattacgccgatagacggtggtgtttcgacggcatcaaaaacaatcagattctcgaggaaaacgtcgaggtggagatctggacaaaggaaggggagcgcaagaaacttaagcctagatggctggatgctaaaatctattccgaccccctggccctcaaggaatttaaagagttcgctgccggccggaagtctctgacccttaacctgattacagagatgggaagactcccgacctttatgacgcagaaggcgcgcgatgccctggacaatctggctgttctccataccgccgaagctggcgggcgggcctacaaccacgcccttagcgagctgcctgaaacactggagaccctcctgcttctgacactcctggctaccgtgacaggaggcatcttcctgtttctcatgtccgggagaggaattggcaaaatgacccttggcatgtgctgtatcattacggcgagcatcctgctgtggtatgcccaaatccagccccactggattgctgcctctatcattctcgaattctttctgatcgtccttctgattcccgagcctgagaagcagcgcacaccgcaggacaatcaactcacctacgtggtcatcgccatcctgaccgtggttgctgccacaatggcgaacgaaatggggttcctggagaaaaccaagaaagatctcggacttggctccattacaacgcagcagcccgaaagcaatatcctggacattgatctgcggcctgcctccgcttggaccctctatgccgtggctacaacctttgtgacacccatgctgagacattctatcgagaacagctccgtcaatgtttctcttaccgccattgcgaaccaggccacggtgctgatggggctcggaaagggctggcctctgagcaagatggacatcggggtgcccctgctcgctattggatgctactcccaagtcaatcctatcacccttacagccgctctgttcctgctcgtggcccactacgctatcattggcccgggcctgcaggccaaagcgacccgggaagcccagaagcgcgctgccgctgggatcatgaaaaaccccacagttgatggaattaccgtgatcgaccttgatcctattccctatgaccctaagtttgagaaacagctgggccaagtcatgctcctggtgctgtgcgtcacgcaggtgctcatgatgagaacaacctgggccctttgtgaggccctgacactggcgaccgggcccatcagcaccctctgggaaggaaatccgggccggttctggaacacaacgatcgctgtttctatggccaatatttttcgcgggtcctacctggctggagccggccttctgttcagcatcatgaagaacaccacaaataccagacggggcacagggaacattggagagaccctcggcgaaaaatggaagatccgcctgaatgccctggggaagtctgagttccagatttataaaaagtccggaatccaagaagtggatagaacgctcgctaaagagggcatcaagcggggggagacagaccatcacgccgtcagccgcggatctgcgaaacttagatggtttgtggaacggaacatggttacccctgagggcaaggtggtcgatctgggctgcgggagaggaggctggagctactattgtgggggactgaagaacgtgcgcgaagtgaaaggcctcaccaaggggggacccggccatgaggagcccattcctatgtccacatacggctggaatctggttcggcttcagtctggggtcgacgtgttctttaccccccctgaaaaatgcgatacactgctctgtgacatcggagagagctccccgaaccccacggtggaagccggcagaaccctgcgcgtcctgaatctcgttgagaactggcttaataacaatacacagttctgcattaaggtgctgaacccttatatgcccagcgtgatcgaaaaaatggagaccctgcagcggaagtacgggggagctctcgtcggcaatcctctgtccagaaactctacacacgagatgtactgggtgagcaatgcctccgggaacattgtttctagcgtgaatatgatctcccgcatgcttatcaaccggtttaccatgagacacaagaaagctacgtatgaacccgacgtcgatctgggatctggcacccgcaatattggcatcgagagcgaaattccgaacctcgacatcattgggaagcggatcgagaaaattaagcaagaacatgagacatcctggcactacgatcaggaccatccttataaaacctgggcctaccacggaagctatgagacaaagcagaccggctctgcgtccagcatggtgaacggggttgtgagactgctgacaaagccctgggatgtcgtgcctatggtgacccagatggccatgacggacacaacccccttcggacaacagcgcgtctttaaagaaaaggttgatacccggacacaggagcctaaagaaggcacgaagaaactcatgaagatcaccgctgagtggctttggaaagaactggggaagaagaaaacacccagaatgtgtacccgcgaggagttcacaagaaaggtgcggtctaatgccgctctgggagccatctttaccgacgaaaacaaatggaagtccgctcgcgaggccgtggaagatagcagattctgggagctcgtcgacaaagagcggaatctgcaccttgaaggcaagtgcgagacatgtgtgtacaacatgatgggcaagagagaaaaaaagctgggggagtttggaaaagcgaagggctctcgggccatttggtatatgtggctcggggctcgcttcctggaatttgaggccctgggattcctcaatgaggatcattggttctccagagaaaacagcctgtccggcgttgagggggaaggcctttacaaactgggatacatcctccgggacgtgagcaagaaggagggcggggctatgtatgccgacgataccgccggatgggacacgcgcattaccctggaagatcttaaaaatgaggagatggtcacaaaccacatggaaggcgagcataagaaactggcggaagctatctttaagctcacctaccagaataaagtggttagagtgcaacggccgacacctcgcgggaccgtcatggacattatctctagacgggatcagcgcggaagcggccaggtggggacgtatggcctgaacacattcaccaatatggaggcccaactgatcagacagatggaaggagagggcgtttttaagtccattcagcacctcacagtgaccgaggaaatcgccgtccagaactggctggctcgggtgcgcagagagcggctttctcgcatggccattagcggggacgattgcgtcgtgaagcccctggacgatagattcgcttccgccctcacggcgctgaatgacatgggaaaagttcggaaggatatccaacagtgggaaccctctagaggctggaacgactggacccaggtgcctttttgtagccatcacttccacgagcttattatgaaagatgggcgcgtcctggtggtgccgtgccggaatcaggacgagctcatcggaagagcccgcatctcccaaggcgctgggtggtctctgcgggaaacagcctgcctgggcaagagctacgctcagatgtggtccctcatgtattttcatagacgcgacctgcggcttgccgcgaacgccatttgtagcgctgttccctctcactgggtgcctacctccagaacaacctggagcatccatgccaaacacgagtggatgacaaccgaagatatgctgacggtctggaaccgcgtgtggattcaggagaatccctggatggaagacaagacacctgttgagtcttgggaggaaatcccctacctcggaaagcgggaggatcagtggtgcggctccctgattgggcttaccagcagagctacctgggccaaaaacatccaaacagctattaatcaggtgcgctccctgatcggaaacgaagagtataccgactacatgccttctatgaagcggttcagacgggaagaggaggaagccggcgtcctctggtga

SEQ ID NO: 20328 - RNA, 9876 nt, synthetic construct
  misc_feature 1..9876: note = derived and/or modified CDS sequence (opt5) from DENV-2__AF204177__SS-prME
  source 1..9876: mol_type = other RNA
accgccggaatgatcattatgctgatccccaccgtgatggctttccacctcacgaccagaaacggggaacctcatatgattgtgagccggcaggaaaagggaaagtccctgctttttaagaccggagacggggttaatatgtgcaccctgatggccatggatctcggagaactgtgtgaagacaccatcacctacaagtgcccgcttctgcgccaaaacgagcccgaagatattgactgttggtgcaattctacgagcacctgggtgacgtatggcacctgtacgaccacaggggagcacagacgggagaagcgctccgtggcgctcgtccctcatgtgggaatgggcctggaaaccagaacggagacatggatgtctagcgaaggcgcttggaaacacgcccagcggatcgagacctggatcctgcgccatcccgggttcacaattatggccgctatcctcgcctacaccattggaaccacacactttcagagagctctgatcttcattcttctgacggccgttgcgccttccatgaccatgcggtgcatcggcatttctaaccgcgattttgtggagggggtcagcggaggctcctgggtggacatcgttctcgaacacgggagctgtgtgacaaccatggccaagaataagcccacactggatcttgagctgatcaaaaccgaagctaagcagtctgccacgctcagaaaatattgcattgaggctaagctgacaaacaccaccacagaatcccggtgtcctacccaaggagagccgagcctgaatgaggaacaggacaaacgcttcgtctgcaagcattctatggtggatagaggctggggcaacgggtgtggactctttggcaaagggggaatcgtgacatgcgccatgttcacgtgcaaaaagaatatgaaaggcaaggtcgttcagcccgagaacctggaatacaccattgtgatcacacctcactccggggaggaacatgcggtgggaaatgacaccggcaaacacggcaaggagattaaaatcacaccccagagctctatcaccgaggccgaacttacggggtatggaaccgtcacaatggagtgttcccctcggaccggcctggattttaacgaaatggtgctcctgcaaatggagaataaggcttggcttgttcaccgccagtggttcctggacctccccctgccgtggctgcctggggccgatacacagggaagcaactggattcagaaggaaaccctcgtgacgtttaaaaatccccatgctaagaaacaagacgtcgtggttctgggctcccaggagggggccatgcacacagcccttaccggcgctacagagatccagatgtctagcggaaacctcctgttcaccggccatctgaagtgcagacttcggatggacaaactgcaactcaaggggatgtcctacagcatgtgtaccggaaagtttaaagtggtcaaggaaattgcggagacacagcacggcacgatcgtgattagagtccagtatgaaggggatggatctccttgcaaaatccccttcgagatcatggacctggagaagcgccatgtgctgggccggctcattaccgttaaccccatcgtgacagaaaaagattcccctgtcaatattgaggccgaaccgcccttcggggacagctacatcattatcggcgtggagcctggacagctgaaacttaactggtttaagaaaggctctagcattgggcaaatgttcgaaaccacaatgagaggagctaagcgcatggccatcctgggcgataccgcctgggactttgggtccctcggaggcgttttcacgtctatcgggaaagctctgcaccaggtgtttggcgccatttacggagcggctttcagcggcgtctcctggacaatgaagatcctgattggggtgatcattacctggatcggaatgaatagccggtctacctcccttagcgtgtctctcgttctggtcggcgtggtgacactgtatctcggggtcatggtgcaggccgattccggatgtgttgtgagctggaaaaacaaggagctgaagtgcggctccgggatctttattaccgacaatgtccacacatggacggagcagtacaaattccaacccgaatctcctagcaaacttgcctccgctatccagaaagcccatgaggaaggcatttgtggaatcagatctgtgacccgcctggagaacctcatgtggaagcagattacacccgaactgaatcacatcctgagcgagaacgaggttaaacttaccatcatgacaggcgatattaaggggatcatgcaggctggaaaacggtccctcagaccgcaacctaccgaactgaagtatagctggaagacgtggggcaaagccaagatgctgtctaccgagtcccataatcagacatttctcattgacgggcccgaaaccgcggagtgccctaacacaaatcgcgcctggaacagcctggaagtggaggattacggattcggcgtctttaccacaaatatctggcttaaactgcgggagaagcaggacgtgttctgtgactctaaactcatgtccgctgccattaaggataacagagctgttcacgccgacatgggctattggatcgaaagcgcgctgaatgatacctggaagatcgagaaagcctcttttattgaagtcaagagctgccactggcccaaatcccatacgctgtggagcaacgaggtccttgagtctgaaatgatcattcctaagaacttcgctgggcccgtgtcccagcacaattaccgcccgggatatcatacacaaaccgccggcccttggcacctcgggaaactggagatggacttcgatttttgtgaaggaaccacagtggtcgttaccgaggactgcggcaaccgggggcccagcctgagaacgacaaccgcttccggaaagctcatcacagaatgctgttgccggtcttgtaccctgccccctcttcgctacagaggcgaggatggctgctggtacgggatggagattcggccgctgaaggaaaaagaggaaaatctcgtgaacagcctggtgacagccggacatggccagatcgacaatttctccctgggggtccttggaatggccctctttctggaggaaatgctgagaacccgcgtgggcacgaagcacgctattctcctggttgcggtgtctttcgtcacccttatcacagggaacatgagctttcgggatctgggaagagtgatggttatggtgggcgccaccatgacagacgatatcggcatgggggtcacctatctcgctctgctggccgccttcaaagtgcgccccacgtttgctgccggacttctgctcagaaagctgacatccaaagagctcatgatgaccacaattggcatcgttctgctttctcagagcaccattcctgagaccatcctggaactcacagacgcgctggctctggggatgatggtgcttaagatggtccggaagatggagaaataccaactggccgtgacgattatggccatcctctgtgtgcccaatgctgtcatcctgcagaacgcctggaaggtttcctgcaccattctcgcggtggtgagcgtctctcctctgttccttacatccagccagcagaaagctgattggatccccctggccctcaccattaagggactgaatcctacagccatctttctgaccacgctttctaaaacaaacaagaaacgctcctggcccctgaatgaagctattatggccgtgggcatggttagcatcctcgcttcttccctgctcaagaacgacatcccgatgaccgggcctctggtggccggaggccttctgaccgtctgttatgtgctgacaggcagaagcgcggacctcgagctggaacgggccgctgatgttaagtgggaggaccaagccgagatttccgggagctctcccatccttagcattaccatctccgaagatggatctatgagcattaaaaatgaggaagaggagcagatcctgacaattctcatccgcacgggcctgctcgtgatctccgggctgttccctgtctctattcccatcaccgctgccgcctggtacctttgggaagtgaagaaacagagagctggagtcctgtgggacgtgccgagccctccccctgttggcaaggcggagctggaagatggggcctatcggattaaacagaagggaatcctcggctactcccaaattggcgctggggtgtataaggagggaacatttcacaccatgtggcatgtcacacgcggcgccgtgctgatgcacaaagggaagagaatcgaaccctcttgggccgacgttaaaaaggatcttatcagctacgctggaggctggaaactggagggggagtggaaggaaggagaggaagtgcaggtcctcgccctggagcccggcaagaaccctcgggcggtgcagaccaaaccgggcctcttcaagacgaatgctgggaccattggagccgtgtccctggactttagccccggcacatctgggtcccctatcattgataaaaagggaaaagttgtcggcctttacgggaacggagtggtgacccgcagcggcgcctatgtctctgctatcgcccagacagaaaagtccattgaggacaaccccgagatcgaagatgacatcttcagaaagcggaaactgaccattatggatctgcatcctggcgcggggaagacaaaaagatacctccccgctatcgtgcgcgaggccattaagcggggactgagaacgcttatcctggcccctacccgcgttgtggctgccgaaatggaggaagctctccggggcctgccgattagatatcaaacacccgccatccgcgcggagcacaccgggcgggagattgtcgacctcatgtgccatgccaccttcacaatgagactgcttagccctgtgcgcgttcccaattacaacctgatcatcatggacgaagctcactttacggatcctgcctccattgctgcccggggatatatctctaccagagtggagatgggcgaagccgctgggattttcatgacagcgacacccccgggcagccgggacccttttccccagtccaatgcccccatcatggatgaggagcgcgaaattcctgagagaagctggtcttccggacacgaatgggtcacagacttcaaaggcaagaccgtgtggtttgttcccagcatcaaggctgggaacgatatcgccgcctgtctgcggaaaaatggaaagaaagtgattcagctctctcgcaagacgttcgacagcgagtacgtcaaaacaagaaccaacgattgggactttgtggtgaccacagatatctccgaaatgggcgctaatttcaaggccgagcgggtcattgaccctagacgctgcatgaaaccggttatcctgaccgatggggaggaacgggtgattcttgcgggacccatgcctgtgacacattctagcgctgcccaaagacgcggccggatcgggagaaaccccaagaatgagaacgaccagtatatctacatgggcgaacctctggagaatgacgaagattgtgcccactggaaggaggctaaaatgctcctggacaacattaatacccccgagggaatcattccgtccatgtttgaacctgagcgcgaaaaggtcgatgccatcgacggcgagtaccggctgagaggggaagcgcgcaaaacgttcgtggatctcatgagacggggagaccttcccgtttggctggcctatcgcgtggctgccgagggcattaactacgctgatagacggtggtgctttgacgggatcaagaataaccagattctggaggaaaacgtcgaggtggaaatctggacaaaagagggagagcgcaagaagctcaaacctagatggctggatgcccggatctattctgacccccttgctctgaaggagttcaaagagttcgccgcgggcagaaagagcctcaccctgaatctgattacagaaatggggcgcctccctacctttatgacgcagaaagcccgggatgctcttgacaacctggccgttctgcataccgctgaggccggcggcagagcctacaatcacgctctctccgaactgcccgagacacttgagaccctgctcctgctgacactccttgcgaccgtgacaggcgggatcttcctgtttctgatgagcggacgcggcattgggaagatgaccctcggaatgtgctgtatcattacggcctctatcctgctttggtatgctcaaatccagccgcactggattgccgcctccatcattctggagttctttctcatcgtcctgctgattcctgagcccgaaaagcagcggacaccccaggataaccaactcacctacgtggtcatcgctatccttaccgtggttgccgcgacaatggccaatgagatgggcttcctggagaaaaccaagaaagacctgggcctcgggagcattacaacgcagcagcctgaatccaacatcctggacattgatcttagaccggcttctgcctggaccctgtatgctgtggccacaacctttgtgacacccatgctccggcatagcatcgaaaattcctctgtcaacgttagcctgaccgcgattgccaatcaggctacggtgctgatgggactcggcaaggggtggcctctttccaaaatggacatcggagtgcccctgctggccattggctgctacagccaagtcaaccctatcaccctcacagctgccctgttccttctggtggctcactacgccatcattgggcccggactccaggcgaaggccacccgcgaagctcagaagagagccgctgccggcatcatgaaaaatcctacagttgatggcattaccgtgatcgacctggatccgattccctatgaccctaagtttgagaaacagctggggcaagtcatgctccttgtgctgtgtgtcacacaggtgctgatgatgcggacaacctgggccctctgcgaagcgctgacacttgctaccggacccatctctaccctgtgggagggcaaccctgggcgcttctggaatacaacgatcgccgtttccatggctaacatttttagaggaagctacctcgccggcgccgggctgctgttctctatcatgaagaataccacaaacacccggcgcggaacaggcaatattggcgaaaccctcggggagaaatggaagtccagacttaacgctctgggaaaaagcgagtttcagatctataagaagtctggcattcaagaagtggatcggacgctggccaaagaggggatcaagcgcggagaaacagaccatcacgcggtcagcagaggctccgccaaactccggtggttcgtggagagaaacatggttacccccgaggggaaggtggtcgatctgggatgtggccgcggcgggtggtcttactattgcggaggccttaaaaatgtgcgggaagtgaaggggctgaccaagagaggaccgggccatgaggaacctatccccatgagcacatacgggtggaacctcgttcgcctgcagtccggagtcgacgtgttctttacaccccctgagaaatgtgatacactgctctgcgacattggcgaaagctcccccaatcctacggtggaggctggccggacccttagagtcctgaacctggttgagaattggctcaacaataacacacagttctgtatcaaggtgctgaatccgtatatgccctctgtgattgagaagatggaggcccttcagcgcaagtacgggggagctctggtccggaaccctctcagcagaaattccacccacgaaatgtactgggtgtctaacgccagcggcaatatcgtttcctctgtgaacatgattagccgcatgctgatcaatcggtttacaatgagacacaaaaaggcgacctatgagcccgatgtcgacctggggtccggaacgcgcaacatcggcattgaaagcgagatccctaacctcgacattatcgggaagcggattgagaaaatcaagcaagaacatgagaccctttggcactacgatcaggaccatccctataaaacatgggcctaccacggatcttatgaaaccaagcagacaggctccgctagctctatggtgaatggcgttgtgagactgctgaccaaaccgtgggatgtcgtgcctatggtgacacagatggccatgaccgacacgacacccttcgggcaacagcgcgtctttaaggagaaggttgataccagaacccaggaacctaaagagggaacaaagaaactcatgaagattacggctgagtggctgtggaaagaacttggcaagaaaaagacaccccggatgtgcacacgcgaggagttcaccagaaaggtgcggtccaacgccgctctgggggccatctttacagacgagaataaaagaaagagcgcgcgggaggccgtggaagattctcgcttctgggagctcgtcgacaaagaaagaaacctgcacctggagggaaagtgtgaaacctgcgtgtacaatatgatgggcaaacgggagaagaagctcggggagtttggaaaagctaagggctcccgcgccatctggtatatgtggctgggcgctagattccttgaatttgaggccctggggttcctcaacgaagatcattggtttagccgggaaaattccctgagcggagttgaaggcgaggggcttcacaaactgggatacattctccgcgacgtgtctaagaaagagggcggggccatgtacgcggatgacacagctggctgggacaccagaatcacgctggaagatctgaagaacgaggaaatggtcaccaatcatatggagggagaacacaagaaactcgccgaggccattttcaagctgacatatcagaacaaagtggttcgggtgcaacgccctacccccagaggcacagtcatggacatcattagccggcgcgatcagagagggtccggacaggtgggcacctacgggcttaatacgttcacaaacatggaggctcaactgatccggcagatggaaggagagggcgtttttaagtctatccagcatctcaccgtgacagaagagattgccgtccagaattggctggctcgcgtggggagagagcggcttagcagaatggccatctccggcgacgattgcgtcgtgaaaccgctggacgatcgcttcgcgtctgccctcaccgctctgaacgacatgggaaaggttcggaaggatattcaacagtgggaacctagcagaggctggaatgactggacacaggtgcccttttgttcccaccacttccatgagctgatcatgaaagatgggcgcgtcctcgtggtgccctgccggaaccagaacgaactgattggcagagcccgcatctctcaaggcgctgggtggagccttcgggagaccgcctgtctgggaaagtcctatgcgcagatgtggagcctcatgtactttcacagacgcgacctgcggcttgccgctaatgccatctgctctgctgttccttcccattgggtgccgacaagcagaaccacatggtctattcacgccaaacacgaatggatgaccacagaggatatgctgaccgtctggaaccgcgtgtggatccaggagaatccctggatggaagacaagacgtccgttgagagctgggaagagattccttatctcggcaaacgggaagaccagtggtgtgggtccctgatcggcctgacatctagagctacctgggccaagaacattcaaaccgcgatcaatcaggtgcggagcctcattggaaacgaggagtacacagattatatgccctccatgaagagattccgccgggaagaggaagaggccggcgtcctgtggtga

SEQ ID NO: 20329 - RNA, 9876 nt, synthetic construct
  misc_feature 1..9876: note = derived and/or modified CDS sequence (opt5) from DENV-2__DQ645540__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgacaaagaccgaggctaaacaccctgccacgcttagaaagtactgcatcgaagctaaactgacaaacaccaccacagcctctcggtgtccgacccagggggagccctccctcaatgaggaacaagataagcgctttgtttgcaaacatagcatggtggacagaggatggggcaacggctgtgggctgttcggaaagggcgggatcgtgacatgcgcgatgtttacgtgcaagaaaaatatggagggaaaggtcgtgcagcctgaaaacctggagtataccattgttatcacaccccactctggcgaagagaatgccgtggggaacgataccggaaaacatggcaaggagattaaagtcacacctcagtccagcatcaccgaagctgagctcacgggctacgggaccgtgacaatggaatgttctccccggaccggactggacttcaatgagatggttcttctgcagatggaagataaggcctggctcgtgcaccgccaatggtttctggaccttccgctgccttggctccccggcgctgatacacaggggtccaactggattcagaaagagaccctggtcacgttcaagaaccctcacgccaagaaacaggacgtggtcgtgctgggaagccaagagggcgccatgcatacagctctcaccggggcgacagaaatccagatgtcctctggcaatctgctttttaccggacacctgaagtgcagactccggatggacaaactgcagcttaagggcatgagctattccatgtgtaccgggaaattcaaggttgtgaaggagatcgccgaaacacaacatggaacgattgtcatcagagtgcagtacgagggcgatgggagcccctgcaaaattcccttcgagatcatggacctggaaaagcgccacgttctcggacggctgattaccgtgaaccctatcgtcacagagaaagattctccggtgaatatcgaagctgagcccccttttggcgactcctacattatcattggggtggaacccggccagctgaagctcagctggttcaaaaagggatctagcatcggccagatgtttgagaccacaatgagaggggccaagcgcatggccattctgggagataccgcttgggacttcggctcccttgggggagtttttacgtctatcggcaaagccctgcatcaagtcttcggggcgatttatggcgctgcctttagcggagtgtcctggacaatgaagatcctcatcggcgtggtcattacctggatcgggatgaacagccggtctacctccctgagcgtgtctctggttcttgtgggagtcgtgacactctacctgggcgttatggtgcaggccgattccgggtgtgtcgtgagctggaaaaataaggagctgaaatgcggatccggcattttcatcaccgacaacgttcacacatggacggaacagtataagtttcagcctgagtctcccagcaagctcgcttccgccattcaaaaagctcacgaagaggggatctgtggcatcagatctgtgacccgcctggaaaatcttatgtggaagcagattacaccggagctgaaccatatcctcagcgagaatgaagtcaaactgaccattatgacaggagatatcaagggcattatgcaggccgggaaacggtccctgagacctcagcccaccgagcttaagtacagctggaaagcgtggggaaaggccaagatgctctctacggaactgcacaaccataccttcctgatcgacggccctgagacagctgaatgccccaataccaaccgcgcctggaatagcctcgaggtggaggattatgggtttggagtgttcacaaccaacatctggctgaaacttaaggaacggcaagacgtcttttgtgacagcaaactgatgtctgctgccattaaggataatagagcggttcacgccgacatgggctactggatcgagtccgctctcaacgatacatggaaaattgaaaaggccagcttcatcgaggtgaagtcttgccactggcctaaaagccataccctgtggtccaacggcgtgctggagagcgaaatgattatccccaagaatttcgctgggccggtctctcagcacaactatcgccctggataccatacgcagacagccggcccctggcaccttgggaaactcgagatggactttgatttctgtgaaggaaccaccgtggttgtgacagaggactgcggcaatcgggggccctccctgagaaccacgacagccagcggaaagctgatcaccgaatggtgctgtcggtcctgcacactccctccgctgcgctacagaggcgaggatggctgttggtatgggatggagattcggccccttaaagaaaaggaggaaaacctggtcaattctctcgtgaccgctggacatggccagatcgacaactttagcctgggggttctgggaatggcgcttttcctcgaggaaatgctgagaacacgcgtgggcaccaagcacgccattctgctcgtcgctgtgtcctttgttacgctgatcaccgggaatatgtctttccgggatcttggaagagtgatggtcatggtgggcgccacaatgaccgacgatattggcatgggggtgacatacctggccctcctggctgcctttaaagtccgccctaccttcgcggctggactgcttctgagaaagctcacgagcaaagagctgatgatgacaaccatcggcattgttctcctgtcccaatctacaatccccgagaccatccttgaactgaccgacgccctcgccctggggatgatggtgctgaagattgtgcggaacatggagaaatatcagcttgctgtcacaatcatggccattctgtgcgtgcctaatgcggttatcctccagaacgcttggaaggtgagctgtacgattctggccgtcgtgtccgttagccccctcctgcttacctcttcccaacagaaggccgattggatccctctggctctcacaatcaaaggactgaatcccaccgccatttttctgacaacccttagccgcacgtctaagaaaagatcctggccgctgaacgaagctatcatggccgtgggcatggtcagcattctcgcgtcttccctgctcaagaatgacatccctatgacagggcccctggtggccggaggccttctgaccgtctgctacgtgctgaccggccggagcgctgacctcgagctggaacgcgccgctgatgttagatgggaggagcaggccgaaatttccgggagctctcctatccttagcatcacaatttccgaggacggatctatgagcatcaaaaacgaagaggaggaacagaccctgacaattctcatccggacgggcctgctcgtgatttccgggctgttccccgtctctatcccgattaccgccgctgcgtggtatctttgggaggtgaagaaacaacgcgccggagttctgtgggatgtgccttctccccctcccgtcggcaaggctgaactggaggacggggcctacagaatcaagcagaaaggaatcctcggctattcccagattggcgccggggtgtacaaggaaggaacatttcacaccatgtggcatgtgacacggggcgctgttctgatgcacaaagggaagcgcatcgagccctcctgggccgatgtcaaaaaggaccttattagctacggaggcgggtggaagctggagggagaatggaaagagggcgaagaggtccaggtgctcgcgctggaacctggcaagaatccgagagctgtccaaaccaaacccggactcttcaagacgaacaccggaacaatcggcgccgtgtccctggattttagccctgggacctctggatcccccattgttgacaaaaagggcaaggtggtcgggctttatggaaacggcgtggttacacggagcggcacctacgtgtctgccatcgctcagacagagaaatccatcgaggataatcctgaaattgaggacgatatcttcagaaagaaacgcctgacgattatggacctgcatcccggggccggaaagaccaaacggtatctccctgcgatcgtcagagaagctattaagcgcggcctgcggacacttatcctggccccgaccagagtggttgccgctgagatggaagaggccctccgcgggctgcccatccggtaccagacccctgctattagagccgagcacacaggacgcgaaatcgtggatctcatgtgtcatgcgacgttcaccatgcggctgcttagccccattagagtccctaactataatctgatcattatggacgaggcccactttacagaccccgcttccatcgccgctcggggctacatttctacccgcgtggaaatgggggaggccgccggcatcttcatgacagctaccccgcctggaagcagagatccctttccccagtccaacgcgcctatcatggacgaggaacgggagattcccgaacgcagctggaactctggccacgagtgggtgacggatttcaaggggaaaacagtctggtttgttccttccatcaaggccggaaacgacattgctgcctgcctgcgcaagaatggcaagaaagtgatccaactcagccggaagaccttcgattctgaatatgtgaagaccagaacaaacgactgggattttgtcgtgaccacagacattagcgagatgggggccaatttcaaagctgagcgcgttatcgatccgcggagatgtatgaagcccgtgatcctgaccgacggagaagaaagagtcattcttgccggccctatgcccgtgacgcattcctctgcggctcagcggagagggcgcgttggccggaaccctaaaaatgaaaacgatcagtacatctacatgggagagcccctggaaaatgacgaggactgcgcccactggaaggaggccaaaatgctcctggataacattaatacaccggaaggcatcattcctagcatgtttgagcccgaaagagagaaggtggacgctatcgatggggaatatcgcctgagaggagaggcccggaaaaccttcgtcgacctcatgcgcagaggcgatcttcctgtgtggctggcgtaccgggtcgccgctgaggggatcaactatgccgaccgcagatggtgttttgatggagtgaagaacaatcaaattctggaagagaacgttgaagtggagatctggacaaaggagggcgaacggaaaaagctcaaacccagatggctggacgctcgcatttactccgatcctcttgccctgaaggagttcaaagagttcgctgccgggcggaagtctctcaccctgaatctgatcacggagatgggcagactccccacctttatgacacagaaggcgcgcaacgcccttgacaatctggctgtgctgcataccgccgaagctggaggccgggcctataaccacgccctcagcgagctgccggagacacttgaaaccctgctcctgctgacactccttgctaccgtcacaggcgggattttcctgtttctgatgtccgggaaagggatcggaaagatgacactcggcatgtgctgcattatcaccgcgagcgttctgctttggtacgcccagatccagcctcactggattgctgcctctatcattctggagttctttctcatcgtgctgctgattcccgaacccgagaaacaaagaacccctcaggataatcagctcacatatgtggtcatcgccatccttaccgtggttgctgccacaatggcgaacgaaatgggcttcctggagaagacgaaaaaggactttgggctgggaggcattgccacccagcaaccggagtccaatatcctcgatattgacctgcggcccgctagcgcctggacactttacgctgtggccaccacattcatcacccctatgctgcgccattccattgaaaactctagcgtcaatgtgtccctcacggcgatcgccaaccaggctaccgtcctgatggggctgggaaagggctggcccctctctaaaatggacatcggggtgcctcttctggccattggatgttacagccaggttaatcccatcacactgaccgctgccctcctgcttctggtggctcactatgccattatcggccctggcctccaggcgaaggccacaagagaggctcaaaaacgggccgctgccgggattatgaagaacccgaccgtcgatggaatcacggtgattgacctggatcccatcccttacgaccccaaatttgaaaagcagctgggccaggttatgctccttgtgctgtgcgtcacacaggtgctgatgatgcgcaccacatgggccctctgtgaggcgctgacccttgctaccgggcctatctccacactgtgggaaggaaatcccggcagattctggaacacgaccattgccgtgagcatggctaatatctttcgggggtcttatctcgccggagccggcctgctgttctccattatgaagaacacagctaacacccgcagaggcacagggaataccggagagacgctcggcgagaaatggaagaaccggcttaatgccctggggaaaagcgaatttcaaatctacaagaaatctggcattcaggaggttgatcgcacactggcgaaggaaggcatcaaaagaggggagaccgaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcacaaaagggggacctggccatgaagaacccatccccatgagcacctatggctggaacctggtgagactgcagtccggggtcgacgtgttctttacacctcccgaaaaatgcgatacgctcctttgtgacattggagagtctagccctaatccgaccgttgaggccggccgcacactgcgggtgctgaacctcgtcgaaaattggctgaacaataacacccaattctgcatcaaggtgcttaatccctacatgccttccgttattgagaagatggaagctctgcagagaaaatacgggggagccctcgtgcgcaaccccctgagcagaaattccacacacgagatgtattgggtctctaacgcgagcggcaacatcgtgtcctctgtgaatatgattagcagaatgctgatcaaccgctttaccatgcggcacaagaaagccacgtacgaacctgatgtcgacctcgggtccggaaccagaaatatcggcattgagtctgagatccccaaccttgatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagtgaaggtcgatacccgcacacaagaacccaaagagggaacgaagaagctcatgaaaattaccgccgagtggctgtggaaggaacttggcaaaaagaaaacacctagaatgtgtacccgggaggagttcacacgcaaggtgagaagcaacgctgccctgggggcgatctttaccgacgagaataaatggaagtctgcccgggaggctgttgaagattccggattctgggagctcgtggacaaggaaagaaacctgcacctggagggcaaatgcgaaacatgtgtctataatatgatgggcaagcgggagaaaaagctcggggagtttggaaaagccaagggcagccgcgctatttggtacatgtggctgggggccagattccttgaatttgaggccctgggattcctcaacgaagatcattggttttctcgggaaaattccctgagcggcgtggaaggggagggccttcacaagctgggatacatcctccgcgacgtttccaaaaaggagggcggggcgatgtatgctgatgacaccgccggatgggatacgagaattaccctggaagacctgaaaaacgaggaaatggtgacaaatcatatggagggcgaacacaagaaactcgccgaggctatcttcaagctgacctaccagaacaaggtcgtgcgggtccagcgccccacaccgagagggaccgtgatggacattatcagccggcgcgatcagagaggatctggccaagttgtgacgtatgggcttaatacattcaccaacatggaggcccagctgatccggcagatggaaggcgagggagtctttaaaagcattcaacagctcacagctaccgaagagatcgccgtgaagaactggctggcgcgcgtgggcagagagcggctttcccgcatggccatttctggggacgattgcgttgtgaaacctctggacgatagattcgctagcgccctcacggctctgaatgacatgggaaaggtccggaaagatatccagcagtgggaaccctccagaggctggaacgactggacccaagtgcccttttgctctcatcacttccacgagctgattatgaaggatgggcgcgttctcgtggtcccttgtcggaatcaggacgaactgatcggacgggcccgcatcagccagggcgcggggtggtcccttcgggagacagcctgcctgggcaagtcttacgctcagatgtggagcctcatgtattttcatagacgcgatctgcggcttgccgctaacgccatttgttccgctgtgccgagccactgggtccccacctctagaacaacctggtccatccatgccacacacgaatggatgaccacggaggacatgctgacagtgtggaatcgcgtttggattcaagagaacccttggatcgaagataaaacccccgtggagagctgggaagagattccttacctcggaaagcgggaagaccagtggtgcggctctctgatcgggctgacctccagagcgacatgggccaaaaatatccagaccgctattaaccaggtccgcagcctcatcggaaatgaggagtatacagactacatgccctccatgaagcggttcagacgggaagaggaagaggccggcgtgctgtggtga

SEQ ID NO: 20330 - RNA, 9876 nt, synthetic construct
  misc_feature 1..9876: note = derived and/or modified CDS sequence (opt5) from DENV-2__DQ645541__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgacaaagaccgaggctaaacaccctgccacgcttagaaagtactgcatcgaagctaaactgacaaacaccaccacagcctctcggtgtccgacccagggggagccctccctcaatgaggaacaagataagcgctttgtttgcaaacatagcatggtggacagaggatggggcaacggctgtgggctgttcggaaagggcgggatcgtgacatgcgcgatgtttacgtgcaagaaaaatatggagggaaaggtcgtgcagcctgaaaacctggagtataccattgttatcacaccccactctggcgaagagaatgccgtggggaacgataccggaaaacatggcaaggagattaaagtcacacctcagtccagcatcaccgaagctgagctcacgggctacgggaccgtgacaatggaatgttctccccggaccggactggacttcaatgagatggttcttctgcagatggaagataaggcctggctcgtgcaccgccaatggtttctggaccttccgctgccttggctccccggcgctgatacacaggggtccaactggattcagaaagagaccctggtcacgttcaagaaccctcacgccaagaaacaggacgtggtcgtgctgggaagccaagagggcgccatgcatacagctctcaccggggcgacagaaatccagatgtcctctggcaatctgctttttaccggacacctgaagtgcagactccggatggacaaactgcagcttaagggcatgagctattccatgtgtaccgggaaattcaaggttgtgaaggagatcgccgaaacacaacatggaacgattgtcatcagagtgcagtacgagggcgatgggagcccctgcaaaattcccttcgagatcatggacctggaaaagcgccacgttctcggacggctgattaccgtgaaccctatcgtcacagagaaagattctccggtgaatatcgaagctgagcccccttttggcgactcctacattatcattggggtggaacccggccagctgaagctcagctggttcaaaaagggatctagcatcggccagatgtttgagaccacaatgagaggggccaagcgcatggccattctgggagataccgcttgggacttcggctcccttgggggagtttttacgtctatcggcaaagccctgcatcaagtcttcggggcgatttatggcgctgcctttagcggagtgtcctggacaatgaagatcctcatcggcgtggtcattacctggatcgggatgaacagccggtctacctccctgagcgtgtctctggttcttgtgggagtcgtgacactctacctgggcgttatggtgcaggccgattccgggtgtgtcgtgagctggaaaaataaggagctgaaatgcggatccggcattttcatcaccgacaacgttcacacatggacggaacagtataagtttcagcctgagtctcccagcaagctcgcttccgccattcaaaaagctcacgaagaggggatctgtggcatcagatctgtgacccgcctggaaaatcttatgtggaagcagattacaccggagctgaaccatatcctcagcgagaatgaagtcaaactgaccattatgacaggagatatcaagggcattatgcaggccgggaaacggtccctgagacctcagcccaccgagcttaagtacagctggaaagcgtggggaaaggccaagatgctctctacggaactgcacaaccataccttcctgatcgacggccctgagacagctgaatgccccaataccaaccgcgcctggaatagcctcgaggtggaggattatgggtttggagtgttcacaaccaacatctggctgaaacttaaggaacggcaagacgtcttttgtgacagcaaactgatgtctgctgccattaaggataatagagcggttcacgccgacatgggctactggatcgagtccgctctcaacgatacatggaaaattgaaaaggccagcttcatcgaggtgaagtcttgccactggcctaaaagccataccctgtggtccaacggcgtgctggagagcgaaatgattatccccaagaatttcgctgggccggtctctcagcacaactatcgccctggataccatacgcagacagccggcccctggcaccttgggaaactcgagatggactttgatttctgtgaaggaaccaccgtggttgtgacagaggactgcggcaatcgggggccctccctgagaaccacgacagccagcggaaagctgatcaccgaatggtgctgtcggtcctgcacactccctccgctgcgctacagaggcgaggatggctgttggtatgggatggagattcggccccttaaagaaaaggaggaaaacctggtcaattctctcgtgaccgctggacatggccagatcgacaactttagcctgggggttctgggaatggcgcttttcctcgaggaaatgctgagaacacgcgtgggcaccaagcacgccattctgctcgtcgctgtgtcctttgttacgctgatcaccgggaatatgtctttccgggatcttggaagagtgatggtcatggtgggcgccacaatgaccgacgatattggcatgggggtgacatacctggccctcctggctgcctttaaagtccgccctaccttcgcggctggactgcttctgagaaagctcacgagcaaagagctgatgatgacaaccatcggcattgttctcctgtcccaatctacaatccccgagaccatccttgaactgaccgacgccctcgccctggggatgatggtgctgaagattgtgcggaacatggagaaatatcagcttgctgtcacaatcatggccattctgtgcgtgcctaatgcggttatcctccagaacgcttggaaggtgagctgtacgattctggccgtcgtgtccgttagccccctcctgcttacctcttcccaacagaaggccgattggatccctctggctctcacaatcaaaggactgaatcccaccgccatttttctgacaacccttagccgcacgtctaagaaaagatcctggccgctgaacgaagctatcatggccgtgggcatggtcagcattctcgcgtcttccctgctcaagaatgacatccctatgacagggcccctggtggccggaggccttctgaccgtctgctacgtgctgaccggccggagcgctgacctcgagctggaacgcgccgctgatgttagatgggaggagcaggccgaaatttccgggagctctcctatccttagcatcacaatttccgaggacggatctatgagcatcaaaaacgaagaggaggaacagaccctgacaattctcatccggacgggcctgctcgtgatttccgggctgttccccgtctctatcccgattaccgccgctgcgtggtatctttgggaggtgaagaaacaacgcgccggagttctgtgggatgtgccttctccccctcccgtcggcaaggctgaactggaggacggggcctacagaatcaagcagaaaggaatcctcggctattcccagattggcgccggggtgtacaaggaaggaacatttcacaccatgtggcatgtgacacggggcgctgttctgatgcacaaagggaagcgcatcgagccctcctgggccgatgtcaaaaaggaccttattagctacggaggcgggtggaagctggagggagaatggaaagagggcgaagaggtccaggtgctcgcgctggaacctggcaagaatccgagagctgtccaaaccaaacccggactcttcaagacgaacaccggaacaatcggcgccgtgtccctggattttagccctgggacctctggatcccccattgttgacaaaaagggcaaggtggtcgggctttatggaaacggcgtggttacacggagcggcacctacgtgtctgccatcgctcagacagagaaatccatcgaggataatcctgaaattgaggacgatatcttcagaaagaaacgcctgacgattatggacctgcatcccggggccggaaagaccaaacggtatctccctgcgatcgtcagagaagctattaagcgcggcctgcggacacttatcctggccccgaccagagtggttgccgctgagatggaagaggccctccgcgggctgcccatccggtaccagacccctgctattagagccgagcacacaggacgcgaaatcgtggatctcatgtgtcatgcgacgttcaccatgcggctgcttagccccattagagtccctaactataatctgatcattatggacgaggcccactttacagaccccgcttccatcgccgctcggggctacatttctacccgcgtggaaatgggggaggccgccggcatcttcatgacagctaccccgcctggaagcagagatccctttccccagtccaacgcgcctatcatggacgaggaacgggagattcccgaacgcagctggaactctggccacgagtgggtgacggatttcaaggggaaaacagtctggtttgttccttccatcaaggccggaaacgacattgctgcctgcctgcgcaagaatggcaagaaagtgatccaactcagccggaagaccttcgattctgaatatgtgaagaccagaacaaacgactgggattttgtcgtgaccacagacattagcgagatgggggccaatttcaaagctgagcgcgttatcgatccgcggagatgtatgaagcccgtgatcctgaccgacggagaagaaagagtcattcttgccggccctatgcccgtgacgcattcctctgcggctcagcggagagggcgcgttggccggaaccctaaaaatgaaaacgatcagtacatctacatgggagagcccctggaaaatgacgaggactgcgcccactggaaggaggccaaaatgctcctggataacattaatacaccggaaggcatcattcctagcatgtttgagcccgaaagagagaaggtggacgctatcgatggggaatatcgcctgagaggagaggcccggaaaaccttcgtcgacctcatgcgcagaggcgatcttcctgtgtggctggcgtaccgggtcgccgctgaggggatcaactatgccgaccgcagatggtgttttgatggagtgaagaacaatcaaattctggaagagaacgttgaagtggagatctggacaaaggagggcgaacggaaaaagctcaaacccagatggctggacgctcgcatttactccgatcctcttgccctgaaggagttcaaagagttcgctgccgggcggaagtctctcaccctgaatctgatcacggagatgggcagactccccacctttatgacacagaaggcgcgcaacgcccttgacaatctggctgtgctgcataccgccgaagctggaggccgggcctataaccacgccctcagcgagctgccggagacacttgaaaccctgctcctgctgacactccttgctaccgtcacaggcgggattttcctgtttctgatgtccgggaaagggatcggaaagatgacactcggcatgtgctgcattatcaccgcgagcgttctgctttggtacgcccagatccagcctcactggattgctgcctctatcattctggagttctttctcatcgtgctgctgattcccgaacccgagaaacaaagaacccctcaggataatcagctcacatatgtggtcatcgccatccttaccgtggttgctgccacaatggcgaacgaaatgggcttcctggagaagacgaaaaaggactttgggctgggaggcattgccacccagcaaccggagtccaatatcctcgatattgacctgcggcccgctagcgcctggacactttacgctgtggccaccacattcatcacccctatgctgcgccattccattgaaaactctagcgtcaatgtgtccctcacggcgatcgccaaccaggctaccgtcctgatggggctgggaaagggctggcccctctctaaaatggacatcggggtgcctcttctggccattggatgttacagccaggttaatcccatcacactgaccgctgccctcctgcttctggtggctcactatgccattatcggccctggcctccaggcgaaggccacaagagaggctcaaaaacgggccgctgccgggattatgaagaacccgaccgtcgatggaatcacggtgattgacctggatcccatcccttacgaccccaaatttgaaaagcagctgggccaggttatgctccttgtgctgtgcgtcacacaggtgctgatgatgcgcaccacatgggccctctgtgaggcgctgacccttgctaccgggcctatctccacactgtgggaaggaaatcccggcagattctggaacacgaccattgccgtgagcatggctaatatctttcgggggtcttatctcgccggagccggcctgctgttctccattatgaagaacacagctaacacccgcagaggcacagggaataccggagagacgctcggcgagaaatggaagaaccggcttaatgccctggggaaaagcgaatttcaaatctacaagaaatctggcattcaggaggttgatcgcacactggcgaaggaaggcatcaaaagaggggagaccgaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcacaaaagggggacctggccatgaagaacccatccccatgagcacctatggctggaacctggtgagactgcagtccggggtcgacgtgttctttacacctcccgaaaaatgcgatacgctcctttgtgacattggagagtctagccctaatccgaccgttgaggccggccgcacactgcgggtgctgaacctcgtcgaaaattggctgaacaataacacccaattctgcatcaaggtgcttaatccctacatgccttccgttattgagaagatggaagctctgcagagaaaatacgggggagccctcgtgcgcaaccccctgagcagaaattccacacacgagatgtattgggtctctaacgcgagcggcaacatcgtgtcctctgtgaatatgattagcagaatgctgatcaaccgctttaccatgcggcacaagaaagccacgtacgaacctgatgtcgacctcgggtccggaaccagaaatatcggcattgagtctgagacacccaaccttgatatcattggcaagcgcatcgagaaaattaagcaggagcatgaaaccagctggcactatgaccaggaccatccgtacaagacatgggcttatcacgggtcctacgagaccaaacaaacaggaagcgcctcttccatggttaatggcgtggtgcggctgctgaccaagccttgggatgtcatccccatggtgacgcagatggctatgacagacaccacccctttcgggcagcagagagtttttaaagaaaaggtggatacacgcacgcaagagcccaaagagggaaccaagaagctcatgaaaatcacagccgaatggctgtggaaggagcttggcaaaaagaaaacccctagaatgtgtacacgggaagagttcacccgcaaggtcagaagcaacgctgccctgggggcgatttttacagacgagaataaatggaagtctgcccgggaagctgtggaggattccggattctgggaactcgttgacaaggagagaaacctgcacctggaaggcaaatgcgagacctgtgtgtataatatgatgggcaagcgggagaaaaagctcggggaatttggaaaagccaagggcagccgcgctatctggtacatgtggctgggggccagattccttgagtttgaagccctgggattcctcaacgaggatcattggttttctcgggaaaattccctgagcggcgtcgagggggagggccttcacaagctgggatacattctccgcgacgtgtccaaaaaggaaggcggggcgatgtatgctgatgacacggccggatgggataccagaatcacactggaggacctgaaaaacgaagagatggttaccaatcatatggaaggcgagcacaagaaactcgccgaggctattttcaagctgacataccagaacaaggtggtccgggtgcagcgccccaccccgagagggacggtcatggacatcattagccggcgcgatcagagaggatctggccaagtggttacatatgggcttaataccttcacaaacatggaagcccagctgatccggcagatggagggcgaaggagtgtttaaaagcatccaacagctcaccgctacggaggagattgccgtcaagaactggctggcgcgcgtgggcagagaacggctttcccgcatggccatctctggggacgattgcgtggttaaacctctggacgatagattcgctagcgccctcaccgctctgaatgacatgggaaaggtgcggaaagatattcagcagtgggagccctccagaggctggaacgactggacacaagtccccttttgctctcatcacttccacgaactgatcatgaaggatgggcgcgtgctcgttgtgccttgtcggaatcaggacgagctgattggacgggcccgcatcagccagggcgcggggtggtcccttcgggaaaccgcctgcctgggcaagtcttacgctcagatgtggagcctcatgtattttcatagacgcgatctgcggcttgccgctaacgccatctgttccgctgtcccgagccactgggtgcccacatctagaaccacatggtccattcatgccacccacgagtggatgacgacagaggacatgctgaccgtctggaatcgcgtgtggatccaagaaaacccttggattgaggataaaacccccgttgaaagctgggaggaaatcccttacctcggaaagcgggaggaccagtggtgcggctctctgattgggctgacatccagagcgacctgggccaaaaatatccagacagctatcaaccaggtgcgcagcctcattggaaatgaggaatatacggactacatgccctccatgaagcggttcagacgggaggaagaggaagccggcgtcctgtggtga

SEQ ID NO: 20331 - RNA, 9876 nt, synthetic construct
  misc_feature 1..9876: note = derived and/or modified CDS sequence (opt5) from DENV-2__DQ645542__SS-prME
  source 1..9876: mol_type = other RNA
accgccggagtgatcattatgatgatccccacggtggttgctttccacctgacgaccagaaatggggagcctcatatgattgtgagccggcaggaaaagggaaaatccctcctgtttaagacagagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtcacgtatggaacctgtacagcgaccggcgagcacagacgggaaaaacgctccgtggctctggttcctcatgtggggatgggactcgagacaagaaccgaaacgtggatgtctagcgagggcgcctggaagcacgcccagcggatcgagacatgggtcctgcgccatcccggcttcaccatcatggctgccattctggcttacacaatcgggaccacctattttcagagagtgctcattttcatcctgcttacagccgttgcgccttccatgacgatgcggtgcattggaatctctaaccgcgactttgtggaaggcgtcagcgggggatcctgggtggatattgtgctggagcacggcagctgtgtcaccacaatggccaaaaataagcccaccctcgacttcgaactgacaaagaccgaggctaaacaccctgccacgcttagaaagtactgcatcgaagctaaactgacaaacaccaccacagcctctcggtgtccgacccagggggagccctccctcaatgaggaacaagataagcgctttgtttgcaaacatagcatggtggacagaggatggggcaacggctgtgggctgttcggaaagggcgggatcgtgacatgcgcgatgtttacgtgcaagaaaaatatggagggaaaggtcgtgcagcctgaaaacctggagtataccattgttatcacaccccactctggcgaagagaatgccgtggggaacgataccggaaaacatggcaaggagattaaagtcacacctcagtccagcatcaccgaagctgagctcacgggctacgggaccgtgacaatggaatgttctccccggaccggactggacttcaatgagatggttcttctgcagatggaagataaggcctggctcgtgcaccgccaatggtttctggaccttccgctgccttggctccccggcgctgatacacaggggtccaactggattcagaaagagaccctggtcacgttcaagaaccctcacgccaagaaacaggacgtggtcgtgctgggaagccaagagggcgccatgcatacagctctcaccggggcgacagaaatccagatgtcctctggcaatctgctttttaccggacacctgaagtgcagactccggatggacaaactgcagcttaagggcatgagctattccatgtgtaccgggaaattcaaggttgtgaaggagatcgccgaaacacaacatggaacgattgtcatcagagtgcagtacgagggcgatgggagcccctgcaaaattcccttcgagatcatggacctggaaaagcgccacgttctcggacggctgattaccgtgaaccctatcgtcacagagaaagattctccggtgaatatcgaagctgagcccccttttggcgactcctacattatcattggggtggaacccggccagctgaagctcagctggttcaaaaagggatctagcatcggccagatgtttgagaccacaatgagaggggccaagcgcatggccattctgggagataccgcttgggacttcggctcccttgggggagtttttacgtctatcggcaaagccctgcatcaagtcttcggggcgatttatggcgctgcctttagcggagtgtcctggacaatgaagatcctcatcggcgtggtcattacctggatcgggatgaacagccggtctacctccctgagcgtgtctctggttcttgtgggagtcgtgacactctacctgggcgttatggtgcaggccgattccgggtgtgtcgtgagctggaaaaataaggagctgaaatgcggatccggcattttcatcaccgacaacgttcacacatggacggaacagtataagtttcagcctgagtctcccagcaagctcgcttccgccattcaaaaagctcacgaagaggggatctgtggcatcagatctgtgacccgcctggaaaatcttatgtggaagcagattacaccggagctgaaccatatcctcagcgagaatgaagtcaaactgaccattatgacaggagatatcaagggcattatgcaggccgggaaacggtccctgagacctcagcccaccgagcttaagtacagctggaaagcgtggggaaaggccaagatgctctctacggaactgcacaaccataccttcctgatcgacggccctgagacagctgaatgccccaataccaaccgcgcctggaatagcctcgaggtggaggattatgggtttggagtgttcacaaccaacatctggctgaaacttaaggaacggcaagacgtcttttgtgacagcaaactgatgtctgctgccattaaggataatagagcggttcacgccgacatgggctactggatcgagtccgctctcaacgatacatggaaaattgaaaaggccagcttcatcgaggtgaagtcttgccactggcctaaaagccataccctgtggtccaacggcgtgctggagagcgaaatgattatccccaagaatttcgctgggccggtctctcagcacaactatcgccctggataccatacgcagacagccggcccctggcaccttgggaaactcgagatggactttgatttctgtgaaggaaccaccgtggttgtgacagaggactgcggcaatcgggggccctccctgagaaccacgacagccagcggaaagctgatcaccgaatggtgctgtcggtcctgcacactccctccgctgcgctacagaggcgaggatggctgttggtatgggatggagattcggccccttaaagaaaaggaggaaaacctggtcaattctctcgtgaccgctggacatggccagatcgacaactttagcctgggggttctgggaatggcgcttttcctcgaggaaatgctgagaacacgcgtgggcaccaagcacgccattctgctcgtcgctgtgtcctttgttacgctgatcaccgggaatatgtctttccgggatcttggaagagtgatggtcatggtgggcgccacaatgaccgacgatattggcatgggggtgacatacctggccctcctggctgcctttaaagtccgccctaccttcgcggctggactgcttctgagaaagctcacgagcaaagagctgatgatgacaaccatcggcattgttctcctgtcccaatctacaatccccgagaccatccttgaactgaccgacgccctcgccctggggatgatggtgctgaagattgtgcggaacatggagaaatatcagcttgctgtcacaatcatggccattctgtgcgtgcctaatgcggttatcctccagaacgcttggaaggtgagctgtacgattctggccgtcgtgtccgttagccccctcctgcttacctcttcccaacagaaggccgattggatccctctggctctcacaatcaaaggactgaatcccaccgccatttttctgacaacccttagccgcacgtctaagaaaagatcctggccgctgaacgaagctatcatggccgtgggcatggtcagcattctcgcgtcttccctgctcaagaatgacatccctatgacagggcccctggtggccggaggccttctgaccgtctgctacgtgctgaccggccggagcgctgacctcgagctggaacgcgccgctgatgttagatgggaggagcaggccgaaatttccgggagctctcctatccttagcatcacaatttccgaggacggatctatgagcatcaaaaacgaagaggaggaacagaccctgacaattctcatccggacgggcctgctcgtgatttccgggctgttccccgtctctatcccgattaccgccgctgcgtggtatctttgggaggtgaagaaacaacgcgccggagttctgtgggatgtgccttctccccctcccgtcggcaaggctgaactggaggacggggcctacagaatcaagcagaaaggaatcctcggctattcccagattggcgccggggtgtacaaggaaggaacatttcacaccatgtggcatgtgacacggggcgctgttctgatgcacaaagggaagcgcatcgagccctcctgggccgatgtcaaaaaggaccttattagctacggaggcgggtggaagctggagggagaatggaaagagggcgaagaggtccaggtgctcgcgctggaacctggcaagaatccgagagctgtccaaaccaaacccggactcttcaagacgaacaccggaacaatcggcgccgtgtccctggattttagccctgggacctctggatcccccattgttgacaaaaagggcaaggtggtcgggctttatggaaacggcgtggttacacggagcggcacctacgtgtctgccatcgctcagacagagaaatccatcgaggataatcctgaaattgaggacgatatcttcagaaagaaacgcctgacgattatggacctgcatcccggggccggaaagaccaaacggtatctccctgcgatcgtcagagaagctattaagcgcggcctgcggacacttatcctggccccgaccagagtggttgccgctgagatggaagaggccctccgcgggctgcccatccggtaccagacccctgctattagagccgagcacacaggacgcgaaatcgtggatctcatgtgtcatgcgacgttcaccatgcggctgcttagccccattagagtccctaactataatctgatcattatggacgaggcccactttacagaccccgcttccatcgccgctcggggctacatttctacccgcgtggaaatgggggaggccgccggcatcttcatgacagctaccccgcctggaagcagagatccctttccccagtccaacgcgcctatcatggacgaggaacgggagattcccgaacgcagctggaactctggccacgagtgggtgacggatttcaaggggaaaacagtctggtttgttccttccatcaaggccggaaacgacattgctgcctgcctgcgcaagaatggcaagaaagtgatccaactcagccggaagaccttcgattctgaatatgtgaagaccagaacaaacgactgggattttgtcgtgaccacagacattagcgagatgggggccaatttcaaagctgagcgcgttatcgatccgcggagatgtatgaagcccgtgatcctgaccgacggagaagaaagagtcattcttgccggccctatgcccgtgacgcattcctctgcggctcagcggagagggcgcgttggccggaaccctaaaaatgaaaacgatcagtacatctacatgggagagcccctggaaaatgacgaggactgcgcccactggaaggaggccaaaatgctcctggataacattaatacaccggaaggcatcattcctagcatgtttgagcccgaaagagagaaggtggacgctatcgatggggaatatcgcctgagaggagaggcccggaaaaccttcgtcgacctcatgcgcagaggcgatcttcctgtgtggctggcgtaccgggtcgccgctgaggggatcaactatgccgaccgcagatggtgttttgatggagtgaagaacaatcaaattctggaagagaacgttgaagtggagatctggacaaaggagggcgaacggaaaaagctcaaacccagatggctggacgctcgcatttactccgatcctcttgccctgaaggagttcaaagagttcgctgccgggcggaagtctctcaccctgaatctgatcacggagatgggcagactccccacctttatgacacagaaggcgcgcaacgcccttgacaatctggctgtgctgcataccgccgaagctggaggccgggcctataaccacgccctcagcgagctgccggagacacttgaaaccctgctcctgctgacactccttgctaccgtcacaggcgggattttcctgtttctgatgtccgggaaagggatcggaaagatgacactcggcatgtgctgcattatcaccgcgagcgttctgctttggtacgcccagatccagcctcactggattgctgcctctatcattctggagttctttctcatcgtgctgctgattcccgaacccgagaaacaaagaacccctcaggataatcagctcacatatgtggtcatcgccatccttaccgtggttgctgccacaatggcgaacgaaatgggcttcctggagaagacgaaaaaggactttgggctgggaggcattgccacccagcaaccggagtccaatatcctcgatattgacctgcggcccgctagcgcctggacactttacgctgtggccaccacattcatcacccctatgctgcgccattccattgaaaactctagcgtcaatgtgtccctcacggcgatcgccaaccaggctaccgtcctgatggggctgggaaagggctggcccctctctaaaatggacatcggggtgcctcttctggccattggatgttacagccaggttaatcccatcacactgaccgctgccctcctgcttctggtggctcactatgccattatcggccctggcctccaggcgaaggccacaagagaggctcaaaaacgggccgctgccgggattatgaagaacccgaccgtcgatggaatcacggtgattgacctggatcccatcccttacgaccccaaatttgaaaagcagctgggccaggttatgctccttgtgctgtgcgtcacacaggtgctgatgatgcgcaccacatgggccctctgtgaggcgctgacccttgctaccgggcctatctccacactgtgggaaggaaatcccggcagattctggaacacgaccattgccgtgagcatggctaatatctttcgggggtcttatctcgccggagccggcctgctgttctccattatgaagaacacagctaacacccgcagaggcacagggaataccggagagacgctcggcgagaaatggaagaaccggcttaatgccctggggaaaagcgaatttcaaatctacaagaaatctggcattcaggaggttgatcgcacactggcgaaggaaggcatcaaaagaggggagaccgaccatcacgccgtctcccggggaagcgctaagctcagatggttcgtggagcgcaacctggtgaccccggaaggcaaggtcatggatcttggctgcgggcggggaggctggtcttattactgtgggggactgaaaaatgttaaggaggtgaaaggcctcacaaaagggggacctggccatgaagaacccatccccatgagcacctatggctggaacctggtgagactgcagtccggggtcgacgtgttctttacacctcccgaaaaatgcgatacgctcctttgtgacattggagagtctagccctaatccgaccgttgaggccggccgcacactgcgggtgctgaacctcgtcgaaaattggctgaacaataacacccaattctgcatcaaggtgcttaatccctacatgccttccgttattgagaagatggaagctctgcagagaaaatacgggggagccctcgtgcgcaaccccctgagcagaaattccacacacgagatgtattgggtctctaacgcgagcggcaacatcgtgtcctctgtgaatatgattagcagaatgctgatcaaccgctttaccatgcggcacaagaaagccacgtacgaacctgatgtcgacctcgggtccggaaccagaaatatcggcattgagtctgagatccccaaccttgatattatcggcaagcgcattgagaaaatcaagcaggagcatgaaacaagctggcactatgaccaggaccatccgtacaagacctgggcttatcacgggtcctacgagacaaaacaaaccggaagcgcctcttccatggttaatggcgtggtgcggctgctgacaaagccttgggatgtcatccccatggtgacccagatggctatgacggacacaacccctttcgggcagcagagagtttttaaagaaaaggtggatacccgcacacaagagcccaaagagggaacgaagaagctcatgaaaattaccgccgaatggctgtggaaggagcttggcaaaaagaaaacacctagaatgtgtacccgggaagagttcacacgcaaggtcagaagcaacgctgccctgggggcgatctttaccgacgagaataaatggaagtctgcccgggaagctgtggaggattccggattctgggaactcgttgacaaggagagaaacctgcacctggaaggcaaatgcgagacatgtgtgtataatatgatgggcaagcgggagaaaaagctcggggaatttggaaaagccaagggcagccgcgctatttggtacatgtggctgggggccagattccttgagtttgaagccctgggattcctcaacgaggatcattggttttctcgggaaaattccctgagcggcgtcgagggggagggccttcacaagctgggatacatcctccgcgacgtgtccaaaaaggaaggcggggcgatgtatgctgatgacaccgccggatgggatacgagaattaccctggaggacctgaaaaacgaagagatggttacaaatcatatggaaggcgagcacaagaaactcgccgaggctatcttcaagctgacctaccagaacaaggtggtccgggtgcagcgccccacaccgagagggaccgtcatggacattatcagccggcgcgatcagagaggatctggccaagtggttacgtatgggcttaatacattcaccaacatggaagcccagctgatccggcagatggagggcgaaggagtgtttaaaagcattcaacagctcacagctaccgaggagatcgccgtcaagaactggctggcgcgcgtgggcagagaacggctttcccgcatggccatttctggggacgattgcgtggttaaacctctggacgatagattcgctagcgccctcacggctctgaatgacatgggaaaggtgcggaaagatatccagcagtgggagccctccagaggctggaacgactggacccaagtccccttttgctctcatcacttccacgaactgattatgaaggatgggcgcgtgctcgttgtgccttgtcggaatcaggacgagctgatcggacgggcccgcatcagccagggcgcggggtggtcccttcgggaaacagcctgcctgggcaagtcttacgctcagatgtggagcctcatgtattttcatagacgcgatctgcggcttgccgctaacgccatttgttccgctgtcccgagccactgggtgcccacctctagaacaacctggtccatccatgccacacacgagtggatgaccacggaggacatgctgacagtctggaatcgcgtgtggattcaagaaaacccttggatcgaggataaaacccccgttgaaagctgggaggaaattccttacctcggaaagcgggaggaccagtggtgcggctctctgatcgggctgacctccagagcgacatgggccaaaaatatccagaccgctattaaccaggtgcgcagcctcatcggaaatgaggaatatacagactacatgccctccatgaagcggttcagacgggaggaagaggaagccggcgtcctgtggtga

SEQ ID NO: 20332 - RNA, 9876 nt, synthetic construct
  misc_feature 1..9876: note = derived and/or modified CDS sequence (opt5) from DENV-2__AY702036__SS-prME
  source 1..9876: mol_type = other RNA
accgccggagtgatcgtcatgctgattcccacagctatggccttccacctcacgacccggaacggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttctccacaaacatctggctgaaacttcgggagaaacaggacgtcttttgtgatagcaagctgatgtctgccgctatcaaagacaatagagccgtgcacgcggatatgggctattggattgaatccgccctcaacgacacctggaagatggagaaggctagcttcatcgaggttaaatcttgccactggcctaagagccatacgctgtggtccaatggggtgctggaaagcgagatgattatccccaaaaacttcgccggaccggtctctcagcacaactaccgccctggctatcatacacaaaccgctgggccctggcaccttggaaagctcgaaatggattttgacttctgtgagggcaccacagtggtggtcaccgaagattgcgggaatcggggaccctccctgagaacgacaaccgccagcggcaaactgattacagagtggtgctgtcggtcctgcaccctccctccgctgcgctacagaggcgaggacgggtgttggtacggaatggaaatccggccccttaaggagaaggaagagaacctggttaattctctcgtgacagccggccatgggcagattgataactttagcctgggagtgctgggcatggctcttttcctcgaagagatgctgagaacccgcgtcgggacgaaacacgcgatcctgctcgtggccgtttcctttgtgaccctgatcacaggaaatatgtctttccgggaccttggcagagtcatggtgatggttggcgctaccatgacagatgacattgggatgggagtgacctatctggccctcctggccgcttttaaggtccgccctacgttcgccgcgggcctgcttctgagaaaactcacaagcaaggagctgatgatggctaccatcgggattgccctcctgtcccagtctacaatgcccgaaaccatccttgagctgaccgatgccctcgctctgggaatgatggtgctgaaaattgttcggaacatggaaaagtaccaacttgccgtgacaatcatggcgatcagctgcgtccctaatgctgtgattctgcagaacgcctggaaggtgtcctgtacgatcctcgccgctgtcagcgtttctcccctgctcctgacctccagccagcagaaagccgactggattcctcttgctctgacaatcaagggcctcaatcccaccgccatttttctgacaaccctgtctcgcacgtccaaaaagagaagctggccgcttaacgaggcgatcatggccgtggggatggtgtctatcctggcttccagcctcctgaaaaatgacattcctatgacaggacccctcgtcgccggcggcctgcttaccgtgtgctatgttctgaccgggcggtccgctgatctggaactcgagcgcgccgccgacgtgaagtgggaggatcaagctgaaatcagcggatctagccctattctgtccatcacaatttctgaggacggcagcatgtccatcaaaaacgaagaggaggaacagacccttacaattctgatcagaacggggctcctggtcatctctggagtgttccccgttagcattccgatcaccgcggccgcttggtacctctgggaggtgaagaagcagcgggccggcgtcctgtgggatgtgccttctccccctcccgtcgggaaagccgaacttgaggacggagcttatcgcattaagcagagaggcatcctgggctacagccaaattggggccggagtgtataaagaaggcacatttcacaccatgtggcatgttacaagaggggcggtgctgatgcaccgcggaaagagaatcgagcccagctgggctgatgtcaaaaaggacctcatctcctacggcgggggatggaagctggagggcgaatggaaagagggcgaagaggtgcaggttcttgccctggaacctgggaagaatccgcgggccgtgcagaccaaacccggaattttcaagacgaacaccggcacaatcggggctgtcagcctcgatttttctcctggaacctccggcagccccattgtggacagaaaagggaaggtggttggactgtacggcaatggcgtcgtgacacgctctggggcctatgtgtccgcgatcgctcagaccgaaaagagcattgaggataaccctgaaatcgaggacgatatcttccggaaaaagagactcacaattatggacctgcatcccggagccggcaaaacgaagcgctaccttcctgccatcgtccgggaagctattaacagagggctgcgcaccctgatcctcgccccgacacgggtggttgctgccgagatggaagaggcgctgagaggacttcccattcgctatcaaacccctgccatccgggctgagcacaccggcagagaaattgtggacctgatgtgtcatgccacattcacgatgcggctcctgtcccccgtccgcgtgcctaattacaacctcatcatcatggatgaggctcactttaccgaccccgcctctattgccgctagagggtatatcagcacacgggttgaaatgggcgaggcggccggaattttcatgaccgctacaccgcctggctcccgcgatccctttccccagagcaatgcccctatcatggacgaggaaagagagattcccgaacggtcttggaactccgggcacgagtgggtgaccgatttcaaaggaaagacggtctggtttgtgcctagcatcaaggccggcaatgacatcgctgcctgcctgcgcaagaatgggaagaaagttattcagctttctcgcaagacattcgatagcgaatacgtgaaaacccgggcgaatgactgggattttgtcgtgaccacagacatctccgagatgggagctaacttcaaggccgagagagtgattgatccgcgccggtgtatgaagcccgtcatcctgaccgacggcgaagagagagttattctggccgggcctatgcccgtgacacattctagcgctgcccaacgccggggcagaatcggacgcaatcctaaaaacgaaaatgaccagtatatctacatgggcgagcccctcgaaaacgatgaggactgcgcgcactggaaggaggccaaaatgctgcttgataatattaacaccccggaagggatcattccttccatgtttgagcccgaaagagagaaggtggacgctatcgatggagaataccggctgcgcggcgaggccagaaaaacgttcgtcgacctcatgcggcgcggggatctgcctgtgtggctggcttataaggttgccgctgagggaattaattacgccgacagaaaatggtgttttgatggcatcaagaacaaccagattctcgaagagaatgtggaagtcgagatctggacaaaggagggggaacggaagaaacttaaacccagatggctggacgcgcgcatctattctgatcctctggccctcaaagagttcaaagagttcgctgccggccggaagtccctgacccttaacctgattacagagatgggaagactccccacctttatgacgcagaaggctcgcaatgccctggacaacctggccgtgctccataccgctgaagcgggcgggcgggcctacaatcacgctctttccgagctgccggagacactggaaaccctcctgcttctgacactcctggccaccgttacaggaggcatcttcctgtttctcatgagcgggaaaggaattggcaagatgacccttggcatgtgctgcatcattacggcctcttccctgctgtggtatgctcaaatccagcctcactggatcgccgcgagcattatcctcgagttctttctgattgtgcttctgatccccgaacccgagaaacagagaacacctcaggataaccaactcacctacgtcgtgattgccatcctgaccgtcgtggctgccacaatggctaatgaaatggggttcctggagaagaccaaaaaggacctcggacttggctccatcacaacgcaggagtctgaaagcaacattctggacatcgatctgcggccggcctccgcgtggaccctctatgccgttgctacaacctttgtgacacccatgctgcgccattctattgagaatagctccgtgaacgtcagccttaccgccatcgctaatcaggccacggttctgatggggctcggaaagggctggcctctgtctaaaatggacattggggtgcccctgctcgctatcggatgttactcccaggtgaaccctattacccttacagccgcgctgctgctcctggtcgcccactacgctatcatcggccccggccttcaagccaaggctaccagagaagcccagaaacgggccgcggctgggattatgaagaatcctacagtggatggaatcaccgttattgacctggagccgatcccctatgatcctaaattcgaaaagcagctcggccaggtgatgctgctgattctctgcgtcacgcaagtgcttatgatgcgcacaacctgggccctgtgtgaggctctgacactcgccaccgggcccatcagcaccctgtgggagggaaaccctggcagattttggaatacaacgatcgccgtctctatggctaacattttccgggggtcctaccttgccggagcgggcctgctctttagcatcatgaagaataccacaaacacccgcagaggcacagggaacattggagaaaccctgggcgagaaatggaagtctcggctgaatgccctcgggaaaagcgagttccagatctataagaaatccggcattcaggaggtggaccgcacgcttgctaaggagggcatcaaaagaggggaaacagatcatcacgccgtttctcggggaagcgctaagctgagatggtttgtggagcgcaacatggtcacccccgaaggcaaggtggttgacctgggctgcgggcggggaggctggtcctactattgtgggggactcaaaaatgtgagagaggtcaagggcctgaccaaagggggaccgggccatgaagaacctatccccatgagcacatacggctggaaccttgtgcgcctgcaatccggggtggatgttttcttcacaccccctgagaagtgcgacaccctcctgtgtgatattggagaatctagccccaatcctacgatcgaggccggccggaccctgagagtcctcaaccttgtggaaaattggctgaacaataacacacagttttgcattaaagtgctgaatccgtatatgccctccgtcatcgagaagatggaaaccctccagcgcaagtacgggggagcgctggttcggaaccctctttctagaaatagcacacacgagatgtactgggtgtccaacgccaccggcaatattgtgtctagcgtcaacatgatctcccgcatgctgatcaaccggttcacgatgaaacacaagaaagctacctatgagcccgacgtggatctcgggagcggaacaagaaatattggcatcgaatctgagattcctaacctggacatcattggcaagcgcatcgagaagattaagcaggagcatgaaacctcctggcactacgaccaagatcatccctataagacatgggcctaccacgggagctatgagaccaaacagacaggatctgcttccagcatggttaatggcgtggtccggctgctcaccaagccgtgggacgtggttcctatggtgacgcagatggccatgacagataccaccccctttgggcagcaaagagtcttcaaagagaaggtggacacacgcacgcaggaacctaaagagggaaccaagaaacttatgaaaatcacagctgaatggctgtggaaggagctgggcaaaaagaaaacccccagaatgtgtacacgggaggaatttacccgcaaggtgagatctaacgccgcgctcggggccatcttcacagatgagaataaatggaagtccgctcgggaagccgtcgaggacggaagattttgggaactggttgatcgggagcgcaaccttcacctggagggcaagtgcgaaacctgtgtgtacaatatgatgggcaaaagagagaagaaactcggggagttcggaaaggctaaaggcagccgggccatttggtatatgtggctgggggcccgctttctggagttcgaagcgctcggatttctgaacgaggaccattggttctccagaggcaatagcctttctggggtggagggcgaaggactgcaccggctcggctacatcctgcgcgaggtcgggaagaaggaaggaggcgctatgtacgccgatgacacggccgggtgggataccagaattacacttgaggacctgaaaaacgaagagatggtgaccaatcatatgaagggagagcacaaaaagctcgctgaagccatctttaaactgacatatcagaacaaggttgtgcgggtccagcgccctacccccagaggcacggtgatggacattatcagccggcgcgatcaaagagggtccggccaggttggaacatacggcctgaataccttcacaaacatggaggctcagctcatccggcaaatggaaggggagggaattttcaagtctatccagcatctgaccgccacggaggaaattgcggtgcagaattggcttgcccgcgtcggcagagagcggctgagcagaatggctatctccggggacgattgcgtggttaaaccgattgacgatcgctttgcctctgctctcaccgccctgaacgacatgggaaaggtgcggaaagatatccagcaatgggaacctagcagaggctggaacgactggacacaggtccccttctgctcccaccactttcatgagcttgtgatgaaggatgggcgcgtcctggtggttccctgtcggaatcaggacgaactcatcggcagagcgcgcatttctcagggagccggctggagcctgaaagagaccgcttgcctggggaagtcctatgcccaaatgtggacactcatgtacttccaccggagagatctgcgccttgctgccaacgctatctgtagcgccgtgccttctcattgggtcccgacctcccggacaacctggagcattcacgcgaagcacgagtggatgacgacagaagacatgctggccgtgtggaatagagtgtggatccaggagaacccctggatggaagataaaacccctgttgagtcttgggaagaggtgccctatctcggaaagcgcgaggaccagtggtgcggctccctgattgggcttaccagccgggctacatgggccaaaaatatccagaccgccattaaccaagtcagatccctgatcggaaatgaagagtacacagactatatgccttctatgaagcggtttagacgcgaagaggaagaggctggcgtgctctggtga

SEQ ID NO: 20333 - RNA, 9876 nt, synthetic construct
  misc_feature 1..9876: note = derived and/or modified CDS sequence (opt5) from DENV-2__AY702034__SS-prME
  source 1..9876: mol_type = other RNA
acagccggagtgatcgtcatgctgattcccacagctatggccttccacctcacgacccggaacggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacttctgtgagggcacaaccgtggtggtcacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggttaattccctcgtgaccgccggccatgggcagattgataacttttctctgggagtgctgggcatggctcttttcctcgaagagatgctgagaacgcgcgtcgggaccaaacacgcgatcctgctcgtggccgttagctttgtgacactgatcaccggaaatatgtccttccgggaccttggcagagtcatggtgatggttggcgctacaatgaccgatgacattgggatgggagtgacgtatctggccctcctggccgcttttaaggtccgccctacattcgccgcgggcctgcttctgagaaaactcacctctaaggagctgatgatggctacaatcgggattgccctcctgagccagtccaccatgcccgaaaccatccttgagctgacagatgccctcgctctgggaatgatggtgctgaaaattgttcggaacatggaaaagtaccaacttgccgtgacgatcatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatttttctgaccacgctgagccgcacatctaaaaagagatcctggccgcttaacgaggcgatcatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgattctgatcagaaccgggctcctggtcatctccggagtgttccccgtttctattccgatcacagcggccgcttggtacctctgggaggtgaagaagcagcgggccggcgtcctgtgggatgtgccttctccccctcccgtcgggaaagccgaacttgaggacggagcttatcgcattaagcagagaggcatcctgggctactcccaaattggggccggagtgtataaagaaggcacctttcacacaatgtggcatgttaccagaggggcggtgctgatgcaccgcggaaagagaatcgagccctcctgggctgatgtcaaaaaggacctcatcagctacggcgggggatggaagctggagggcgaatggaaagagggcgaagaggtgcaggttcttgccctggaacctgggaagaatccgcgggccgtgcagacgaaacccggaattttcaagaccaacacaggcaccatcggggctgtctccctcgattttagccctggaacatctggctcccccattgtggacagaaaagggaaggtggttggactgtacggcaatggcgtcgtgacccgcagcggggcctatgtgtctgcgatcgctcagacagagaagtccattgaggataaccctgaaatcgaggacgatatcttccggaaaaagagactcacgattatggacctgcatcccggagccggcaaaaccaagcgctaccttcctgccatcgtccgggaagctattaacagagggctgcgcacactgatcctcgccccgacccgggtggttgctgccgagatggaagaggcgctgagaggacttcccattcgctatcaaacccctgccatccgggctgagcacacaggcagagaaattgtggacctgatgtgtcatgccacgttcaccatgcggctcctgagccccgtccgcgtgcctaattacaacctcatcatcatggatgaggctcactttacagaccccgcctccattgccgctagagggtatatctctacccgggttgaaatgggcgaggcggccggaattttcatgacagctaccccgcctggcagccgcgatccctttccccagtccaatgcccctatcatggacgaggaaagagagattcccgaacggagctggaactctgggcacgagtgggtgacggatttcaaaggaaagacagtctggtttgtgccttccatcaaggccggcaatgacatcgctgcctgcctgcgcaagaatgggaagaaagttattcagcttagccgcaagaccttcgattctgaatacgtgaaaacccgggcgaatgactgggattttgtcgtgacaaccgacatcagcgagatgggagctaacttcaaggccgagagagtgattgatccgcgccggtgtatgaagcccgtcatcctgacagacggcgaagagagagttattctggccgggcctatgcccgtgacccattcctctgctgcccaacgccggggcagaatcggacgcaatcctaaaaacgaaaatgaccagtatatctacatgggcgagcccctcgaaaacgatgaggactgcgcgcactggaaggaggccaaaatgctgcttgataatattaacacgccggaagggatcattcctagcatgtttgagcccgaaagagagaaggtggacgctatcgatggagaataccggctgcgcggcgaggccagaaaaacattcgtcgacctcatgcggcgcggggatctgcctgtgtggctggcttataaggttgccgctgagggaattaattacgccgacagaaaatggtgttttgatggcatcaagaacaaccagattctcgaagagaatgtggaagtcgagatctggaccaaggagggggaacggaagaaacttaaacccagatggctggacgcgcgcatctattccgatcctctggccctcaaagagttcaaagagttcgctgccggccggaagtctctgacacttaacctgattaccgagatgggaagactccccacgtttatgacccagaaggctcgcaatgccctggacaacctggccgtgctccatacagctgaagcgggcgggcgggcctacaatcacgctcttagcgagctgccggagaccctggaaacactcctgcttctgaccctcctggccacagttaccggaggcatcttcctgtttctcatgtccgggaaaggaattggcaagatgacgcttggcatgtgctgcatcattacagccagctctctgctgtggtatgctcaaatccagcctcactggatcgccgcgtccattatcctcgagttctttctgattgtgcttctgatccccgaacccgagaaacagagaacccctcaggataaccaactcacctacgtcgtgattgccatcctgacagtcgtggctgccaccatggctaatgaaatggggttcctggagaagaccaagaaggacctcggacttggcagcatcacgacccaggagtccgaatctaacattctggacatcgatctgcggccggccagcgcgtggacactctatgccgttgctaccacatttgtgacccccatgctgcgccattccattgaaaattctagcgtgaacgtctcccttacggccatcgctaatcaggccaccgttctgatggggctcggaaagggctggcctctgagcaaaatggacattggggtgcccctgctcgctatcggatgttactctcaggtgaaccctattacacttaccgccgcgctgctgctcctggtcgcccactacgctatcatcggccccggccttcaagccaaggctacaagagaagcccagaaacgggccgcggctgggattatgaagaatcctaccgtggatggaatcacggttattgacctggagccgatcccctatgatcctaaattcgaaaagcagctcggccaggtgatgctgctgattctctgcgtcacacaagtgcttatgatgcgcaccacatgggccctgtgtgaggctctgaccctcgccaccgggcccatctccacactgtgggagggaaaccctggcagattttggaatacgaccatcgccgtcagcatggctaacattttccgggggtcttaccttgccggagcgggcctgctcttttccatcatgaagaatacaaccaacacacgcagaggcaccgggaacattggagaaacgctgggcgagaaatggaaaagccggctgaatgccctcgggaaatctgagttccagatctataagaaaagcggcattcaggaggtggaccgcacacttgctaaggagggcatcaaaagaggggaaaccgatcatcacgccgtttcccggggatctgctaagctgagatggtttgtggagcgcaacatggtcacccccgaaggcaaggtggttgacctgggctgcgggcggggaggctggagctactattgtgggggactcaaaaatgtgagagaggtcaagggcctgacaaaagggggaccgggccatgaagaacctatccccatgtccacctacggctggaaccttgtgcgcctgcaaagcggggtggatgttttcttcacaccccctgagaagtgcgacacgctcctgtgtgatattggagaatcctctcccaatcctaccatcgaggccggccggacactgagagtcctcaaccttgtggaaaattggctgaacaataacacccagttttgcattaaagtgctgaatccgtatatgcccagcgtcatcgagaagatggaaacactccagcgcaagtacgggggagcgctggttcggaaccctctttccagaaattctacccacgagatgtactgggtgagcaacgccacgggcaatattgtgtcctctgtcaacatgatcagccgcatgctgatcaaccggttcaccatgaaacacaagaaagctacatatgagcccgacgtggatctcgggtccggaaccagaaatattggcatcgaaagcgagattcctaacctggacatcattggcaagcgcatcgagaagattaagcaggagcatgaaacatcttggcactacgaccaagatcatccctataagacctgggcctaccacgggtcctatgagacaaaacagaccggaagcgcttcttccatggttaatggcgtggtccggctgctcacgaagccgtgggacgtggttcctatggtgacacagatggccatgaccgataccacaccctttgggcagcaaagagtcttcaaagagaaggtggacacgcgcacccaggaacctaaagagggaacaaagaaacttatgaaaatcaccgctgaatggctgtggaaggagctgggcaaaaagaaaacacccagaatgtgtacccgggaggaatttacacgcaaggtgagaagcaacgccgcgctcggggccatcttcaccgatgagaataaatggaagtctgctcgggaagccgtcgaggacggaagattttgggaactggttgatcgggagcgcaaccttcacctggagggcaagtgcgaaacgtgtgtgtacaatatgatgggcaaaagagagaagaaactcggggagttcggaaaggctaaaggctcccgggccatttggtatatgtggctgggggcccgctttctggagttcgaagcgctcggatttctgaacgaggaccattggttcagcagaggcaattcccttagcggggtggagggcgaaggactgcaccggctcggctacatcctgcgcgaggtcgggaagaaggaaggaggcgctatgtacgccgatgacaccgccgggtgggatacaagaattacccttgaggacctgaaaaacgaagagatggtgacaaatcatatgaagggagagcacaaaaagctcgctgaagccatctttaaactgacctatcagaacaaggttgtgcgggtccagcgccctacgcccagaggcacagtgatggacattatctctcggcgcgatcaaagagggagcggccaggttggaacctacggcctgaatacattcaccaacatggaggctcagctcatccggcaaatggaaggggagggaattttcaagtccatccagcatctgacggccaccgaggaaattgcggtgcagaattggcttgcccgcgtcggcagagagcggctgtctagaatggctatcagcggggacgattgcgtggttaaaccgattgacgatcgctttgcctccgctctcacagccctgaacgacatgggaaaggtgcggaaagatatccagcaatgggaaccttctagaggctggaacgactggacccaggtccccttctgcagccaccactttcatgagcttgtgatgaaggatgggcgcgtcctggtggttccctgtcggaatcaggacgaactcatcggcagagcgcgcatttcccagggagccggctggtctctgaaagagacagcttgcctgggaaagagctatgcccaaatgtggaccctcatgtacttccaccggagagatctgcgccttgctgccaacgctatctgttccgccgtgcctagccattgggtcccgacatctcggaccacgtggtccattcacgcgaagcacgagtggatgacaaccgaagacatgctggccgtgtggaatagagtgtggatccaggagaacccctggatggaagataaaacccctgttgagagctgggaagaggtgccctatctcggaaagcgcgaggaccagtggtgcggctctctgattgggcttacatcccgggctacctgggccaaaaatatccagacagccattaaccaagtcagaagcctgatcggaaatgaagagtacacggactatatgccttccatgaagcggtttagacgcgaagaggaagaggctggcgtgctctggtga

SEQ ID NO: 20334 - RNA, 9876 nt, synthetic construct
  misc_feature 1..9876: note = derived and/or modified CDS sequence (opt5) from DENV-2__AF208496__SS-prME
  source 1..9876: mol_type = other RNA
accgccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgttccttcgccaaaacgaacccgaggatattgactgttggtgcaattttacatccacctgggtgacgtatggcacctgtacaaccacaggggagcacagacgggaaaagcgctctgtcgctctggtgcctcatgttggaatgggcctcgagaccagaacggaaacatggatgagctccgagggcgcctggaaacacgtgcagcggatcgagacctggatcctgcgccatcccgggttcacaattatggccgctatcctggcctacaccattggaaccacacactttcagagagctctcatcttcattctgcttacggccgtcgcgccttctatgaccatgcggtgcatcggcattagcaaccgcgattttgtggaaggggtttccggaggctcttgggtggacatcgtcctggagcacgggagctgtgtgacaaccatggccaagaataagcccacactcgatttcgaactgatcaaaaccgaggctaagcagcctgccacgcttagaaaatattgcattgaagctaagctgacaaacaccaccacagagtcccggtgtccgacccaaggagagcccagcctcaatgaagagcaggacaaacgctttatctgcaagcattctatggtggatagaggctggggcaacgggtgtggactgttcggcaaggggggaattgtcacatgcgccatgtttacgtgcaaaaagaatatggaaggcaaagttgtgcagcctgagaacctggaatacaccatcgtgattacaccccactccggggaggagcatgcggtcggaaatgacaccggcaagcacggcaaagaaatcaagatcacacctcagagctctattaccgaggccgaactcacggggtatggaaccgtgacaatggagtgttccccccggaccggcctggatttcaacgaaatggttcttctgcaaatggaggacaaagcttggctcgtgcaccgccagtggtttctggatcttccgctgccttggctccccggggccgacacacagggaagcaattggatccagaaggagaccctggtcacgttcaagaaccctcatgctaaaaagcaagacgtggttgtgctgggctctcaggaaggggccatgcacacagccctcaccggcgctacagagattcagatgtccagcggaaatctgcttttcaccggccatctgaaatgcagactccggatggataagctgcaacttaaagggatgtcctactctatgtgtaccggaaagtttaagatcgtcaaagaaattgcggagacacagcacggcacgatcgtgatcagagtccagtatgagggggacggaagcccctgcaagattcccttcgaaatcaccgatctggagaaacgccatgtgctcggccggctgattacagttaaccctatcgtgaccgaaaaggactccccggtcaacattgaggccgaacccccttttggggatagctacatcattatcggcgtggagcccggacagctgaaactcaattggttcaagaagggctcttccatcgggcaaatgtttgagacaaccatgagaggagctaaacgcatggccattctgggcgacacggcctgggatttcgggagccttggaggcgtttttacatctatcgggaaggctctgcaccaggtgttcggcgccatttacggagcggcttttagcggcgtctcctggaccatgaaaatcctcattggggtgatcatcacctggattggaatgaactctcggagcacatccctgagcgtgtctctggttcttgtcggcgtggtgaccctctatctgggggccatggtccaggccgactccggatgtgtggttagctggaagaataaagaactgaagtgcggctctgggatcttcattacagataacgtgcacacgtggaccgagcagtacaagtttcaacctgaatcccccagcaaactcgcttccgccatccagaaggctcatgaggaaggcatttgtggaatcagatctgtcacacgcctggagaatcttatgtggaaacagatcaccccggagctgaaccacattctcagcgaaaatgaggtgaagctgacaatcatgaccggcgacattaaagggatcatgcaggccggaaagcggtccctgagacctcaacccacggaacttaaatattcttggaagacctggggcaaggcgaaaatgctcagcacagagtcccataaccagaccttcctgattgatgggcctgaaacagccgagtgccccaataccaaccgcgcttggaatagcctggaggttgaagactacggatttggcgtgttcacaaccaacatctggctcaagctgcgggagaaacaggacgtcttctgtgattctaagcttatgtccgccgctatcaaagacaatagagccgtgcacgcggatatgggctattggattgaaagcgccctgaacgacacgtggaagatggagaaggcttcttttatcgaggttaaatcctgccactggcctaagagccatacactctggtctaatggggtgctggaaagcgagatgattatccccaaaaacttcgccggaccggtctcccagcacaactaccgccctggctatcatacccaaaccgctgggccctggcacctgggaaagcttgaaatggattttgacttctgtgagggcacaaccgtggtggtcacggaagattgcgggaatcggggacccagcctcagaacaaccacagcctctggcaaactgattaccgagtggtgctgtcggtcctgcacactgcctccgctccgctacagaggcgaggacgggtgttggtacggaatggaaatccggcccctgaaggagaaggaagagaaccttgttaatagcctggtgaccgccggccatgggcagattgataacttttccctcggagtgctgggcatggctctgttccttgaagagatgctcagaacgcgcgtcgggaccaaacacgcgatcctgctggtggccgtttcttttgtgacactcatcaccggaaatatgagcttccgggacctgggcagagtcatggtgatggttggcgctacaatgaccgatgacattgggatgggagtgacgtatcttgccctgctcgccgcttttaaggtccgccctacattcgccgcgggcctgctgcttagaaaactgacctccaaggagctcatgatggctacaatcgggattgccctgctctctcagagcaccatgcccgaaaccatcctggagcttacagatgccctggctctcggaatgatggtgctgaaaattgttcggaacatggaaaagtaccaactggccgtgacgatcatggcgatctcctgcgtccctaatgctgtgattcttcagaacgcctggaaggtgtcttgtaccatcctggccgctgtcagcgtttcccccctcctgctcacaagctctcagcagaaagccgactggattcctctggctcttaccatcaagggcctgaatcccacagccatttttctcaccacgctgtcccgcacaagcaaaaagagatcttggccgctgaacgaggcgatcatggccgtggggatggtgtccatccttgctagctctctgctcaaaaatgacattcctatgaccggacccctggtcgccggcggcctcctgaccgtgtgctatgttcttacagggcggtccgctgatctggaactggagcgcgccgccgacgtgaagtgggaggatcaagctgaaatcagcggatccagccctattctctctatcaccattagcgaggacggctccatgtctatcaaaaacgaagaggaggaacagacactgacgattcttatcagaaccgggctgctcgtcatcagcggagtgttccccgtttccattccgatcacagcggccgcttggtacctgtgggaggtgaagaagcagcgggccggcgtcctctgggatgtgccttctccccctcccgtcgggaaagccgaactggaggacggagcttatcgcattaagcagagaggcatccttggctacagccaaattggggccggagtgtataaagaaggcacctttcacacaatgtggcatgttacccggggggcggtgctgatgcaccgcggaaagagaatcgagccctcctgggctgatgtcaaaaaggacctgatctcttacggcgggggatggaagctcgagggcgaatggaaagagggcgaagaggtgcaggttctggcccttgaacctgggaagaatccgcgggccgtgcagacgaaacccggaattttcaagaccaacacaggcaccatcggggctgtcagcctggatttctcccctggaacaagcggctctcccattgtggacagaaaagggaaggtggttggactctacggcaatggcgtcgtgacccgctccggggcctatgtgagcgcgatcgctcagacagagaagtctattgaggataaccctgaaatcgaggacgatatctttcggaaaaagagactgacgattatggacctccatcccggagccggcaaaaccaagcgctacctgcctgccatcgtccgggaagctattaaaagagggcttcgcacactgatcctggccccgacccgggtggttgctgccgagatggaagaggcgctcagaggactgcccattcgctatcaaacccctgccatccgggctgagcacacaggcagagaaattgtggaccttatgtgtcatgccacgttcaccatgcggctgctctcccccgtccgcgtgcctaactacaatctgatcatcatggatgaggctcactttacagaccccgccagcattgccgctagagggtatatctccacccgggttgaaatgggcgaggcggccggaattttcatgacagctaccccgcctggctctcgcgatccctttccccagagcaacgcccctatcatggacgaggaaagagagattcccgaacggtcctggaatagcgggcacgagtgggtgacggatttcaagggaaagacagtctggtttgtgccttctatcaaagccggcaacgacatcgctgcctgcctcagaaagaatgggaaaaaggttattcagctgtcccgcaaaaccttcgatagcgaatacgtgaagacccgggcgaacgactgggattttgtcgtgacaaccgacatctctgagatgggagctaatttcaaggccgagagagtgattgatccgcgccggtgtatgaaacccgtcatccttacagacggcgaagagagagttattctggccgggcctatgcccgtgacccatagctccgctgcccaacgccggggcagaatcggacgcaaccctaagaatgaaaacgaccagtatatctacatgggcgagcccctggaaaatgatgaggactgcgcgcactggaaagaggccaagatgctcctggataacattaatacgccggaagggatcattccttctatgtttgagcccgaaagagagaaagtggacgctatcgatggagaataccggcttcgcggcgaggccagaaagacattcgtcgacctgatgcggcgcggggatctccctgtgtggctggcttataaagttgccgctgagggaattaactacgccgacagaaagtggtgtttcgatggcatcaagaataaccagattctggaagagaacgtggaagtcgagatctggaccaaagagggggaacggaagaaactcaagcccagatggcttgacgcgcgcatctatagcgatcctctggccctgaaagagtttaaggaattcgctgccggccggaagtccctcacactgaatcttattaccgagatgggaagactgcccacgtttatgacccagaaagctcgcaacgccctcgacaatctggccgtgctgcatacagctgaagcgggcgggcgggcctacaaccacgctctctctgagcttccggagaccctggaaacactgctcctgcttaccctgctcgccacagttaccggaggcatcttcctgtttctgatgagcgggaagggaattggcaaaatgacgctcggcatgtgctgcatcattacagcctccagccttctgtggtatgctcaaatccagcctcactggatcgccgcgtctattatcctggagttctttctcattgtgctgcttatccccgaacccgagaagcagagaacccctcaggataatcaactgacctacgtcgtgattgccatcctcacagtcgtggctgccaccatggctaacgaaatggggttcctggagaaaacaaagaaggacctgggactcggctccatcgccacgcaggagagcgaatccaatattcttgacatcgatctgcggccggcgtctgcctggaccctgtatgctgttgccacaacctttgtgacacccatgctccgccatagcattgagaactcctctgtgaatgtcagcctgaccgctatcgccaaccaggctacggttcttatggggctgggaaaaggctggcctctctccaagatggacattggggtgcccctgctggccatcggatgttacagccaggtgaatcctattaccctcacagcggcccttctgctgctcgtcgctcactacgccatcatcggccccggcctgcaagctaaagccaccagagaagcccagaagcgggcggctgccgggattatgaaaaaccctacagtggatggaatcaccgttattgaccttgagccgatcccctatgatcctaagttcgaaaagcagctgggccaggtgatgctcctgattctgtgcgtcacgcaagtgctcatgatgcgcacaacctgggctctttgtgaggccctgacactggccaccgggcccatctctaccctctgggagggaaatcctggcagattttggaacacaacgatcgctgtctccatggccaatattttccgggggagctacctggcgggagccggccttctgttttctatcatgaaaaacaccacaaatacccgcagaggcacagggaacattggagaaaccctcggcgagaagtggaaatcccggctgaacgctctggggaagagcgaattccagatctataaaaagtctggaattcaggaggtggaccgcacgctcgccaaagagggcatcaagagaggggaaacagatcatcacgctgttagccggggatccgccaagcttagatggttcgtggagcgcaatatggtcacccccgaaggcaaagtggttgacctgggctgcgggcggggaggctggtcttactattgtgggggactgaagaacgtgagagaggtcaaaggcctcaccaaggggggaccgggccatgaagagcctatccccatgagcacatacggctggaatctggtgcgccttcaatccggggtggatgtttttttcaccccccctgagaaatgcgacacactgctctgtgatattggagaaagctcccccaaccctacgatcgaggcgggccggaccctgagagtcctgaatctcgtggaaaactggcttaataacaatacacagttttgcattaaggtgctgaacccgtatatgccctctgtcatcgagaagatggaaaccctgcagcgcaaatacgggggagccctcgttcggaatcctctgagcagaaactccacacacgagatgtactgggtgtctaatgctaccggcaacattgtgagctccgtcaatatgatctctcgcatgcttatcaaccggttcacgatgaagcacaaaaaggccacctatgagcccgacgtggatctggggagcggaacaagaaacattggcatcgaatccgagattcctaatctcgacatcattggcaaacgcatcgaaaagattaagcaggagcatgaaaccagctggcactacgaccaagatcatccctataaaacatgggcttaccacgggtcttatgagaccaagcagacaggatccgccagctctatggttaacggcgtggtccggctgctgaccaaaccgtgggacgtggttcctatggtgacgcagatggctatgacagataccaccccctttgggcagcaaagagtcttcaaggagaaagtggacacacgcacgcaggaacctaaggagggaaccaagaaactcatgaagatcacagccgaatggctttggaaagagctgggcaagaaaaagacccccagaatgtgtacacgggaggaatttacccgcaaagtgagatccaatgcggccctgggggctatcttcacagatgagaacaagtggaagagcgcccgggaagctgtcgaggacggaagattttgggaactcgttgatcgggagcgcaatctgcaccttgagggcaaatgcgaaacctgtgtgtacaacatgatgggcaagagagagaaaaagctgggggaattcggaaaagccaagggctctcgggccatttggtatatgtggctcggggcgcgctttctggagttcgaagctctgggatttctcaatgaggaccattggttctccagaggcaacagcctgtccggggtggagggcgaaggacttcaccggctgggctacatcctccgcgaggtcgggaagaaagaaggaggcgccatgtacgccgatgacacggctgggtgggataccagaattacactggaggaccttaagaatgaagagatggtgaccaaccatatgaaaggagagcacaagaaactggccgaagctatcttcaagctcacatatcagaataaggttgtgcgggtccagcgccctacccccagaggcacggtgatggacattatcagccggcgcgatcaaagagggtctggccaggttggaacatacggcctgaacacctttacaaatatggaggcccagctgatccggcaaatggaaggggagggaattttcaaaagcatccagcatctcaccgcgacggaggaaattgccgtgcagaactggctggctcgcgtcggcagagagcggctttccagaatggccatctctggggacgattgcgtggttaagccgattgacgatcgctttgctagcgccctgaccgcgctcaatgacatgggaaaagtgcggaaggatatccagcaatgggaaccttccagaggctggaacgactggacacaggtccccttctgctctcaccactttcatgagctggtgatgaaagatgggcgcgtccttgtggttccctgtcggaaccaggacgaactgatcggcagagcccgcattagccagggagctggctggtccctcaaggagaccgcctgcctggggaagtcttatgctcaaatgtggacactgatgtacttccacaaacgggatctcagactggccgctaatgccatctgtagcgcggtgccttcccattgggtcccgaccagccgcacaacctggtctattcacgccaagcacgagtggatgacgacagaagacatgcttgctgtgtggaaccgggtgtggatccaggagaatccctggatggaagataaaacccctgttgagtcctgggaagaggtgccctatctgggaaagagagaggaccagtggtgcggcagcctcattgggctgacctctcgcgccacatgggccaaaaacatccagaccgctattaatcaagtccggtcccttatcggaaacgaagagtacacagactatatgcctagcatgaagagatttcggagagaagaggaagaggccggcgtgctgtggtga

SEQ ID NO: 20335 - RNA, 9876 nt, synthetic construct
  misc_feature 1..9876: note = derived and/or modified CDS sequence (opt5) from DENV-2__AY702040__SS-prME
  source 1..9876: mol_type = other RNA
acagccggaatgatcattatgctgatccccacagtgatggctttccacctcacgaccagaaacggggagcctcatatgattgtcagccggcaggaaaagggaaagagcctgctttttaagacaaaggacggaaccaatatgtgcacactgatggccatggatctcggggagctgtgtgaagacaccatcacatacaagtgcccgttccttaaacaaaacgagcccgaagatattgactgttggtgcaattctaccagcacgtgggttacctatggaacatgtaccacaaccggcgagcaccgcagagagaagcggtccgtggcgctggtgcctcatgttgggatgggactcgaaacgcgcacagagacctggatgtctagcgaaggcgcttggaagcacgcccagagaatcgagacatggatcctgcggcatcccggctttaccattatggccgctatcctggcctacaccattgggacaacgcacttccagcgcgtgctcatctttattctgcttaccgctatcgccccttccatgacaatgagatgcattggaatctctaaccgggatttcgttgagggcgtgagcgggggatcctgggtcgacatcgtgctggaacacggcagctgtgttaccacaatggcgaaaaataagcccaccctcgattttgagctgattaaaacggaagccaagcagcctgctacacttcgcaaatattgcatcgaggccaagctgaccaacaccacaaccgactctagatgtccgacacaaggggaacccacgctcaatgaggagcaggataagcggttcgtgtgcaaacattccatggtcgaccgcggatggggcaacggctgtgggctgtttggaaagggcgggattgtgacctgcgctatgttcacatgcaaaaagaatatggaaggaaaaatcgtgcagcctgagaacctggaatacaccgtcgttattacaccccacagcggcgaggaacatgccgtggggaatgataccggaaagcacggcaaagaggtgaagatcacgcctcagtcttccatcaccgaggcggaactcacaggctatgggaccgtcacaatggagtgtagccccagaaccggactggactttaacgaaatggtgcttctgcaaatggaggataaggcctggctcgttcaccggcagtggttcctggaccttccgctgccttggctccccggcgctgacacgcaggggtctaattggattcagaaagaaacactggtgacctttaagaaccctcatgccaaaaagcaagatgtcgtggttctgggatcccaggagggcgctatgcacacagccctcaccggggccaccgagatccagatgagctccggcaatctgcttttcacaggacatctgaaatgccgcctcagaatggacaagctgcaacttaagggcatgtcttacagcatgtgtacggggaaattcaagattgtgaaagaaatcgctgagacccagcacggaacaattgtcatccgggtgcagtatgaaggcgatgggtccccctgcaagatcccctttgagattatggacctggagaaaagacatgtcctcggacgcctgatcaccgtgaaccctattgttacagaaaaggatagcccggtgaacatcgaggcggaaccccctttcggcgactcttacattatcattggggtcgagcccggccagctgaagctcgattggtttaaaaagggatccagcatcggccaaatgttcgaaaccacgatgagaggggccaaaagaatggctatcctgggagacacagcctgggattttggctctcttgggggagtgttcaccagcattggcaaggccctgcaccaggtttttggggctatctacggcgccgcgttctccggagtgtcttggaccatgaaaattctcatcggcgtcattatcacatggatcgggatgaatagccgctccaccagcctgtctgtgtccctggtgcttgttggaattgtcacactctatctgggcgtgatggtgcaggctgacagcgggtgtgtcgtgtcttggaagaacaaggagctgaaatgcggatccggcatctttgttacggataatgtgcacacctggacagagcagtacaagttccaacctgaaagcccctccaaactcgcctctgccattcagaaggctcatgaggaagggatctgtggcattcggagcgtcaccagactggagaaccttatgtggaaacagatcacatccgaactgaatcacatcctctctgagaacgaggtgaagctgaccattatgacgggagacatcaaaggcattatgcaggttgggaagcgcagcctgcggccgcaacctaccgaacttagatattcctggaagacatggggaaaagccaagatgctcagcaccgagctgcataatcagacatttctgatcgacggccccgaaaccgctgagtgccctaacacaaatcgcgcctggaactctctcgaagtggaggattacgggttcggagtctttaccacgaatatttggctgcggcttagagagaaacaggacgcgttctgtgatcccaagctgatgtccgccgctatcaaagacaaccgcgccgtgcacgctgatatgggctattggatcgaaagcgccctcaatgacacatggaagattgagaaggcgtctttcatcgaagttaaatcctgccactggcctaagagccataccctgtggtctaacggcgtgctggagagcgagatggtcattcccaaaaattttgccgggccggtgtcccagcacaacaaccggcctggataccatacccaaacagctggcccctggcaccttgggaagctcgaaatggatttcgacttttgtgagggaaccacggtggtcgttacagaagagtgcggcaatagagggcccagcctgcggaccacaaccgcctctggaaaactgatcacagaatggtgctgtcgctcctgcaccctccctccgctgagatatcggggcgaggatggctgttggtacgggatggagattagaccccttaaggaaaaggaggaaaacctggtgagctccctcgtgacggctggacatggccagatcgacaatttctctctggggattctgggaatggccctttttctcgaggaaatgctgcgcacccgggtcggcacaaaacacgccatcctgctcgtggctgttagcttcgtgaccctgatcacagggaacatgtcctttagagatcttggacgcgtcatggtgatggttggcgcgaccatgacggacgatattggcatgggggtgacatacctggccctcctggctgccttcaaggtcagacctacctttgccgctggactgcttctgcggaaactcacatctaaggagctgatgatgaccaccatcggcattgtgctcctgagccagtcctctatccccgagacaattcttgaactgacggacgccctcgcgctggggatgatggttctgaaaatggtgcgcaatatggagaagtatcaacttgctgtcaccatcatggccatcctgtgcgtgcctaacgccgtgattctccagaatgcttggaaggtcagctgtacaatcctggccgttgtgtccgtgagccccctcctgcttacctcttcccagcagaaagcggactggattcctctggctctcacaatcaagggactgaaccccaccgccattttcctgacgacacttagcagaacctctaaaaagcggtcctggccgctgaatgaagccatcatggctgtcggcatggtgagcatcctcgcctcttccctgctcaaaaacgatattcctatgaccgggcccctggttgctggaggccttctgacagtgtgctacgtcctgaccggccgcagcgccgacctcgagctggaaagagcgacagatgtgaagtgggacgatcaagccgagatctccgggagctctcctattcttagcatcattatctccgaggacggatctatgagcattaaaaatgaagaggaggaacagacgctgaccatcctcatccggacaggcctgctcgttatttccgggctgtttcccgtgtctatcccgattaccgctgccgcttggtatctttgggaggtcaagaagcagcgcgccggagtgctgtgggatgtcccttctccccctcccgtgggcagagccgaactggaggacggggcttaccggatcaaacagaagggcattctcggctattcccaaatcggcgcgggggtttacaaagaaggaacattccacaccatgtggcatgtgacgcgcggcgccgtcctgatgcacaaggggaaaagaatcgagccctcctgggctgatgtgaagaaggaccttattagctatggaggcgggtggaaactggaaggagagtggaaggagggcgaagaggttcaggtgctcgccctggaacctggcaaaaacccgcgggccgtccagaccaagcccgggctctttagaacaaataccggaacaatcggcgctgtgtccctggatttcagccctgggacctctggatcccccattgtggacaaaaagggcaaggttgtcgggctttacggaaacggcgtggtgacacgcggcggggcctacgtcagcgcgatcgctcagacggagaaatctattgaagataatcctgagatcgaggacgacatcttccggaagagacgcctgaccattatggatctgcatcccggagccggcaaaacaaagcggtatctccctgccatcgtgagagaagctattaaacgcgggctgcggacccttatcctggccccgaccagagttgtggcggctgagatggaagaggccctccgcggactgcccattcggtaccaaacccctgccatcagagctgaacacacgggccgggagattgtcgacctcatgtgtcatgccacctttacaatgcgcctgctttcccccatcagagtgcctaactataacctgatcattatggatgaggctcacttcaccgaccccgccagcatcgcggcccgggggtacatttccacacgcgttgaaatgggcgaggctgccggaatctttatgaccgctacgccgcctggctctagagatcccttcccccagagcaatgcccctattatggacgaggaacgggagatccccgaaagatcctggaacagcgggcacgagtgggtgacagattttaagggaaagaccgtctggttcgtgccttctatcaaaaccggcaatgacattgccgcttgcctgcgcaagaacgggaaacgggttatccagctctccagaaagacatttgatagcgaatatgtgaaaacccgcacaaatgactgggatttcgtcgtgaccacggacatttctgagatgggagcgaactttaaggccgaacgggtgatcgacccgagacgctgtatgaagcccgtcattctgacagatggcgaggagcgggttatccttgctgggcctatgcccgtgacccatagctccgccgcccaaagacgcggcagaatcggacggaatcctcgcaacgaaaatgaccagtacatttatatgggcgagcccctggaaaacgatgaggactgcgctcactggaaagaagccaagatgctcctggataatatcaacacaccggaggggattatcccttctatgttcgagcccgaaagagagaaagtggacgcgattgatggagaataccggctgcgcggcgaggctagaaagacctttgtcgacctcatgcggagaggggatcttcctgtgtggctggcctacaaagttgccgctgaaggaatcaattatgccgaccgccggtggtgtttcgatggcacgagaaacaatcagattctggaggagaacgtggaagtcgagatctggaccaaggaaggggagcgcaaaaagctcaagccccggtggctggacgcgagaatctacagcgatcctcttgccctgaaagagttcaaggaatttgctgccggccggaaatccctcacactgaacctgattaccgagatgggacgcctccccacattcatgacccagaaggctagagacgcccttgacaatctggctgtgctgcatacagccgaagcgggcgggaaagcctataaccacgctctctctgagctgccggaaacccttgagacgctgctcctgctgacactccttgccaccgttaccggaggcatctttctgttcctgatgagcgggcggggaattggcaagatgacactcggcatgtgctgcatcattaccgcttccatcctgctttggtacgcccaaatccagcctcactggattgccgctagcatcattctggagtttttcctcatcgtgctgctgattcccgaacccgagaagcagcgcacacctcaggataatcaactcacgtatgtcatcatcgcgattcttaccgtggtcgccgctacaatggccaacgaaatggggtttctggagaaaaccaagaaagacttcggactgggccatatcgccacacagcagccggaatctaatattctcgatatcgacctgagacccgcttccgcctggaccctttacgcggtggccacgacctttattacacctatgctgcggcacagcatcgagaactcctctgttaatgtgagcctcaccgctattgccaaccaggctacagtgctgatggggctgggaaagggctggcccctctccaaaatggatatcggggtccctcttctggccatcggatgttattctcaagttaatcccattaccctgacggcggccctcctgcttctggtggctcattacgccatcattggccctggcctccaggctaaggccacacgcgaggctcagaagagagccgcggccgggatcatgaaaaacccgaccgtggacggaattacagtcatcgatctggaccccatcccttacgatcccaagttcgaaaaacagctgggccaagtgatgctccttgttctgtgcgtgacccaggtcctgatgatgcggaccacatgggctctctgtgaggccctgacgcttgctaccgggcctgtgagcacactgtgggaaggaaatcccggccgcttttggaacaccacaattgccgtctccatggccaatatcttcagagggagctatctcgcgggagctggcctgctgttttctattatgaagaacaccacgtccgcccggagaggcacagggaatatgggagagaccctcggcgaaaaatggaaaagccgccttaacgctctggggaagtctgagttccagatctacaaaaagtccggcattcaagaggtggaccggaccctggccaaagaaggcatcaagagaggggagacagatcaccatgccgttagccgcggatctgctaaactccggtggttcgtggaaagaaatctggtcaccccggagggcaaggtggttgaccttggctgcgggcgcggaggctggagctattactgtgggggactgaaaaacgtgcgggaggtcaagggcctcacaaaagggggacctggccacgaggaacccatccccatgtccacgtatggctggaacctggtgagactgcagtctggggtggatgtctttttcgtccctcccgaaaaatgcgacaccctcctttgtgacattggagagagctcccctaatccgacagtggaagccggccgcaccctgcgggtgctgaacctcgtcgagaattggctgaacaataacacacagttttgcgttaaggtgcttaatccctacatgcctagcgtgatcgagagaatggaaaccctgcagcgcaaatatgggggagcgctcgtccggaaccccctgtccagaaattctacgcacgagatgtactgggtgagcaacgcctccggcaatattgtttctagcgtgaacatgatctcccgcatgctgattaatagattcaccatgcggcataagaaagctacatacgaacctgatgtcgacctcgggtctggaacccgcaacatcggcatcgagagcgaaacacccaatcttgatattatcggcaagagaattgagaagatcaaacaagagcacgaaacctcctggcattatgaccaggatcacccgtacaagacatgggcctatcacgggagctacgagaccaaacagacgggatctgcttccagcatggtgaacggcgttgtgcggctgctgacaaagccttgggacgtcattcccatggtgacccagatggccatgaccgatacaacgccttttgggcaacagagagtgttcaaagaaaaggtcgacacccggacacaggagcccaaggaaggaaccaaaaagctcatgaaaatcacagcggagtggctgtggaaggagcttggcaaaaagaagacccctcgcatgtgtacaagagaagagtttaccaaaaaggttcggtctaacgccgctctgggggccattttcacggatgaaaataaatggaagtccgctcgcgaggccgtggaggacaacagattttgggaactcgtggataaagagcggaatctgcatctggaaggaaagtgcgagacctgtgtctataacatgatgggcaaacgcgaaaagaagctcggcgagttcgggaaagctaagggaagcagagccatctggtacatgtggctgggcgcgcggtttcttgagttcgaagccctggggtttctcaatgaggaccactggttctctcgcgaaaactccctgagcggagtggagggcgaagggcttcataaactgggctatatcctcagagaggtttccaagaaagagggaggcgctatgtacgccgacgatacagctgggtgggacacccggattacaatcgaagatctgaagaatgaggaaatgattaccaaccacatggccggagagcataagaaactggccgaagcgatcttcaagctcacgtaccagaataaagtggtccgcgtgcaaagacccacaccgcggggcaccgttatggacattatcagccgcaaggatcagagagggtctggacaggtgggcacatatgggctgaacacctttacgaatatggaggctcaacttatccggcagatggagggcgaaggaattttcaaaagcatccagcacctgaccgcctccgaggaaattgccgtccaggactggctcgtgagagttggccgcgagcggctgtctagaatggctatcagcggggatgactgcgtggtcaagcctcttgatgaccgctttgccaaggctctgacagccctcaacgatatgggaaaagtgcggaaggacattcaacagtgggagccctccagaggctggaatgattggacccaggtccccttctgctctcaccattttcacgaactgatcatgaaagacgggcgcacactggtggttccttgtcggaaccaggacgagctcatcggacgggcgcgcattagccaaggcgccgggtggtccctgcgggaaaccgcttgccttggcaagtcttacgcccagatgtggagcctgatgtatttccatagacgcgatctccggctggctgccaatgcgatctgttccgccgtgccgagccactgggtccccacatctagaaccacgtggtccattcacgctagccatgagtggatgacaaccgaagacatgcttaccgtgtggaaccgggtgtggatcctggagaacccttggatggaggataaaacacccgttgaatcttgggaggaaattccttacctcggaaagagagaggaccagtggtgcggctccctgatcgggctgaccagccgcgccacatgggctaagaatattcagacggccatcaaccaagtgcggtccctcatcggaaatgaagagtataccgattacatgccctctatgaaaagatttcgcagagaggaagaggaagctggcgtcctgtggtga

SEQ ID NO: 20336 - RNA, 9876 nt, synthetic construct
  misc_feature 1..9876: note = derived and/or modified CDS sequence (opt5) from DENV-2__AY037116__SS-prME
  source 1..9876: mol_type = other RNA
accgccggcatcattatcatgatgattcccacagtgatggctttccacctgacgacccggaatggggagcctcatatgatcgtgagccggcaggaaaagggaaagtccctcctgtttaagacagagaatggcgttaacatgtgcacccttatggccatggacctgggggaactctgtgaggatacaattacctacaattgcccgctgcttcgccaaaacgaacccgaggacatcgattgtggatgccactctacaagcacctgggtgacgtatggcacctgtacagcgaccggggagcatcggcgggaaaagcgctccgtggctctggtccctcacgtgggaatgggcctcgagacaagaaccgaaacgtggatgtctagcgagggcgcctggaagcatgcccagcggatcgagacatgggttctgcgccaccccgggttcaccattatggctgccatcctggcttacacaattggaaccacctattttcagagagtgctcatcttcattctgcttacagccgtcacgccttccatgaccatgcggtgcatcggcatttctaatcgcgactttgtggaaggggttagcggaggctcctgggtggatatcgtcctggagcacgggagctgtgtgacaaccatggcgaagaacaagcccacactcgacttcgaactggtgaagaccgaggccaaacatcctgctacgcttagaaagtactgcatcgaagccaaactgacaaataccaccacagcttctcggtgtccgacccagggagagccctccctcaacgaggaacaagataagcgctttgtctgcaaacacagcatggttgacagaggctggggcaatgggtgtggactgttcggcaaagggggaattgtgacatgcgccatgtttacgtgcaagaaaaacatggagggcaaggtggtccagcctgaaaatctggagtataccatcgtgattacaccccattctggggaagagaacgcggttggaaatgataccggcaaacacggcaaggagatcaaagtgacacctcagtccagcattaccgaagccgagctcacggggtacggaaccgtcacaatggaatgttctccccggaccggcctggacttcaacgagatggtgcttctgcagatggaaaataaggcttggctcgttcaccgccaatggtttctggatcttccgctgccttggctccccggggccgacacacagggatccaactggatccagaaagagaccctggtgacgttcaagaaccctcatgctaagaaacaggatgtcgtggtcctgggcagccaagagggggccatgcacacagccctcaccggcgctacagaaatccagatgtcctctggaaatctgctttttaccggccatctgaagtgcagactccggatggacaaactgcagcttaaggggatgagctattccatgtgtaccggaaaattcaaggtggttaaggagattgcggaaacacaacacggcacgatcgtgattagagtccagtacgagggggacggaagcccctgcaaaatccccttcgagattatggatctggaaaagcgccatgtgctcggccggctgatcaccgttaaccctatcgtgacagagaaagactctccggtcaatattgaagccgagcccccttttggggattcctacatcattatcggcgtggaacccggacagctgaagctcagctggttcaaaaagggctctagcattgggcagatgtttgagaccacaatgagaggagctaagcgcatggccatcctgggcgacaccgcctgggatttcgggtcccttggaggcgtgtttacgtctattgggaaagctctgcaccaagttttcggcgccatctatggagcggcttttagcggcgtctcctggacaatgaagatcctcattggggtggtgatcacctggattggaatgaacagccggtctacctccctgagcgtctctctggtgcttgttggcgtggtcacactctacctgggggtgatggttcaggccgactccggatgtgtggtcagctggaaaaataaggagctgaaatgcggctccgggatcttcattaccgataacgtgcacacatggacggaacagtataagtttcagcctgagtctcccagcaagctcgcctccgctatccaaaaagcccatgaagagggcatctgtggaattagatctgttacccgcctggaaaatcttatgtggaagcagatcacaccggagctgaaccacattctcagcgagaatgaagtgaaactgaccatcatgacaggcgacattaaggggatcatgcaggctggaaaacggtccctgagacctcagcccaccgagcttaagtacagctggaaagcctggggcaaggcgaagatgctctctacggaactgcataaccacaccttcctgatcgatgggcctgagacagccgaatgccccaataccaaccgcgcttggaatagcctcgaggtcgaggactatggatttggcgtgttcacaaccaacatttggctgaaacttaaggaacggcaagatgtgttttgtgacagcaaactgatgtctgccgctatcaaggacaatagagccgtccacgcggatatgggctactggattgagtccgccctcaacgacacatggaaaatcgaaaaggctagcttcattgaggttaagtcttgccattggcctaaaagccacaccctgtggtccaacggggtgctggagagcgaaatgatcatccccaagaatttcgccggaccggtgtctcagcataactatcgccctggctaccacacgcagacagctgggccctggcatcttggacggctcgagatggattttgacttctgtgaaggcaccaccgtcgtggttacagaggattgcgggaatagaggaccctccctgcggaccacgacagccagcggcaaactgattaccgaatggtgctgtcgctcctgcacactccctccgctgagataccggggcgaggacgggtgttggtatggaatggagatcagaccccttaaggaaaaagaggaaaacctggtcaattctctcgtcaccgccggccacgggcagattgataactttagcctgggagtgctgggcatggctcttttcctcgaggaaatgctgcgcacacgggttgggaccaagcacgcgatcctgctcgtggccgtctcctttgtgacgctgattaccggaaatatgtctttcagagaccttggccgcgttatggtgatggtcggcgctacaatgaccgatgacatcgggatgggagtgacatacctggccctcctggccgcttttaaggtgagacctaccttcgccgcgggcctgcttctgcggaaactcacgagcaaggagctgatgatgacaaccattgggatcgtcctcctgtcccaatctacaatccccgagaccattcttgaactgaccgatgcttgggccctcggaatgatggttctgaaaatcgtgcgcaacatggagaagtatcagctggccgtgacaattatggctatcctttgcgtccctaatgccgtgattctgcagaacgcgtggaaagttagctgtacgaccctcgctgtggtctccgtgagccccctgctcctgacatcttcccaacagaaggccgactggatccctcttgccctgaccatcaagggcctcaatcccacagctatttttctgaccacgctgagcagaacatctaaaaagcggtcctggccgcttaacgaagccatcatggctgttgggatggtgagcattctggcctcttccctcctgaaaaatgatatccctatgaccggacccctcgtcgcgggcggcctgcttaccgtgtgctacgtcctgacagggcgcagcgccgacctggagctcgaaagagctgccgacgtgcggtgggaggagcaggctgaaatttccggaagctctcctatcctgagcatcaccatttccgaggatggctctatgagcatcaagaacgaagaggaggaacagacacttacgattctgatccgcaccgggctcctggttatttccggactcttccccgcctctatcccgattacagccgctgcgtggtatctgtgggaggtgaaaaagcaaagagccggcgtcctttgggacgtgccttctccccctcccgttgggaaagctgaactggaggatggagcctaccggatcaagcagaagggcatcctgggctattcccagattggggccggagtgtacaaagaaggcacctttcatacaatgtggcacgtcacccgcggggctgtgctcatgcataagggaaaaagaatcgagccctcctgggccgacgtgaagaaagatctgattagctacggcgggggatggaaacttgagggcgaatggaaggagggcgaagaggttcaggtcctggcgctcgaacctgggaaaaatccgcgggctgtgcaaacgaagcccggactgttcaaaaccaacacaggcaccatcggggccgtgtccctcgactttagccctggaacatctggctcccccattgtcgataagaaagggaaggtggttggactgtatggcaacggcgtggtcaccagaagcggggcctacgtgtctgctatcgcccagacagagaagtccatcgaggacaatcctgaaattgaggatgacatcttccgcaaaaagcggcttacgattatggatctgcaccccggagcgggcaaaaccaagagatatctgcctgctatcgttcgcgaagccattaaacgggggctcagaacactgatccttgccccgacccgcgtggtcgctgccgagatggaagaggctctgcggggactccccatcagataccagacccctgccattcgcgcggagcatacaggccgggaaatcgtggacctgatgtgtcacgccacgttcaccatgagactcctgagccccattcgggttcctaactataatcttatcattatggatgaggctcactttacagaccccgcctccatcgctgcccgcgggtacatttctaccagagtggaaatgggcgaggccgctggaatcttcatgacagcgaccccgcctggcagccgggacccctttccccagtccaacgcccctatcatggatgaggaacgcgagattcccgaaagaagctggaactctgggcatgagtgggtcacggacttcaagggaaagacagtgtggtttgtgccttccatcaaagctggcaacgatattgccgcctgcctgcggaagaatgggaaaaaggtcatccaactgagcagaaaaaccttcgactctgaatatattaagacccgcacaaacgattgggactttgttgtgaccacagatatcagcgagatgggagctaatttcaaggccgagcgggtgatcgacccgagacgctgtatgaaacccgtcattctcaccgatggcgaagaacgggtgatcctggcggggcctatgcccgttacgcactcctctgctgcccagagacgcggccgggtgggaagaaaccctaagaatgaaaacgaccagtacatttacatgggcgagccccttgaaaatgatgaggactgcgcccattggaaagaggctaagatgctgctcgacaacatcaatacaccggaagggattatccctagcatgtttgagcccgaacgcgagaaagtcgatgccatcgacggagaatatagactgcggggcgaggcgcgcaagaccttcgtggatctgatgagaagaggggacctccctgtttggcttgcctaccgcgtggctgccgagggaattaactatgctgatagacggtggtgttttgacggcgtcaaaaacaatcaaatcctggaagagaacgtggaagtcgagatttggacaaaggagggggaaagaaagaaactgaagccccgctggctcgatgcccggatctactccgaccctctggctcttaaagagttcaaggagttcgccgcgggcagaaaatctctgaccctcaatctgattacggagatgggacgcctgcccacctttatgacacagaaggcccggaacgctctcgataatcttgccgtgctgcacaccgctgaagccggcgggagagcctataaccacgctctgagcgagctcccggagacactggaaacccttctgctcctgacactgctcgcgaccgttacgggaggcatcttcctttttctgatgtccgggaagggaattggcaaaatgacactgggcatgtgctgcatcatcaccgccagcattctcctgtggtacgctcagatccagcctcattggattgccgcctctatcattcttgagttctttctgatcgtgctcctgatccccgaacccgagaagcaacggacccctcaggacaatcagctgacatatgtggtcattgctatcctcaccgttgtggccgcgacaatggccaacgaaatggggttccttgagaaaacgaagaaagattttggactgggctccattgctacccagcaaccggagagcaatatcctggacattgatctccgccccgcctccgcttggacactgtacgccgtggcgaccacattcatcacccctatgcttagacactctatcgaaaacagctccgtcaatgtgtctctgacggccattgctaaccaggccaccgttctcatggggctgggaaagggctggcccctgagcaagatggacatcggggtgcctctccttgctattggatgttactcccaggtcaatcccatcacactgaccgccgctctgctcctgcttgtggcccattatgcgattatcggccctggcctgcaggccaaagctacacgggaggcccaaaagcgcgctgccgccgggattatgaaaaacccgaccgtcgacggaatcacggtgatcgatctcgaccccattccttacgatcccaagtttgaaaaacagctgggccaggttatgctgctcgtgctttgcgtcacacaggtgctgatgatgagaaccacatgggcgctgtgtgaggctctcaccctggccaccgggcctatcagcacactttgggaaggaaatcccggccggttctggaacacgaccattgctgtttctatggccaatatctttcgcgggtcctatctggccggagctggcctcctgttcagcattatgaagaacacagccaacaccagacggggcacagggaataccggagagacgctgggcgagaagtggaaaaaccgcctcaatgcgcttgggaagtctgaatttcaaatctacaaaaagtccggaatccaggaggtggacagaacactggccaaagaaggcattaagagaggggaaaccgatcaccatgctgtcagcagaggatctgccaaactgcgctggttcgtggagcggaacctcgtgaccccggaaggcaaggttgtcgacctgggctgcgggagaggaggctggagctattactgtgggggacttaagaatgtgaaagaggtgaagggcctgacaaaagggggacctggccacgaggagcccatccccatgtccacctatggctggaacctcgtccgcctgcagtctggggttgatgtgttctttacacctcccgaaaagtgcgacacgctgctctgtgatattggagagagctcccctaatccgaccgtggaggctggccggacacttagagtcctgaacctggtggaaaattggctcaacaataacacccaattctgcatcaaagttctgaatccctacatgcctagcgtgattgagaagatggaagcccttcagcgcaagtacgggggagcgctggtccggaaccccctctccagaaattctacacacgagatgtattgggtgagcaacgcctccggcaacatcgtttctagcgtgaatatgatctcccgcatgctgattaaccggtttaccatgagacataaaaaggctacgtacgaacctgacgtcgatctggggtctggaacccgcaatatcggcattgagagcgagacacccaacctcgacatcattggcaaacggatcgaaaagatcaaacaggagcacgaaacctcctggcattatgatcaggaccacccgtacaagacatgggcctatcacgggagctacgagaccaagcaaacaggatctgcttccagcatggtgaatggcgtggtcagacttctgaccaaaccttgggacattatccccatggttacgcagatggccatgacagataccacccctttcgggcagcagcgcgtgtttaaggaaaaagtggacacaagaacgcaagagcccaaggagggaaccaaaaagctgatgaagattacagctgaatggctctggaaagagctgggcaagaaaaagacccctcggatgtgtacacgcgaagagttcaccagaaaagtccggtctaacgccgcgcttggggccatctttacagatgagaataagtggaaatccgctagagaagccgtggaggacagcggattctgggaactggttgataaggagcggaacctccatctggaaggcaagtgcgagacctgtgtgtataatatgatgggcaaacgcgagaagaaactgggggaatttggaaaggctaaaggctctagagccatttggtacatgtggctcggggcccggttcctggagtttgaagcgcttggattcctgaacgaggaccactggttttcccgcgaaaatagcctctccggcgtcgagggggagggcctgcataaacttggatacatcctgagagatgtgagcaagaaagaaggcggggctatgtatgccgacgatacggccggatgggacacccggattacactcgaggatctgaagaacgaagagatggttaccaatcacatggaaggcgagcataaaaagctggctgaggccatcttcaaactcacataccagaacaaggtggtccgcgtgcagagacccaccccgcgggggacggttatggacatcatttctcgcagagaccagcggggaagcggccaagtggtcacatatgggctgaataccttcacaaacatggaagctcagcttatccgccagatggagggcgaaggagtgtttaagtccattcaacacctgaccgtcacggaggagatcgccgtgaaaaactggctcgttagagtgggccgggaacgcctgtctagaatggcgattagcggggatgactgcgtcgtgaagcctcttgatgaccggttcgcctccgctctgaccgccctcaatgatatgggaaaagtgagaaaggacatccagcagtgggagccctctcgcggctggaacgattggacacaggttcccttttgcagccaccatttccacgaactgatcatgaaagacgggcgggtgctggtcgtgccttgtagaaatcaagatgagctcattggacgcgctcggatctcccagggcgccgggtggtctctgagagaaaccgcgtgccttggcaagagctacgcccagatgtggtccctgatgtattttcatcgccgggacctcagactggctgccaacgctatttgtagcgccgttccgtctcactgggtgcccacatcccgcaccacatggagcatccacgctacccatgagtggatgacgacagaggatatgcttaccgtctggaatcgggtgtggattcaggaaaacccttggatggaggacaagacccccgtcgaatcttgggaggaaatcccttacctgggaaaaagagaggatcaatggtgcggctccctcatcgggctgacaagccgcgccacctgggcgaagaatattcagacagccatcaaccaggtgcggtccctgattggaaatgaggaatatacggactacatgccctctatgaaaagattccggagagaggaagaggaagctggcgttctctggtga

SEQ ID NO: 20337 - RNA, 9876 nt, synthetic construct
  misc_feature 1..9876: note = derived and/or modified CDS sequence (opt5) from DENV-2__AF169678__SS-prME
  source 1..9876: mol_type = other RNA
tccgccggaatgatcattatgctgatccccaccgtgatggctttccacctgacaacgcggaatggggagcctcatatgattgtctccatccaggaaaagggaaaatctctgctttttaagaccgaggacggcgttaatatgtgcacactgatggccatggatctcggggaactgtgtgaggacaccattacatacaaatgcccgcttctgcggcaaaatgaacccgaggatatcgactgttggtgcaatagcacctccacatgggtgacctatggaacgtgtaccacaaccggcgagcaccgccgggaaaagcggtctgtggcgctcgtccctcatgtggggatgggactggagacacgcaccgaaacgtggatgtcctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaggacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcaaaatccccttcgaaatcatggacctcgagaagagatacgttctgggacgcctgattacggtgaaccctatcgtcaccgaaaaagattccccggtgaacattgaggccgaacccccttttggcgacagctacatcattatcggggttgagcccggccagctcaagctgaattggttcaagaaaggatctagcattggccaaatgtttgagacaaccatgagaggggctaagagaatggccatccttggagatacagcctgggacttcggctccctcgggggagtgtttacctctatcggcaaagctctccatcaggtcttcggggccatttatggcgcggcttttagcggagtgtcctggacgatgaagatcctgattggcgtgatcattacatggatcgggatgaacagccgctctacctccctgagcgtttctcttgtcctcgtgggaatcgtgaccctgtacctgggcgtcatggtgcaggccgattccgggtgtgttgtgagctggaaaaataaggaactcaagtgcggatccggcattttcatcacagacaacgtccacacctggacagagcagtataaatttcaacctgaatctcccagcaagctggcctccgctattcagaaagcccaggaggaagggatctgtggcattcggtctgtgacgagacttgagaatctgatgtggaagcagatcaccccggagctcaaccacatcctggctgaaaatgaggttaaactgacaattatgaccggagatatcaagggcattatgcaagccgggaaacgcagccttcggcctcagcccacagaactcaagtactcctggaagacctggggaaaagcgaagatgctgagcacggagtctcataaccagaccttcctgatcgacggccctgaaacagccgagtgccccaataccaacagagcttggaactccctcgaggtggaagattatgggtttggagtcttcacaaccaacatttggctgaaacttaaggagaaacaggacgccttttgtgacagcaagctgatgtctgctgccatcaaggataatcgcgcggtgcacgccgacatgggctactggatcgaatccgctctcaacgatacatggaaaattgagaaggccagcttcatcgaggttaaaaattgccattggcctaagtctcacaccctgtggagcaacggcgtgctggaatccgagatgattatccccaaaaaccttgctgggccggtcagccaacacaattatcggcctggataccatacgcagattgccggcccctggcacctcgggaagctggaaatggacttcgatttttgtgacggaacaaccgtggtggtcaccgaggattgcggcaacagagggccctctctgcgcacaaccacggcctccggaaagctcatcacagaatggtgctgtcggagctgcaccctgcctccgcttagataccggggcgaggacggctgttggtatgggatggagattcgccccctgaaagaaaaggaggaaaatctcgttaactccctggtgacagctggacatggccaggtggataatttctctctgggggtccttggaatggcgctctttctggaggaaatgctgagaacccgggtgggcacaaaacacgccatcctcctggttgctgtgagcttcgtcacccttatcacggggaacatgtcctttaaggacctgggaagagtggttgtgatggtcggcgccaccatgacagatgacattggcatgggggtgacctacctcgccctgctggctgccttcaaagttcgccctacatttgcggctggacttctgctccggaagctgacctctaaggagctcatgatgacgacaatcggcattgtgctgcttagccaatccaccatccccgagacaattctggaactcaccgatgccctggccctggggatgatggtccttaaaatcgtgagaaatatggagaagtatcagctggctgtgaccatcatggccattctctgcgtccctaacgcggttatcctgcagaatgcttggaaagtgtcttgtacaattctcgccgtggtcagcgtgagccccctgatccttacgagctctcagcaaaagaccgactggattcctctggccctcacaatcaaaggactgaaccccaccgctatcttcctgacaaccctttcccgcacgaataagaaaagaagctggccgctgaacgaagccattatggctgttggcatggtgtctatcctcgcctccagcctgctcaagaatgacattcctatgacagggcccctggtcgcgggaggccttctgaccgtgtgctacgttctgaccggccggtctgccgatctcgagctggaacgcgctgccgacgtgaagtgggaggatcaggctgagatctccgggagctcccctattcttagcatcacaatttctgaagacggaagcatgtccatcaaaaacgaggaagaggagcagaccctgacaatcctcattagaacgggcctgctcgtcatctctgggctgtttcccgtgagcattccgatcaccgccgccgcttggtatctttgggaagtcaagaaacagcgggcgggagtgctgtgggatgttccttctccccctcccatgggcaaggccgagctggaagacggggcttaccgcattaaacaaaagggaatcctcggctatagccagatcggcgccggggtgtacaaggagggaacattccataccatgtggcacgtcacaagaggcgccgtgctgatgcacaaagggaagcggattgaacccagctgggctgatgttaaaaaggaccttatctcctacggaggcgggtggaaactggagggagagtggaaggaaggcgaggaagtgcaggtcctcgccctggagcctggcaagaatccgcgcgcggtgcagaccaaacccgggctctttaagacgaacaccggaacaattggcgctgtgtctctggatttcagccctgggacctccggaagccccatcattgacaaaaagggcaaagttgtcgggctttatggaaacggcgtggtgacaagatctggcgcctacgtctccgccatcgctcaaaccgaaaagagcatcgaggataatcctgagattgaagacgatatctttcggaagaaacgcctgacaattatggacctgcatcccggggccggaaagacgaaaagatatctccctgcgatcgtgcgggaggctattaagagaggcctgcgcacccttatcctggccccgacacgggttgtggccgctgaaatggaggaagccctcagagggctgcccattcgctaccagacccctgctatccgggccgagcacaccggaagagagatcgtcgacctcatgtgtcatgcgacattcacgatgcgcctgctttctcccgtgcgggttcctaactataatctgattatcatggatgaagcccacttcaccgaccccgcttccattgccgctagaggctacatcagcacacgcgtggagatgggggaagccgccggcatttttatgaccgctacaccgcctggatcccgggatcccttcccccagtctaacgcgcctatcatcgacgaggagagagaaattcccgagcggagctggaactccggccatgaatgggtcaccgattttaaagggaagacggtgtggttcgttcctagcatcaaggccggaaacgacattgctgcctgcctgcgcaaaaatggcaagaaagtgatccaactctctagaaagacatttgattccgagtatgtcaaaacccggaccaacgactgggatttcgtggtgacaaccgacattagcgaaatgggggccaattttaaggctgagcgcgtcatcgatccgagacggtgtatgaaacccgttatcctgacagacggagaggaaagagtgattcttgccggccctatgcccgtgacccactctagcgcggctcagcgccgggggagaatcggccgcaaccctaagaatgagaacgaccagtacatttacatgggagaacccctggagaatgatgaagactgcgcccactggaaggaggccaaaatgctcctggataacatcaatacgccggagggcattatcccttccatgttcgaacccgagcgggaaaaggtcgacgctattgatggggagtatagactgcgcggagaagcccggaaaacatttgtggacctcatgagacgcggcgatcttcctgtttggctggcgtacaaggtggccgctgaggggatcaactatgccgacagacggtggtgtttcgatggaatccagaacaatcaaattctggaggaaaacgtcgaggtggaaatctggaccaaagagggcgagcgcaagaagctcaaacccagatggctggacgctcggatttactctgatcctcttgccctgaaggaatttaaagagttcgctgccgggcgcaagagcctcacactgaatctgatcaccgaaatgggcagactccccacgttcatgacccagaaagcgcgggacgcccttgataacctggctgttctgcatacagccgaggctggaggcagagcctataatcacgccctctccgaactgccggagacccttgagacactgctcctgctgaccctccttgctacagtgaccgggggaatttttctgttcctgatgtctggccgcgggatcggaaagatgacgctcggcatgtgctgcatcattacagcgagcatcctgctttggtacgcccagattcagcctcattggatcgctgcctccattatcctggaatttttcctcatcgtcctgctgattcccgagcccgaaaagcaacggacccctcaggacaaccagctcacctatgtggtcatcgccattcttacagtggttgctgccaccatggcgaatgagatgggctttctggagaaaaccaagaaagacctggggttcggaagcatcgccacgcagcaaccggagtctaacattctcgatatcgacctgagacccgcttccgcctggaccctttacgctgtggccacaacctttgtgacacctatgctgcgccacagcattgaaaattcctctgtcaacgttagcctcaccgcgatcgccaatcaggctacggtgctgatgggcctggggaagggatggcccctctccaaaatggatatcggcgtgcctcttctggccattgggtgttactctcaggtcaaccccatcaccctgacagctgccctcctgcttctggtggctcactatgccattatcggacctggcctccaggcgaaggccacccgggaagctcaaaagagagccgctgccggcattatgaaaaatccgacagttgacgggatcaccgtgatcgatctggaccccattccttacgatcccaagttcgagaaacagctgggacaggtcatgctccttgtgctgtgcgtcacgcaagtgctgatgatgcggacaacctgggccctctgtgaagcgctgacacttgctaccggccctatcagcaccctgtgggaggggaaccccggacgcttttggaatacaacgattgccgtttccatggctaacatcttcagaggcagctatctcgccggggccggactgctgttttctattatgaagaataccacaaacacccggcgcggcacaggcaacatcggggaaaccctcggagagaaatggaagtccagacttaatgctctgggcaaaagcgagttccagatctacaagaagtctgggattcaggaagtggaccggacgctggccaaagagggaatcaagcgcggcgaaacagatcatcacgcggtctccagagggagcgccaaactccggtggtttgtggagcgcaacatgattaccccggagggaaaggttgtggacctgggctgcggcagagggggatggtcttattactgtggcgggcttaaaaatgtccgggaagtgaagggactgaccaagggcgggcctggacatgaggaacccatccccatgagcacatatggctggaacctcgtgagactgcagtccggcgttgatgtcttcttcacccctcccgagaaatgcgacacactgctctgtgatattggggaatctagccctaatccgacggtggaggctggacgcacccttcgggtgctgaacctggtcgagaattggctcaacaataacacacaattttgcatcaaggttctgaatccctacatgccttccgtgatcgagaaaatggaggcccttcagagaaagtacggcggggctctggtgcgcaaccccctcagcagaaattccacccacgaaatgtattgggtctctaacgccagcggaaatattgtgtcctctgttaacatgatcagcagaatgctgattaaccgcttcacaatgaaacataagaaggcgacctacgagcctgacgtggacctgggctccgggacgcggaatatcggaattgaatctgaggtccccaacctcgatatcattggcaaaagaatcgagaagatcaaacaggaacacgagaccagctggcactatgaccaggatcatccgtacaagacatgggcctatcacggctcctacgaaaccaaacaaacagggagcgcttcttccatggtgaatggagttgtgcgccttctgaccaagccttgggacgtcctgcccacagtgacccagatggccatgacggatacaaccccttttggccagcagcgggtgttcaaggagaaagtcgacaccagaacacaagaacccaaggaggggacgaaaaagctcatgaaaattaccgctgagtggctgtggaaggaacttggcaaaaagaagacacctcgcatgtgtacccgggaggaatttacaagaaaagttcgcagcaacgccgctctgggcgccatcttcaccgatgagaataagtggaaatctgcgagagaggccgtggaagactcccggttttgggagctcgtggataaggaacgcaacctgcatctggaggggaaatgcgaaacatgtgtctataatatgatgggaaagagagagaagaaactcggcgagttcggcaaggctaaagggagccgggccatttggtacatgtggctgggagctagatttcttgagttcgaggccctgggctttctcaacgaagaccactggttctctcgggaaaattccctgagcggggtggaaggagagggccttcacaagctggggtacatcctccgcgatgtttccaaaaaggagggcggagccatgtatgcggacgacaccgctggctgggatacgagaattaccctggaagacctgaagaacgaggaaatggtgacaaatcatatggagggggaacacaaaaagctcgccgaggccatctttaaactgacctaccagaacaaggtcgtgcgggttcagcgccccacaccgagaggaaccgtgatggatatcattagccggcgcgaccaaagaggctctgggcaggtcggaacgtatggccttaatacattcaccaacatggaggctcagctgatccggcagatggaaggggagggcgtgttcaaaaatattcaacatctcacagccaccgaagagatcgctgttcagaactggctggcccgcgtgggaagagagcggcttagccgcatggcgatttccggcgatgactgcgtcgtgaagcctctggatgacagatttgcctctgctctcacggccctgaacgatatggggaaggtccggaaagacatccagcagtgggaacccagccgcggatggaatgattggacccaagtgcccttctgctcccaccattttcacgagctgatcatgaaggacggcagagttctcgtggtcccttgtcggaaccaggatgaactgattgggagagctcgcatctctcagggagccggctggagccttcgggagacagcgtgcctggggaaatcctacgcccagatgtggtctctcatgtatttccacagacgcgacctgcggcttgctgccaatgctatttgtagcgccgtgccgtcccattgggtgcccaccagcagaacaacctggtctatccacgctaagcatgaatggatgacaaccgaggacatgctgacggtttggaaccgcgtgtggattcaagagaatccttggatggaagataaaacacccgtcgagtcctgggaagagatcccttacctcggcaagcgggaagaccagtggtgcggaagcctgattggcctgacctctagagccacctgggcgaagaacatccaggccgctatcaatcaggtgcgctccctcattgggaacgaggagtatacagattacatgcccagcatgaaacggtttagacgcgaagaggaagaggccggagttctgtggtga

SEQ ID NO: 20338 - RNA, 9876 nt, synthetic construct
  misc_feature 1..9876: note = derived and/or modified CDS sequence (opt5) from DENV-2__AF169679__SS-prME
  source 1..9876: mol_type = other RNA
tccgccggaatgatcattatgctgatccccaccgtgatggctttccacctgaccacgcggaatggggagcctcatatgattgtctccatccaggaaaagggaaaatctctgctttttaagaccgaggacggcgttaatatgtgcacgctgatggccatggatctcggggaactgtgtgaggacaccattacatacaaatgcccgcttctgcggcaaaatgaacccgaggatatcgactgttggtgcaatagcacctccacatgggtgacctatggaacgtgtaccacaaccggcgagcacagaagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaggaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcaaaatccccttcgaaatcatggacctcgagaagagatacgttctgggacgcctgattacggtgaaccctatcgtcaccgaaaaagattccccggtgaacattgaggccgaacccccttttggcgacagctacatcattatcggggttgagcccggccagctcaagctgaattggttcaagaaaggatctagcattggccaaatgtttgagacaaccatgagaggggctaagagaatggccatccttggagatacagcctgggacttcggctccctcgggggagtgtttacctctatcggcaaagctctccatcaggtcttcggggccatttatggcgcggcttttagcggagtgtcctggacgatgaagatcctgattggcgtgatcattacatggatcgggatgaacagccgctctacctccctgagcgtttctcttgtcctcgtgggaatcgtgaccctgtacctgggcgtcatggtgcaggccgattccgggtgtgttgtgagctggaaaaataaggaactcaagtgcggatccggcattttcatcacagacaacgtccacacctggacagagcagtataaatttcaacctgaatctcccagcaagctggcctccgctattcagaaagcccaggaggaagggatctgtggcattcggtctgtgacgagacttgagaatctgatgtggaagcagatcaccccggagctcaaccacatcctggctgaaaatgaggttaaactgacaattatgaccggagatatcaagggcattatgcaagccgggaaacgcagccttcggcctcagcccacagaactcaagtactcctggaagacctggggaaaagcgaagatgctgagcacggagtctcataaccagaccttcctgatcgacggccctaaaacagccgaatgccccaataccaacagagcttggaactccctcgaggtggaggattatgggtttggagtcttcacaaccaacatttggctgaaacttaaagaaaagcaggacgccttttgtgacagcaagctgatgtctgctgccatcaaagataatcgcgcggtgcacgccgacatgggctactggatcgagtccgctctcaacgatacatggaagattgaaaaagccagcttcatcgaggttaagaattgccattggcctaaatctcacaccctgtggagcaacggcgtgctggagtccgaaatgattatccccaagaaccttgctgggccggtcagccaacacaattatcggcctggataccatacgcagattgccggcccctggcacctcgggaagctggagatggacttcgatttttgtgacggaacaaccgtggtggtcaccgaagattgcggcaacagagggccctctctgcgcacaaccacggcctccggaaaactcatcacagagtggtgctgtcggagctgcaccctgcctccgcttagataccggggcgaagacggctgttggtatgggatggagattcgccccctgaaggagaaagaagagaatctcgttaactccctggtgacagctggacatggccaggtggataatttctctctgggggtccttggaatggcgctctttctggaagagatgctgagaacccgggtgggcacaaagcacgccatcctcctggttgctgtgagcttcgtcacccttatcacggggaacatgtcctttaaagacctgggaagagtggttgtgatggtcggcgccaccatgacagatgacattggcatgggggtgacctacctcgccctgctggctgccttcaaggttcgccctacatttgcggctggacttctgctccggaagctgacctctaaagaactcatgatgacgacaatcggcattgtgctgcttagccaatccaccatccccgagacaattctggagctcaccgatgccctggccctggggatgatggtccttaagatcgtgagaaatatggaaaaatatcagctggctgtgaccatcatggccattctctgcgtccctaacgcggttatcctgcagaatgcttggaaggtgtcttgtacaattctcgccgtggtcagcgtgagccccctgatccttacgagctctcagcagaagaccgactggattcctctggccctcacaatcaagggactgaaccccaccgctatcttcctgacaaccctttcccgcacgaataaaaagagaagctggccgctgaacgaggccattatggctgttggcatggtgtctatcctcgcctccagcctgctcaagaatgacattcctatgacagggcccctggtcgcgggaggccttctgaccgtgtgctacgttctgaccggccggtctgccgatctcgaactggagcgcgctgccgacgtgaaatgggaagatcaggctgagatctccgggagctcccctattcttagcatcacaatttctgaggacggaagcatgtccatcaagaacgaagaggaggaacagaccctgacaatcctcattagaacgggcctgctcgtcatctctgggctgtttcccgtgagcattccgatcaccgccgccgcttggtatctttgggaggtcaaaaagcagcgggcgggagtgctgtgggatgttccttctccccctcccatgggcaaagccgaactggaggacggggcttaccgcattaagcaaaagggaatcctcggctatagccagatcggcgccggggtgtacaaagaaggaacattccataccatgtggcacgtcacaagaggcgccgtgctgatgcacaaggggaaacggattgagcccagctgggctgatgttaagaaagaccttatctcctacggaggcgggtggaagctggaaggagagtggaaggagggcgaagaggtgcaggtcctcgccctggaacctggcaaaaatccgcgcgcggtgcagaccaagcccgggctctttaaaacgaacaccggaacaattggcgctgtgtctctggatttcagccctgggacctccggaagccccatcattgacaagaaaggcaaggttgtcgggctttatggaaacggcgtggtgacaagatctggcgcctacgtctccgccatcgctcaaaccgaaaagtccatcgaagataatcctgagattgaggacgatatctttcggaaacgcagactgacaattatggacctgcatcccggggccggaaagacgaaacggtatctccctgcgatcgtgagagaagctattaagcgcggcctgcggacccttatcctggccccgacaagagttgtggccgctgagatggaagaggccctccgcgggctgcccattcggtaccagacccctgctatcagagccgaacacaccggacgcgagatcgtcgacctcatgtgtcatgcgacattcacgatgcggctgctttctcccgtgagagttcctaactataatctgattatcatggatgaggcccacttcaccgaccccgcttccattgccgctcgcggctacatcagcacacgggtggaaatgggggaggccgccggcatttttatgaccgctacaccgcctggatccagagatcccttcccccagtctaacgcgcctatcatggacgaggaacgggagatccccgaacgcagctggaactccggccatgagtgggtcaccgattttaaagggaagacggtgtggttcgttcctagcattaaggccggaaacgacatcgctgcctgcctgcgcaaaaatggcaagaaagtgattcaactctctcggaagacatttgattccgaatatgtcaaaacccgcaccaacgactgggatttcgtggtgacaaccgacatcagcgagatgggggccaattttaaggctgaaagagtcattgatccgcggagatgtatgaaacccgttatcctgacagacggagaggagcgcgtgatccttgccggccctatgcccgtgacccactctagcgcggctcagcggagagggcgcattggccggaaccctaagaatgaaaacgaccagtacatctacatgggagagcccctggaaaatgatgaggactgcgcccactggaaggaagccaaaatgctcctggataacattaatacgccggagggcatcattccttccatgttcgagcccgaaagagagaaggtcgacgctatcgatggggaatatcgcctgcggggagaggccagaaaaacatttgtggacctcatgcgcagaggcgatcttcctgtttggctggcgtacaaggtggccgctgaagggattaactatgccgaccggcgctggtgtttcgatggaatcagaaacaatcagatcctggaggagaacgtcgaagtggagatttggaccaaagaaggcgagcggaagaagctcaaaccccgctggctggacgctagaatctactctgatcctcttgccctgaaggagtttaaagagttcgctgccgggagaaagagcctcacactgaatctgattaccgagatgggccggctccccacgttcatgacccaaaaagcgcgcgacgcccttgataacctggctgttctgcatacagccgaagctggaggccgggcctataatcacgccctctccgagctgccggaaacccttgagacactgctcctgctgaccctccttgctacagtgaccgggggaatctttctgttcctgatgtctggcagagggattggaaagatgacgctcggcatgtgctgcatcatcacagcgagcattctgctttggtacgcccagatccagcctcattggattgctgcctccatcattctggagtttttcctcatcgtcctgctgatccccgaacccgagaagcagcgcacccctcaagacaaccagctcacctatgtggtcattgccatccttacagtggttgctgccaccatggcgaatgaaatgggctttctggagaaaacaaagaaagacctggggttcggaagcattgccacgcagcagccggaatctaacatcctcgatattgacctgcggcccgcttccgcctggaccctttacgctgtggccacaacctttgtgacacctatgctgagacacagcatcgaaaattcctctgtcaacgttagcctcaccgcgattgccaatcaagctacggtgctgatgggcctggggaagggatggcccctctccaaaatggatatcggcgtgcctcttctggccatcgggtgttactctcaggtcaaccccattaccctgacagctgccctcctgcttctggtggctcactatgccatcattggacctggcctccaggcgaaggccacccgggaggctcagaagcgcgccgctgccggcatcatgaaaaatccgacagttgacgggattaccgtgatcgatctggaccccatcccttacgatcccaagttcgaaaaacaactgggacaggtcatgctccttgtgctgtgcgtcacacaggtgctgatgatgagaacaacctgggccctctgtgaggcgctgacacttgctaccggccctattagcaccctgtgggaagggaaccccggacggttttggaatacaacgatcgccgtttccatggctaacattttccgcggcagctatctcgccggggccggactgctgttttctatcatgaagaataccacaaacaccagacggggcacaggcaacattggggagaccctcggagaaaaatggaagtcccgccttaatgctctgggcaaaagcgagttccaaatctacaagaagtctgggatccaggaggtggacagaacgctggccaaagaaggaattaagcggggcgagacagatcatcacgcggtctcccgcgggagcgccaaactcagatggtttgtggaacggaacatgatcaccccggagggaaaggttgtggacctgggctgcggcagagggggatggtcttattactgtggcgggcttaaaaatgtccgcgaggtgaagggactgaccaagggcgggcctggacatgaggagcccattcccatgagcacatatggctggaacctcgtgcggctgcagtccggcgttgatgtcttcttcacccctcccgaaaaatgcgacacactgctctgtgatatcggggagtctagccctaatccgacggtggaagctggaagaacccttcgcgtgctgaacctggtcgagaattggctcaacaataacacacagttttgcattaaggttctgaatccctacatgccttccgtgatcgagaaaatggaagcccttcaacggaagtacggcggggctctggtgagaaaccccctcagccgcaattccacccacgagatgtattgggtctctaacgccagcggaaatatcgtgtcctctgttaacatgattagccggatgctgatcaacagattcacaatgaaacataagaaggcgacctacgaacctgacgtggacctgggctccgggacgcgcaatattggaatcgagtctgaagtccccaacctcgatattatcggcaaacggattgagaagatcaaacaggagcacgaaaccagctggcactatgaccaggatcatccgtacaagacatgggcctatcacggctcctacgagaccaaacagacagggagcgcttcttccatggtgaatggagttgtgagacttctgaccaagccttgggacgtcctgcccacagtgacccaaatggccatgacggatacaaccccttttggccagcagcgcgtgttcaaggaaaaagtcgacacccggacacaggagcccaaggaagggacgaaaaagctcatgaaaatcaccgctgagtggctgtggaaggagcttggcaaaaagaagacacctagaatgtgtacccgcgaagagtttacaagaaaagttcggagcaacgccgctctgggcgccattttcaccgatgaaaataagtggaaatctgcgcgcgaggccgtggaggactccagattttgggaactcgtggataaggagcggaacctgcatctggaagggaaatgcgagacatgtgtctataatatgatgggaaagagagaaaagaaactcggcgagttcggcaaggctaaagggagccgggccatctggtacatgtggctgggagctcgctttcttgagttcgaagccctgggctttctcaacgaggaccactggttctctagagaaaattccctgagcggggtggagggagaaggccttcacaagctggggtacattctccgggatgtttccaaaaaggagggcggagccatgtatgcggacgacaccgctggctgggatacgcgcatcaccctggaggacctgaagaacgaagagatggtgacaaatcatatggaaggggagcacaaaaagctcgccgaagccatttttaaactgacctaccaaaacaaggtcgtgagagttcagcggcccacaccgcgcggaaccgtgatggatatcatcagcagacgggaccagcgcggctctgggcaagtcggaacgtatggccttaatacattcaccaacatggaggctcagctgattagacagatggagggggaaggcgtgttcaaaaatatccagcatctcacagccaccgaggaaattgctgttcaaaactggctggcccgggtgggacgcgagagacttagccggatggcgatctccggcgatgactgcgtcgtgaagcctctggatgaccgctttgcctctgctctcacggccctgaacgatatggggaaggtcagaaaagacattcagcagtgggagcccagccggggatggaatgattggacccaggtgcccttctgctcccaccattttcacgaactgatcatgaaggacggcagagttctcgtggtcccttgtcgcaaccaagatgagctgatcgggcgggctagaatttctcagggagccggctggagccttcgcgaaacagcgtgcctggggaaatcctacgcccagatgtggtctctcatgtatttccaccggagagacctgcgccttgctgccaatgctatctgtagcgccgtgccgtcccattgggtgcccaccagccggacaacctggtctattcacgctaagcatgagtggatgacaaccgaagacatgctgacggtttggaacagagtgtggatccaggagaatccttggatggaggataaaacacccgtcgaatcctgggaggaaattccttacctcggcaagcgcgaggaccaatggtgcggaagcctgatcggcctgacctctcgggccacctgggcgaagaacattcaggccgctatcaatcaggtgagatccctcatcgggaacgaagagtatacagattacatgcccagcatgaaacgctttcggagagaggaagaggaagccggagttctgtggtga

SEQ ID NO: 20339 - RNA, 9876 nt, synthetic construct
  misc_feature 1..9876: note = derived and/or modified CDS sequence (opt5) from DENV-2__AF169680__SS-prME
  source 1..9876: mol_type = other RNA
agcgccggcatgatcattatgctgatccccaccgtgatggctttccacctgacaacgcggaacggggaacctcatatgattgtgtccatccaggaaaagggaaaatctctgctttttaagaccgaggacggcgttaatatgtgcacactgatggccatggatctcggggaactgtgtgaggacaccattacatacaaatgcccgcttctgcggcaaaacgaacccgaggatatcgactgttggtgcaattccacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcatcatccccttcgaaattatggacctcgagaaaagatacgttctgggacgcctgatcacggtgaaccctattgtcaccgaaaaggattccccggtgaacatcgaggccgaacccccttttggcgacagctacattatcattggggttgagcccggccagctcaaactgaattggttcaagaagggatctagcatcggccaaatgtttgagacaaccatgagaggggctaaaagaatggccatccttggagatacagcctgggacttcggctccctcgggggagtgtttacctctattggcaaggctctccatcaggtcttcggggccatctatggcgcggcttttagcggagtgtcctggacgatgaaaattctgatcggcgtgattatcacatggatcgggatgaacagccgctctacctccctgagcgtttctcttgtcctcgtgggaattgtgaccctgtacctgggcgtcatggtgcaggccgattccgggtgtgttgtgagctggaagaataaagaactcaagtgcggatccggcatcttcattacagacaacgtccacacctggacagagcagtataagtttcaacctgaatctcccagcaaactggcctccgctatccagaaggcccaggaggaagggatttgtggcatccggtctgtgacgagacttgagaatctgatgtggaaacagatcaccccggagctcaaccacattctggctgaaaatgaggttaagctgacaatcatgaccggagatattaaaggcatcatgcaagccgggaagcgcagccttcggcctcagcccacagaactcaaatactcctggaagacctggggaaaggcgaaaatgctgagcacggagtctcataaccagaatttcctgattgacggccctgaaaccgccgagtgccccaacacaaatagagcttggaactccctcgaggtggaagattatgggtttggagtcttcaccacaaatgtgtggctgaaacttaaagagaagcaggacgccttttgtgacagcaaactgatgtctgctgccatcaaggataaccgcgcggttcacgccgacatgggctactggatcgaatccgctctcaatgatacctggaagattgagaaagccagcttcatcgaggtgaagaactgccattggcctaaatctcacacactgtggagcaacggcgtcctggaatccgagatgattatccccaagaatcttgctgggccggtgagccaacacaactatcggcctggataccatacccagattgccggcccctggcacctcgggaaactggaaatggacttcgatttttgtgacggaacgacagtggtcgttaccgaggattgcggcaatagagggccctctctgcgcaccacaaccgcctccggaaagctcatcacggaatggtgctgtcggagctgcacactgcctccgcttagataccggggcgaggacggctgttggtatgggatggagattcgccccctgaaggaaaaagaggaaaacctcgtcaattccctggtgaccgctggacatggccaggtcgataacttctctctgggggtgcttggaatggcgctctttctggaggaaatgctgagaacacgggttggcaccaagcacgccatcctcctggtggctgtcagcttcgtgacacttatcaccgggaatatgtcctttaaagacctgggaagagttgtggtcatggtgggcgccacgatgaccgatgacattggcatgggggttacatacctcgccctgctggctgccttcaaggtgcgccctacctttgcggctggacttctgctccggaaactgacatctaaggagctcatgatgaccacgatcggcattgtcctgcttagccaatccacaatccccgagaccattctggaactcacagatgccctggccctggggatgatggtgcttaagatcgtgagaaacatggagaaatatcagctggctgtcaccatcatggccattctctgcgttcctaatgcggtgatcctgcagaacgcttggaaggtgtcttgtaccattctcgccgtcgtgagcgttagccccctgatccttacaagctctcagcagaagacggactggattcctctggccctcaccatcaagggactgaatcccacagctatcttcctgaccacactttcccgcaccaacaaaaagagaagctggccgctgaatgaagccattatggctgtgggcatggtctctatcctcgcctccagcctgctcaaaaacgacattcctatgacggggcccctggtggcgggaggccttctgacagtttgctacgtgctgaccggccggtctgccgatctcgagctggaacgcgctaccgacgtcaagtgggagagacaggccgagatctccgggagctcccctattcttagcatcacaatttctgaagatggaagcatgtccatcaagaatgaggaagaggagcagaccctgacaatcctcattcggacgggcctgctcgtgatctctgggctgtttcccgtcagcattccgatcaccgctgccgcctggtatctttgggaagtgaaaaagcagcgcgctggagttctgtgggacgtgccttctccccctcccatgggcaaagcggagctggaagatggggcctacagaattaagcaaaaaggaatcctcggctatagccagatcggcgctggggtctacaaggagggaacattccataccatgtggcacgtgacacggggcgccgttctgatgcacaaggggaaacgcattgaacccagctgggccgacgtgaagaaagatcttatctcctacggaggcgggtggaagctggagggagagtggaaagaaggcgaggaagtccaggtgctcgctctggagcctggcaagaacccgagagccgtgcagaccaagcccgggctctttaaaacgaacaccggaacaattggcgcggtttctctggacttcagccctgggacctccggaagccccatcattgataagaaaggcaaggtcgtggggctttatggaaatggcgtggtcacacggtctggcgcttacgtgtccgccatcgcccaaaccgagaaatccatcgaggacaaccctgagattgaagatgacatctttcgcaagagaaagatgacaattatggatctgcatcccggggctggaaaaacgaagcggtatctgcctgccatcgttagagaggcgattaaacgcggcctccggaccctgatccttgctccgacaagagtggtcgccgccgaaatggaggaagctctgcgcgggctccccattcggtaccagacccctgccatcagagctgagcacaccggacgcgagatcgtggacctgatgtgtcatgccacattcacgatgcggctcctgtctcccgttagagtgcctaattataaccttattatcatggacgaagcgcacttcaccgatcccgcctccattgctgcccgcggctacatcagcacacgggtcgagatgggggaagctgccggcatttttatgaccgccacaccgcctggatccagagaccccttcccccagtctaatgctcctatcatcgatgaggagcgggaaattcccgagcgcagctggaactccggccatgaatgggtgaccgactttaaggggaaaacggtttggttcgtgcctagcatcaaggcgggaaatgatattgccgcttgcctgagaaagaacggcaaaaaggtcatccaactgtctcggaaaacatttgactccgagtatgtgaagacccgcaccaatgattgggacttcgtggtcacaaccgatattagcgaaatgggggccaactttaaagccgagagagttatcgacccgcggagatgtatgaagcccgtgatcctcacagatggagaggaacgcgtgattctggctggccctatgcccgtcacccactctagcgccgcgcagcggagagggcgcatcggccggaatcctaaaaacgagaatgaccagtacatttacatgggagaaccccttgagaacgacgaagattgcgctcactggaaggaggccaagatgctgctcgacaatatcaacacgccggagggcattatcccttccatgttcgaacccgagagagaaaaagtggatgccattgacggggagtatcgcctgcggggagaagctagaaagacatttgttgatctgatgcgcagaggcgacctccctgtgtggcttgcctacaaagtcgcggccgaggggatcaactatgctgatcggcgctggtgtttcgacggaatcagaaataaccagattctggaggaaaatgtggaggttgaaatctggaccaaggagggcgagcggaaaaagctgaagccccgctggctcgatgccagaatttactctgaccctctggctcttaaagaatttaaggagttcgccgctgggcggaaaagcctgacactcaacctgatcaccgaaatgggcagactgcccacgttcatgacccaaaaggcccgcgatgcgctcgacaatcttgccgtgctgcatacagctgaggccggaggccgggcttataaccacgccctgtccgaactcccggagaccctggagacacttctgctcctgaccctgctcgccacagtcaccgggggaatttttcttttcctgatgtctggcagagggatcggaaaaatgacgctgggcatgtgctgcatcattacagctagcatcctcctgtggtacgcgcagattcagcctcattggatcgccgcttccattatccttgaatttttcctgatcgtgctcctgattcccgagcccgaaaagcagcgcacccctcaagataatcagctgacctatgtcgtgatcgccattctcacagttgtggccgctaccatggccaacgagatgggctttcttgaaaagaccaaaaaggacctggggttcggaagcatcgcgacgcagcagccggagtctaatattctggacatcgatctccggcccgcctccgcttggaccctgtacgccgtggctacaacctttgtcacacctatgcttagacacagcattgagaactcctctgttaatgtgagcctgaccgccatcgcgaaccaagccacggtgctcatgggcctggggaaaggatggcccctgtccaagatggacatcggcgtccctctccttgctattgggtgttactctcaggtgaatcccatcaccctgacagccgctctgctcctgcttgttgcccactatgctattatcggacctggcctgcaggccaaagcgacccgggaagcccagaagcgcgctgccgctggcattatgaagaacccgagcgtggatgggatcacagtcatcgacctcgatcccattccttacgaccccaaattcgagaagcaactgggacaggtgatgctgctcgtcctttgcgtgacccaggttctgatgatgagaacgacatgggccctgtgtgaagccctcaccctggcgacaggccctatctccaccctttgggaggggaatcccggacggttttggaacaccacaattgctgtgagcatggccaatatcttccgcggctcttatctggctggggccggactcctgttttccattatgaaaaacacgaccaacacaagacggggcaccggcaatatcggggaaacactgggagagaagtggaaaagccgcctcaacgcccttggcaagtctgagttccaaatctacaaaaagtccgggattcaggaagtcgatagaaccctggctaaggagggaatcaaacggggcgaaacggaccatcacacagtgagccgcgggtctgccaagctgagatggtttgttgagcggaatatgattaccccggagggaaaagtgctcgatctgggctgcggcagagggggatggagctattactgtggcgggcttaagaacgtccgcgaagtgaaaggactgaccaagggcgggcctggacatgaggaacccatccccatgtccacatatggctggaatctcgtgcggctgcagtctggcgttgacgtcttcttcacccctcccgagaagtgcgatacactgctctgtgacattggggaaagctcccctaacccgacggtggaggcgggaagaacccttcgcgtgctgaatctggtcgagaactggctcaataacaatacacagttttgcatcaaagttctgaacccctacatgcctagcgtgatcgaaaagatggaggcccttcaacggaaatacggcggggctctggtgagaaatcccctctcccgcaactctacccacgaaatgtattgggtcagcaatgcctccggaaacattgtgtctagcgttaacatgatctcccggatgctgattaatagattcacaatgaagcataaaaaggctacctacgagcctgatgtggacctgggctctgggacgcgcaacatcggaattgaaagcgaggtccccaatctcgacatcattggcaagcggatcgagaaaatcaagcaggaacacgagacctcctggcactatgatcaggaccatccgtacaaaacatgggcctatcacggcagctacgaaaccaagcagacagggtctgcgtccagcatggtgaacggagttgtgagacttctgaccaaaccttgggatgtcctgcccacagtgacccaaatggccatgacggacacaaccccttttggccagcagcgcgtgttcaaggagaaggtcgatacccggacacaggaacccaaagaggggacgaagaaactcatgaagattaccgctgagtggctgtggaaagaacttggaaagaaaaagacacctagaatgtgtacccgcgaggaatttacaagaaaggttcggtctaatgccgctctgggcgccatcttcaccgacgagaacaaatggaagtccgctcgcgaggccgtggaagatagcagattttgggagctcgtggacaaagaacggaatctgcatctggaggggaagtgcgaaacatgtgtctataacatgatgggaaaaagagagaagaagctcggcgagttcggcaaagcgaaggggtctcgggccatttggtacatgtggctgggagctcgctttcttgagttcgaggccctgggctttctcaatgaagatcactggttctccagagagaacagcctgtccggggtggaaggagagggccttcacaaactggggtacatcctccgggacgttagcaagaaagagggcggagctatgtatgccgatgacaccgccggctgggacacgcgcattaccctggaagatctgaagaatgaggaaatggtgacaaaccatatggagggggaacacaagaaactcgcggaggctatctttaagctgacctaccaaaataaagtcgtgagagttcagcggcccacaccgcgcggaaccgtgatggacatcatttctagacgggatcagcgcggcagcgggcaagtcggaacgtatggccttaacacattcaccaatatggaggcccagctgatcagacagatggaaggggagggcgtgttcaagaacattcagcatctcacagccaccgaagagatcgctgttcaaaactggctggcccgggtgggacgcgagagactttcccggatggctatttctggcgacgattgcgtcgtgaaacctctggacgatcgctttgccagcgcgctcacggccctgaatgacatggggaaggtcagaaaggatatccagcagtgggaaccctcccggggatggaacgactggacccaggtgcccttctgctctcaccattttcacgagctgatcatgaaagatggcagagttctcgtggtcccttgtcgcaatcaagacgaactgattgggcgggctagaatcagccagggagccggctggtcccttcgcgagacagcttgcctggggaagtcttacgcccagatgtggagcctcatgtatttccaccggagagatctgcgccttgcggccaacgctatttgttccgccgtgccgagccattgggtgcccacctctcggacaacctggtccatccacgctaaacatgaatggatgacaaccgaggacatgctgacggtttggaatagagtgtggattcaggagaacccttggatggaagacaagacacccgtcgagagctgggaagagatcccttacctcggcaaacgcgaagatcaatggtgcggatctctgattggcctgacctcccgggccacctgggctaagaatatccaggccgcgatcaaccaggtgagaagcctcattgggaatgaggagtatacagactacatgccctccatgaagcgctttcggagagaagaggaagaggccggagttctgtggtga

SEQ ID NO: 20340 - RNA, 9876 nt, synthetic construct
  misc_feature 1..9876: note = derived and/or modified CDS sequence (opt5) from DENV-2__AF169682__SS-prME
  source 1..9876: mol_type = other RNA
tccgctggcatgatcattatgctgatccccaccgtgatggctttccacctcaccacgagaaatggggagcctcatatgattgtctccatccaggaaaagggaaaatctctgctttttaagaccgaggacggcgttaatatgtgcacgctgatggccatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaggaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcagaatccccttcgaaatcatggacctcgagaaacgctacgttctgggacggctgattacggtgaaccctatcgtcaccgaaaaggattccccggtgaacattgaggccgaacccccttttggcgacagctacatcattatcggggttgagcccggccagctcaaactgaattggttcaagaagggatctagcattggccaaatgtttgagacaaccatgagaggggctaaacgcatggccatccttggagatacagcctgggacttcggctccctcgggggagtgtttacctctatcggcaaggctctccatcaggtcttcggggccatttatggcgcggcttttagcggagtgtcctggacgatgaaaatcctgattggcgtgatcattacatggatcgggatgaacagccggtctacctccctgagcgtttctcttgtcctcgtgggaatcgtgaccctgtacctgggcgtcatggtgcaggccgattccgggtgtgttgtgagctggaagaataaagaactcaagtgcggatccggcattttcatcacagacaacgtccacacctggacagagcagtataagtttcaacctgaatctcccagcaaactggcctccgctattcagaaggcccaggaggaagggatctgtggcattagatctgtgacgcgccttgagaatctgatgtggaaacagatcaccccggagctcaaccacatcctggctgaaaatgaggttaagctgacaattatgaccggagatatcaaaggcattatgcaagccgggaagcggagccttagacctcagcccacagaactcaaatactcctggaagacctggggaaaggcgaaaatgctgagcacggagtctcataaccagaccttcctgatcgacggccctgaaacagccgagtgccccaataccaaccgcgcttggaactccctcgaggtggaagattatgggtttggagtcttcacaaccaacatttggctgaaacttaaagagaagcaggacgccttttgtgacagcaaactgatgtctgctgccatcaaggataatcgggcggtgcacgccgacatgggctactggatcgaatccgctctcaacgatacatggaagattgagaaagccagcttcatcgaggttaagaattgccattggcctaaatctcacaccctgtggagcaacggcgtgctggaatccgagatgattatccccaagaaccttgctgggccggtcagccaacacaattatagacctggataccatacgcagattgccggcccctggcacctcgggaaactggaaatggacttcgatttttgtgacggaacaaccgtggtggtcaccgaggattgcggcaaccgcgggccctctctgcggacaaccacggcctccggaaagctcatcacagaatggtgctgtagaagctgcaccctgcctccgcttcggtaccgcggcgaggacggctgttggtatgggatggagattagacccctgaaggaaaaagaggaaaatctcgttaactccctggtgacagctggacatggccaggtggataatttctctctgggggtccttggaatggcgctctttctggaggaaatgctgcggaccagagtgggcacaaagcacgccatcctcctggttgctgtgagcttcgtcacccttatcacggggaacatgtcctttaaagacctgggacgcgtggttgtgatggtcggcgccaccatgacagatgacattggcatgggggtgacctacctcgccctgctggctgccttcaaggttcggcctacatttgcggctggacttctgctcagaaaactgacctctaaggagctcatgatgacgacaatcggcattgtgctgcttagccaatccaccatccccgagacaattctggaactcaccgatgccctggccctggggatgatggtccttaagatcgtgcgcaatatggagaaatatcagctggctgtgaccatcatggccattctctgcgtccctaacgcggttatcctgcagaatgcttggaaggtgtcttgtacaattctcgccgtggtcagcgtgagccccctgatccttacgagctctcagcagaagaccgactggattcctctggccctcacaatcaagggactgaaccccaccgctatcttcctgacaaccctttccagaacgaataaaaagcggagctggccgctgaacgaagccattatggctgttggcatggtgtctatcctcgcctccagcctgctcaaaaatgacattcctatgacagggcccctggtcgcgggaggccttctgaccgtgtgctacgttctgaccggccgctctgccgatctcgagctggaaagagctacagacgtgaagtgggaggatcaggccgagatctccgggagctcccctagcctttctattaccatcagcgaagacggatccatgtctattaagaacgaggaagaggagcagacactgacgatcctcatccggaccggcctgctcgtcattagcgggctgtttcccgtgtccatcccgattacagctgccgcctggtatctttgggaagtcaaaaagcagcgcgctggagtgctgtgggatgttccttctccccctcccatgggcaaagcggagctggaagacggggcctacagaatcaagcaaaaaggcattctgggatatagccagatcggcgctggggtgtacaaggagggaaccttccatacaatgtggcacgtcacccggggcgccgtgctgatgcacaaggggaaacgcatcgaaccctcctgggccgatgttaagaaagaccttatttcttacggaggcgggtggaagctggagggagagtggaaagaaggcgaggaagtgcaggtcctcgctctggagcctggcaagaatccgagagccgtgcagacgaagcccgggctctttaaaaccaacacaggaaccatcggcgcggtgagcctggatttctcccctgggacaagcggatctcccattatcgacaagaaaggcaaggttgtcgggctttatggaaacggcgtggtgacccggtccggcgcttacgtcagcgccattgcccaaacagaaaaatctatcgaggataatcctgagatcgaagacgatatttttcgcaagagacggctgacgatcatggacctgcatcccggggctggaaagaccaaaagatatctccctgccattgtgcgcgaggcgatcaagcggggcctgagaacacttattctggctccgacccgcgttgtggccgccgaaatggaggaagctctccgggggctgcccatcagataccagacccctgccattcgcgctgagcacacaggacgggagatcgtcgacctcatgtgtcatgccacgttcaccatgagactgctttcccccgtgcgcgttcctaactataatctgatcattatggatgaagcgcacttcacagaccccgccagcatcgctgcccggggctacatttccaccagagtggagatgggggaagctgccggcatctttatgacagccaccccgcctggatctcgggatcccttcccccagagcaacgctcctattatcgacgaggagcgcgaaatccccgagagatcctggaatagcggccatgaatgggtcacggattttaaagggaagacagtgtggttcgttccttctattaaagcgggaaacgacatcgccgcttgcctgcggaagaatggcaagaaagtgattcaactctcccgcaagacctttgatagcgagtatgtcaaaaccagaacaaacgactgggatttcgtggtgaccacagacatctctgaaatgggggccaattttaaggccgagcgggtcattgatccgagacgctgtatgaaacccgttatcctgaccgacggagaggaacgggtgatccttgctggccctatgcccgtgacgcacagctccgccgcgcagagacgcgggcggattggcagaaaccctaagaatgagaacgaccagtacatctacatgggagaacccctggagaatgatgaagactgcgctcactggaaagaggccaagatgctcctggataacattaatacaccggagggcatcattccttctatgttcgaacccgagcgcgaaaaggtcgacgccatcgatggggagtatcggctgagaggagaagctcgcaaaacctttgtggacctcatgagacggggcgatcttcctgtttggctggcctacaaggtggcggccgaggggattaactatgctgaccgcagatggtgtttcgatggaatcaaaaacaatcagatcctggaggaaaacgtcgaggtggaaatttggacaaaggagggcgagcggaaaaagctcaagccccgctggctggacgccagaatctacagcgatcctcttgctctgaaagaatttaaggagttcgccgctgggcggaaatccctcgccctgaatctgattaccgaaatgggcagactccccacgttcatgacccaaaagacacgcgacgcgcttgataacctggccgttctgcataccgctgaggccggaggccgggcttataatcacgccctctctgaactgccggagacacttgagaccctgctcctgctgacactccttgccaccgtgacagggggaatctttctgttcctgatgagcggcagagggattggaaaaatgacactcggcatgtgctgcatcatcaccgcttccattctgctttggtacgcgcagatccagcctcattggattgccgctagcatcattctggtctttttcctcatcgtgctgctgatccccgaacccgagaagcagcgcacccctcaagacaaccagctcacatatgtcgtgattgccatccttaccgttgtggccgctacaatggccaatgaaatgggctttctggagaagacgaaaaaggacctggggttcggatctattgcgacccagcagccggaatccaacatcctcgatattgacctgcggcccgccagcgcttggacactttacgccgtggctaccacatttgtcacccctatgctgagacactccatcgaaaattctagcgttaacgtgtccctcacggccattgcgaatcaagccaccgtgctgatgggcctggggaaaggatggcccctctctaagatggatatcggcgtccctcttctggctatcgggtgttacagccaggtgaaccccattacactgaccgccgctctcctgcttctggttgcccactatgctatcattggacctggcctccaggccaaagcgacacgggaggcccagaagcgcgctgccgctggcatcatgaagaatccgaccgtggacgggattacggtcatcgatctggaccccatcccttacgatcccaaattcgaaaagcaactgggacaggtgatgctccttgtcctgtgcgtgacacaggttctgatgatgagaaccacatgggccctctgtgaggccctgacccttgcgaccggccctatttccacactgtgggaagggaaccccggacggttttggaatacgaccatcgctgtgagcatggccaacattttccgcggctcttatctcgctggggccggactgctgttttccatcatgaaaaatacaaccaacacaagacggggcaccggcaacattggggagacgctcggagaaaagtggaaaagccgccttaatgccctgggcaagtctgagttccaaatctacaaaaagtccgggatccaggaggtcgacagaacactggctaaggaaggaattaaacggggcgagaccgatcatcacgccgtgagccgcgggtctgcgaagctcagatggtttgttgaacggaacatggtgaccccggagggaaaagtcgtggacctgggctgcggcagagggggatggagctattactgtggcgggcttaagaatgtgcgcgaggttaaaggactgacaaagggcgggcctggacatgaggagcccatccccatgtccacctatggctggaacctcgtccggctgcagtctggcgtggatgtgttcttcacacctcccgaaaagtgcgacacgctgctctgtgatattggggagagctcccctaatccgaccgtcgaagccggaagaacacttcgcgttctgaacctggtggagaattggctcaacaataacacccagttttgcatcaaagtgctgaatccctacatgcctagcgtcattgagaagatggaagcccttcaacggaaatacggcggggccctggtgagaaaccccctctcccgcaattctacacacgagatgtattgggttagcaacgcttccggaaatatcgtgtctagcgtcaacatgatctcccggatgctgattaacagattcaccatgaagcataaaaaggccacgtacgaacctgacgtggacctgggctctgggacccgcaatatcggaattgagagcgaagttcccaacctcgatatcattggcaagcggatcgagaaaattaagcaggagcacgaaacatcctggcactatgaccaggatcatccgtacaaaacctgggcgtatcacggcagctacgagacaaagcagaccgggtctgcctccagcatggtgaatggagtcgtgagacttctgacaaaaccttgggacgtgctgcccaccgtcacgcaaatggctatgacagataccaccccttttggccagcagcgcgttttcaaggaaaaggtggacacacggacgcaggagcccaaagaagggaccaagaaactcatgaagatcacagccgagtggctgtggaaagagcttggaaagaaaaagacccctagaatgtgtacacgcgaagagtttaccagaaaggtgcggtctaacgctgccctgggcgctatcttcacagatgaaaataaatggaagtccgcccgcgaggcggtcgaggacagcagattttgggaactcgtggataaagagcggaacctgcatctggaagggaagtgcgagacctgtgtttataatatgatgggaaaaagagaaaagaagctcggcgagttcggcaaagccaaggggtctcgggctatttggtacatgtggctgggagcccgctttcttgagttcgaagctctgggctttctcaacgaggaccactggttctccagagaaaatagcctgtccggggtggagggagaaggccttcacaaactggggtacatcctccgggatgtcagcaagaaagagggcggagccatgtatgccgacgacacggcgggctgggatacccgcattacactggaggacctgaagaacgaagagatggtgaccaatcatatggaaggggagcacaagaaactcgctgaagccatctttaagctgacataccaaaacaaagttgtgagagtccagcggcccaccccgcgcggaacggtgatggatattatctctagacgggaccagcgcggcagcgggcaagttggaacatatggccttaataccttcacaaacatggaggcccagctgatcagacagatggagggggaaggcgtgttcaagaatattcagcatctcaccgctacggaggaaatcgccgtccaaaactgcctggctcggcttggacgcgagagactgtcccggatggccatttctggcgatgactgcgtggtcaaacctctcgatgaccgctttgcgagcgccctgaccgctctgaacgatatggggaagatcagaaaggacattcagcagtgggagccctcccggggatggaatgattggacacaggtgcccttctgttctcaccattttcacgaactcatcatgaaagacggcagagttctggtggtcccttgccgcaaccaagatgagcttatcgggcgggccagaattagccagggagctggctggtccctgcgcgaaaccgcctgtctcgggaagtcttacgcgcagatgtggagcctgatgtatttccaccggagagaccttcgcctggccgctaatgccatctgctccgctgtgccgagccattgggtgcccacatctcggaccacatggtccattcacgccaaacatgagtggatgaccacggaagacatgctcacagtttggaacagagtgtggatccaggagaatccttggatggaggataagacccccgtcgaaagctgggaggaaattccttacctgggcaaacgcgaggaccaatggtgtggatctctgatcggcctcacctcccgggctacatgggccaagaacattcaggcggccatcaatcaggtgagaagcctgatcgggaacgaagagtataccgattacatgccctccatgaagcgctttcggagagaggaagaggaagctggagttctttggtga

SEQ ID NO: 20341 - RNA, 9876 nt, synthetic construct
  misc_feature 1..9876: note = derived and/or modified CDS sequence (opt5) from DENV-2__AF169681__SS-prME
  source 1..9876: mol_type = other RNA
tccgccggcatgatcattatgctgatccccaccgtgatggctttccacctcacgacgagaaatggggagcctcatatgattgtctccatccaggaaaagggaaaatctctgctttttaagaccgaggacggcgttaatatgtgcacactgatggccatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcagaatccccttcgaaatcatggacctcgagaaacgctacgttctgggacggctgattacggtgaaccctatcgtcaccgaaaaggattccccggtgaacattgaggccgaacccccttttggcgacagctacatcattatcggggttgagcccggccagctcaaactgaattggttcaagaagggatctagcattggccaaatgtttgagacaaccatgagaggggctaaacgcatggccatccttggagatacagcctgggacttcggctccctcgggggagtgtttacctctatcggcaaggctctccatcaggtcttcggggccatttatggcgcggcttttagcggagtgtcctggacgatgaaaatcctgattggcgtgatcattacatggatcgggatgaacagccggtctacctccctgagcgtttctcttgtcctcgtgggaatcgtgaccctgtacctgggcgtcatggtgcaggccgattccgggtgtgttgtgagctggaagaataaagaactcaagtgcggatccggcattttcatcacagacaacgtccacacctggacagagcagtataagtttcaacctgaatctcccagcaaactggcctccgctattcagaaggcccaggaggaagggatctgtggcattagatctgtgacgcgccttgagaatctgatgtggaaacagatcaccccggagctcaaccacatcctggctgaaaatgaggttaagctgacaattatgaccggagatatcaaaggcattatgcaagccgggaagcggagccttagacctcagcccacagaactcaaatactcctggaagacctggggaaaggcgaaaatgctgagcacggagtctcataaccagaccttcctgatcgacggccctaagacagccgaatgccccaataccaaccgcgcttggaactccctcgaggtggaggattatgggtttggagtcttcacaaccaacatttggctgaaacttaaggaaaaacaggacgccctgtgtgacagcaagctcatgtctgctgccatcaaggataatcgggcggtgcacgccgacatgggctactggatcgagtccgctctgaacgatacatggaaaattgaaaaggccagctttatcgaggttaaaaattgccattggcctaagtctcacaccctgtggagcaacggcgtgcttgagtccgaaatgattatccccaaaaacctcgctgggccggtcagccaacacaattatagacctggataccatacgcagattgccggcccctggcacctggggaagctggagatggacttcgatttctgtgacggaacaaccgtggtggtcaccgaagattgcggcaaccgcgggccctctctccggacaaccacggcctccggaaagctgatcacagagtggtgctgtagaagctgcacccttcctccgctgcggtaccgcggcgaagacggctgttggtatgggatggagattagacccctcaaagagaaggaagagaatctggttaactccctggtgacagctggacatggccaggtggataatttttctcttggggtcctcggaatggcgctgttcctggaagagatgctccggaccagagtgggcacaaaacacgccatcctgcttgttgctgtgagctttgtcaccctgatcacggggaacatgtccttcaaggacctcggacgcgtggttgtgatggtcggcgccaccatgacagatgacattggcatgggggtgacctacctggccctgcttgctgcctttaaagttcggcctacattcgcggctggactgctcctgagaaagctcacctctaaggaactgatgatgacgacaatcggcattgtgcttctgagccaatccaccatccccgagacaattctcgagctgaccgatgccctggcccttgggatgatggtcctgaaaatcgtgcgcaatatggaaaagtatcagctcgctgtgaccatcatggccattctgtgcgtccctaacgcggttatcctccagaatgcttggaaagtgtcttgtacaattctggccgtggtcagcgtgagcccccttatcctgacgagctctcagcaaaagaccgactggattcctctcgccctgacaatcaaaggactgaaccccaccgctatctttcttacaaccctgtccagaacgaataagaaacggagctggccgctcaacgaggccattatggctgttggcatggtgtctatcctggcctccagcctcctgaagaatgacattcctatgacagggccccttgtcgcgggaggcctgctgaccgtgtgctacgttctcaccggccgctctgccgatctggaacttgagagagctacagacgtgaagtgggaaaaccaggccgagatctccgggagctcccctattctgagcatcaccatttctgaggatggaagcatgtccatcaaaaatgaagaggaagaacagacactcacgatcctgattcggaccggcctcctggtcatctctgggcttttccccgtgagcattccgatcacagctgccgcctggtatctgtgggaggtcaagaaacagcgcgctggagtgctgtgggacgttccttctccccctcccatgggcaaggcggaactcgaggatggggcctacagaattaaacaaaagggaatcctgggctatagccagatcggcgctggggtgtacaaggaaggaacctttcatacaatgtggcacgtcacccggggcgccgtgcttatgcacaaagggaagcgcattgagcccagctgggccgacgttaaaaaggatctgatctcctacggaggcgggtggaaactcgaaggagagtggaaggagggcgaagaggtgcaggtcctggctctcgaacctggcaagaacccgagagccgtgcagacgaaacccgggctgttcaagaccaacacaggaaccattggcgcggtgtctcttgactttagccctgggacatccggaagccccatcattgataaaaagggcaaagttgtcgggctgtatggaaatggcgtggtgacccggtctggcgcttacgtctccgccatcgcccaaacagaaaagtccatcgaagacaaccctgagattgaggatgacatcttccgcaagagacggctgacgattatggatctccatcccggggctggaaaaaccaagagatatctgcctgccatcgtgcgcgaagcgattaaacggggccttagaacactgatcctcgctccgacccgcgttgtggccgccgagatggaagaggctctgcgggggctccccattagataccagacccctgccatccgcgctgaacacacaggacgggagatcgtcgacctgatgtgtcatgccacgtttaccatgagacttctgtctcccgtgcgcgttcctaattataacctgattatcatggacgaggcgcacttcacagatcccgcctccattgctgcccggggctacatcagcaccagagtggaaatgggggaggctgccggcattttcatgacagccaccccgcctggatcccgggacccctttccccagtctaatgctcctatcatcgatgaggaacgcgagattcccgaaagaagctggaactccggccatgagtgggtcacggacttcaaggggaaaacagtgtggtttgttcctagcatcaaggcgggaaatgatattgccgcttgcctccggaagaacggcaaaaaggtgatccaactgtctcgcaaaaccttcgactccgaatatgtcaagaccagaacaaatgattgggactttgtggtgaccacagatattagcgagatgggggccaacttcaaagccgaacgggtcatcgacccgagacgctgtatgaagcccgttatccttaccgatggagaggagcgggtgattctggctggccctatgcccgtgacgcactctagcgccgcgcagagacgcgggcggatcggcagaaatcctaaaaacgaaaatgaccagtacatttacatgggagagcccctcgaaaacgacgaggattgcgctcactggaaggaagccaagatgctgctggacaatatcaacacaccggagggcattatcccttccatgtttgagcccgaacgcgagaaagtcgatgccattgacggggaatatcggctcagaggagaggctcgcaagaccttcgtggatcttatgagacggggcgacctgcctgtttggctggcctacaaagtggcggccgaagggatcaactatgctgatcgcagatggtgttttgacggaatcaagaataaccagattctcgaggagaatgtcgaagtggagatctggacaaaagaaggcgagcggaagaagctgaaaccccgctggcttgatgccagaatttactctgaccctctggctctcaaggagttcaaagaatttgccgctgggagaaagagcctggccctgaacctcatcaccgagatgggccggcttcccacgttcatgacccagaagacccgcgatgcgctggacaatctggccgttctccataccgctgaagccggaggccgggcttataaccacgccctgtccgagcttccggaaacactggagaccctcctgctgctcacacttctggccaccgtgacagggggaattttcctgtttctcatgtctggcagagggatcggaaagatgacactgggcatgtgctgcatcattaccgctagcatccttctgtggtacgcgcagattcagcctcattggatcgccgcttccattatcctcgtcttctttctgatcgtgctgctcattcccgagcccgaaaagcagcgcacccctcaagataatcagcttacatatgtcgtgatcgccattctgaccgttgtggccgctacaatggccaacgagatgggcttcctggagaaaacgaagaaagacctcgggtttggaagcatcgcgacccagcagccggagtctaatattctggacatcgatcttcggcccgcctccgcttggacactgtacgccgtggctaccacattcgtcacccctatgctcagacacagcattgaaaactcctctgttaatgtgagcctgacggccatcgcgaaccaagccaccgtgctgatgggcctcgggaagggatggcccctttccaaaatggacatcggcgtccctctgctggctattgggtgttactctcaggtgaatcccatcacactcaccgccgctctgcttctgctcgttgcccactatgctattatcggacctggcctgcaggccaaggcgacacgggaggcccagaagcgcgctgccgctggcattatgaaaaacccgaccgtggatgggatcacggtcatcgacctggatcccattccttacgaccccaagtttgagaaacaactcggacaggtgatgcttctggtcctgtgcgtgacacaggttctcatgatgagaaccacatgggccctgtgtgaagcccttaccctggcgaccggccctatcagcacactctgggaggggaatcccggacggttctggaacacgaccattgctgtgtccatggccaatatctttcgcggcagctatctggctggggccggactgctgttctctattatgaagaacacaaccaacacaagacggggcaccggcaatatcggggaaacgcttggagagaaatggaagtcccgcctgaacgccctgggcaaaagcgaatttcaaatctacaagaagtctgggattcaggaggtcgatagaacactcgctaaagagggaatcaagcggggcgaaaccgaccatcacgccgtgtcccgcgggagcgcgaaactgagatggttcgttgagcggaatatggtgaccccggaaggaaaggtcgtggatcttggctgcggcagagggggatggtcttattactgtggcgggctgaaaaacgtgcgcgaggttaagggactcacaaagggcgggcctggacatgaggaacccattcccatgagcacctatggctggaatctggtccggctgcagtccggcgtggacgtgtttttcatccctcccgagaaatgcgatacactcctttgtgacattggggaatctagccctaacccgacggtcgaggccggaagaaccctgcgcgttctgaatctcgtggaaaactggctgaataacaatacacagttctgcatcaaggtgcttaacccctacatgccttccgtcatcgagaaaatggaggctctgcaacggaagtacggcggggccctcgtgagaaatcccctgagccgcaactccacccacgaaatgtattgggtttctaatgctagcggaaacattgtgtcctctgtcaacatgatcagccggatgctgattaatagatttacaatgcgccataaaaaggccacctacgagcctgatgtggacctcggctccgggacgcggaacatcggaattgaatctgagatccccaatcttgacattatcggcaagagaatcgagaaaattaagcaggagcacgagaccagctggcactatgatcaggaccatccgtacaaaacatgggcgtatcacggctcctacgaaaccaagcagacagggagcgcctcttccatggttaacggagtggtccgcctgctgaccaaaccttgggatgtgctccccacagtgacccaaatggctatgacggacacaacccctttcggccagcagcgggtctttaaggagaaggttgataccagaacacaggaacccaaagaggggacgaagaaactgatgaagatcaccgccgaatggctttggaaagagctgggaaagaaaaagacacctcgcatgtgtaccagagaggagttcacacggaaggtgcgcagcaatgctgccctcggcgctatttttaccgacgagaacaaatggaagtctgccagagaagcggtggaggattcccggttctgggagctggtcgacaaagaaagaaatctgcatctcgaggggaagtgcgaaacatgtgtgtataacatgatgggaaaacgggagaagaagctgggcgaatttggcaaagccaaggggagccgcgctatctggtacatgtggcttggagccagattcctggagtttgaggctctcggcttcctgaatgaagatcactggttttctcgggagaactcccttagcggggttgaaggagagggcctgcacaaactccgctacattctgagagacgtgtccaagaaagaagggggcgccatgtatgccgatgacaccgcgggatgggacacgcggatcaccctggaggatctcaagaatgaggaaatggtcacaaaccatatggagggcgaacacaagaaactggctgaggccatcttcaaacttacctaccaaaataaagtggttcgcgtgcagagacccacaccgcgggggaccgtcatggacattatcagccgcagagatcagcggggatctggccaagtggggacgtatggactgaacacatttaccaatatggaagcccagctcattcgccagatggagggcgagggggttttcaagaacatccagcatctgacagctaccgaagagattgccgtgcaaaactggcttgctagagtcggccgggaacgcctgagcagaatggccatctccggagacgattgcgtggtcaaacctctcgacgatcggttcgcgtctgccctgacggctctgaatgacatgggcaagatcagaaaggatattcagcagtgggagcccagccgcgggtggaacgactggacccaggtgcccttttgctcccaccatttccacgagctcatcatgaaagatggacgggttctggtggtcccttgtagaaatcaagacgaacttattggccgcgcccggatctctcagggggctggatggagcctgagagagacagcctgcctcggcaagtcctacgcgcagatgtggtctctgatgtattttcaccgccgggatcttagactggccgctaacgccatttgtagcgctgtgccgtcccattgggtgcccaccagccgcacaacctggtctatccacgccaaacatgaatggatgacaaccgaggacatgctcacggtttggaatcgggtgtggattcaggaaaacccttggatggaggacaagacacccgtcgagtcctgggaagagatcccttacctggggaaaagagaagatcaatggtgcggcagcctgatcggactcacctctcgcgctacctgggccaagaatattcaggcggccatcaaccaggtgcggtccctgattggcaatgaggaatatacagactacatgcccagcatgaagagattccggagagaggaggaagaggctggggttctttggtga

SEQ ID NO: 20342 - RNA, 9876 nt, synthetic construct
  misc_feature 1..9876: note = derived and/or modified CDS sequence (opt5) from DENV-2__AF169683__SS-prME
  source 1..9876: mol_type = other RNA
agcgccggaatgatcattatgctgatccccaccgtgatggctttccacctgaccacgagaaatggggaacctcatatgattgtctccatccaggaaaagggaaaatctctgctttttaagaccgaggacggcgttaatatgtgcacgctgatggccatggatctcggggaactgtgtgaggacaccattacatacaaatgcccgcttctgcggcaaaatgaacccgaggatatcgactgttggtgcaattccacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaggacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcagaatccccttcgaaatcatggacctcgagaaacgctacgttctgggacggctgattacggtgaaccctatcgtcaccgaaaaggattccccggtgaacattgaggccgaacccccttttggcgacagctacatcattatcggggttgagcccggccagctcaaactgaattggttcaagaagggatctagcattggccaaatgtttgagacaaccatgagaggggctaaacgcatggccatccttggagatacagcctgggacttcggctccctcgggggagtgtttacctctatcggcaaggctctccatcaggtcttcggggccatttatggcgcggcttttagcggagtgtcctggacgatgaaaatcctgattggcgtgatcattacatggatcgggatgaacagccggtctacctccctgagcgtttctcttgtcctcgtgggaatcgtgaccctgtacctgggcgtcatggtgcaggccgattccgggtgtgttgtgagctggaagaataaagaactcaagtgcggatccggcattttcatcacagacaacgtccacacctggacagagcagtataagtttcaacctgaatctcccagcaaactggcctccgctattcagaaggcccaggaggaagggatctgtggcattagatctgtgacgcgccttgagaatctgatgtggaaacagatcaccccggagctcaaccacatcctggctgaaaatgaggttaagctgacaattatgaccggagatatcaaaggcattatgcatgccgggaagcggagccttagacctcaacccacagaactcaaatactcctggaagacctggggaaaggcgaaaatgctgagcacggagtctcacaaccagaccttcctgatcgacggccctgaaacagccgagtgccccaataccaaccgcgcttggaactccctcgaggtggaagattatgggtttggagtcttcacaaccaacatttggctgaaacttaaagagaagcaggacgccttttgtgacagcaaactgatgtctgctgccatcaaggataatcgggcggtgcatgccgacatgggctactggatcgaatccgctctcaacgatacatggaagattgagaaagccagcttcatcgaggttaagaattgccactggcctaaatctcacaccctgtggagcaacggcgtgctggaatccgagatgattatccccaagaaccttgctgggccggtcagccagcataattatagacctggataccacacgcaaattgccggcccctggcatctcgggaaactggaaatggacttcgatttttgtgacggaacaaccgtggtggtcaccgaggattgcggcaaccgcgggccctctctgcggacaaccacggcctccggaaagctcatcacagaatggtgctgtagaagctgcaccctgcctccgcttcggtaccgcggcgaggacggctgttggtatgggatggagattagacccctgaaggaaaaagaggaaaatctcgttaactccctggtgacagctggacacggccaggtggataatttctctctgggggtccttggaatggcgctctttctggaggaaatgctgcggaccagagtgggcacaaagcatgccatcctcctggttgctgtgagcttcgtcacccttatcacggggaacatgtcctttaaagacctgggacgcgtggttgtgatggtcggcgccaccatgacagatgacattggcatgggggtgacctacctcgccctgctggctgccttcaaggttcggcctacatttgcggctggacttctgctcagaaaactgacctctaaggagctcatgatgacgacaatcggcattgtgctgcttagccagtccaccatccccgagacaattctggaactcaccgatgccctggccctggggatgatggtccttaagatcgtgcgcaatatggagaaatatcaactggctgtgaccatcatggccattctctgcgtccctaacgcggttatcctgcagaatgcttggaaggtgtcttgtacaattctcgccgtggtcagcgtgagccccctgatccttacgagctctcagcagaaaaccgactggattcctctggccctcacaatcaagggactgaaccccaccgctatcttcctgacaaccctttccagaacgaataaaaagcggagctggccgctgaacgaagccattatggctgttggcatggtgtctatcctcgcctccagcctgctcaaaaatgacattcctatgacagggcccctggtcgcgggaggccttctgaccgtgtgctacgttctgaccggccgctctgccgatctcgagctggaaagagctacagacgtgaagtgggaggatcaagccgagatctccgggagctcccctattcttagcatcaccatttctgaagacggaagcatgtccatcaagaacgaggaagaggagcagacactgacgatcctcattcggaccggcctgctcgtcatctctgggctgtttcccgtgagcattccgatcacagctgccgcctggtatctttgggaagtcaaaaagcagcgcgctggagtgctgtgggatgttccttctccccctcccatgggcaaagcggagctggaagacggggcctacagaattaagcagaaaggaatcctcggctatagccaaatcggcgctggggtgtacaaggagggaaccttccacacaatgtggcacgtcacccggggcgccgtgctgatgcataaggggaaacgcattgaacccagctgggccgatgttaagaaagaccttatctcctacggaggcgggtggaagctggagggagagtggaaagaaggcgaggaagtgcaggtcctcgctctggagcctggcaagaatccgagagccgtgcagacgaagcccgggctctttaaaaccaacacaggaaccattggcgcggtgtctctggatttcagccctgggacatccggaagccccatcattgacaagaaaggcaaggttgtcgggctttatggaaacggcgtggtgacccggtctggcgcttacgtctccgccatcgcccagacagagaagtccatcgaggataatcctgagattgaagacgatatctttcgcaagagacggctgacgattatggacctgcaccccggggctggaaagaccaaaagatatctccctgccatcgtgcgcgaggcgattaagcggggcctgagaacacttatcctggctccgacccgcgttgtggccgccgaaatggaggaagctctccgggggctgcccattagataccaaacccctgccatccgcgctgagcatacaggacgggagatcgtcgacctcatgtgtcacgccacgttcaccatgagactgctttctcccgtgcgcgttcctaactataatctgattatcatggatgaagcgcatttcacagaccccgcctccattgctgcccggggctacatcagcaccagagtggagatgggggaagctgccggcatttttatgacagccaccccgcctggatcccgggatcccttcccccagtctaacgctcctatcatcgacgaggagcgcgaaattcccgagagaagctggaactccggccacgaatgggtcacggattttaaagggaagacagtgtggttcgttcctagcatcaaagcgggaaacgacattgccgcttgcctgcggaagaatggcaagaaagtgatccagctctctcgcaagacctttgattccgagtatgtcaaaaccagaacaaacgactgggatttcgtggtgaccacagacattagcgaaatgggggccaattttaaggccgagcgggtcatcgatccgagacgctgtatgaaacccgttatcctgaccgacggagaggaacgggtgattcttgctggccctatgcccgtgacgcacttctctgccgcgcaaagacgcgggcggatcggcagaaaccctaagaatgagaacgaccagtacatttacatgggagaacccctggagaatgatgaagactgcgctcattggaaagaggccaagatgctcctggataacatcaatacaccggagggcattatccctagcatgtttgaacccgagcgcgaaaaggtcgacgccattgatggggagtatcggctgagaggagaagctcgcaaaaccttcgtggacctcatgagacggggcgatcttcctgtttggctggcctacaaggtggcggccgaggggatcaactatgctgaccgcagatggtgttttgatggaatcaaaaacaatcagattctggaggaaaacgtcgaggtggaaatctggacaaaggagggcgagcggaaaaagctcaagccccgctggctggacgccagaatttactccgatcctcttgctctgaaagagttcaaggagttcgccgctgggcggaaatctctcgccctgaatctgatcaccgaaatgggcagactccccacgtttatgacccagaagacacgcgacgcgcttgataacctggccgttctgcacaccgctgaggccggaggccgggcttataatcatgccctcagcgaactgccggagacacttgagaccctgctcctgctgacactccttgccaccgtgacagggggaattttcctgtttctgatgtccggcagagggatcggaaaaatgacactcggcatgtgctgcatcattaccgcttctatcctgctttggtacgcgcaaattcagcctcactggatcgccgctagcattatcctggtcttctttctcatcgtgctgctgattcccgaacccgagaagcagcgcacccctcaggacaaccaactcacatatgtcgtgatcgccattcttaccgttgtggccgctacaatggccaatgaaatgggcttcctggagaagacgaaaaaggacctggggtttggatccatcgcgacccagcagccggaaagcaacattctcgatatcgacctgcggcccgcctctgcttggacactttacgccgtggctaccacattcgtcacccctatgctgagacactccattgagaatagctccgttaacgtgtctctcacggccatcgcgaatcaggccaccgtgctgatgggcctggggaaaggatggcccctcagcaagatggatatcggcgtccctcttctggctattgggtgttactcccaagtgaaccccatcacactgaccgccgctctcctgcttctggttgcccattatgctattatcggacctggcctccaggccaaagcgacacgggaggcccagaagcgcgctgccgctggcattatgaagaatccgaccgtggacgggatcacggtcatcgatctggaccccattccttacgatcccaaatttgaaaagcagctgggacaagtgatgctccttgtcctgtgcgtgacacaggttctgatgatgagaaccacatgggccctctgtgaggccctgacccttgcgaccggccctatctctacactgtgggaagggaaccccggacggttctggaatacgaccattgctgtgagcatggccaacatctttcgcggctcctatctcgctggggccggactgctgttcagcattatgaaaaatacaaccaacacaagacggggcaccggcaacatcggggagacgctcggagaaaagtggaaatctcgccttaatgccctgggcaagtccgagagccagatctacaaaaagtctgggattcaagaggtcgacagaacactggctaaggaaggaatcaaacggggcgagaccgatcaccatgccgtgtcccgcgggagcgcgaagctcagatggtttgttgaacggaacatggtgaccccggagggaaaagtcgtggacctgggctgcggcagagggggatggtcttattactgtggcgggattaagaatgtgcgcgaggttaaaggacttacaaagggcgggcctggacacgaagaacccatccccatgagcacctatggctggaacctggtccggctccagtccggcgtggatgtgttcttcattcctcccgaaaagtgcgacacactgctgtgtgatatcggggagtctagccctaatccgacggtcgaagccggaagaaccctccgcgttcttaacctggtggagaattggctgaacaataacacacagttttgcatcaaagtgctcaatccctacatgccttccgtcattgagaagatggaagctctgcagcggaaatacggcggggcccttgtgagaaaccccctgagccgcaattccacccatgagatgtattgggtttctaacgctagcggaaatatcgtgtcctctgtcaacatgattagccggatgctcatcaacagattcacaatgcgccacaagaaagccacctacgaacctgacgtggacctgggctccgggacgcggaatattggaatcgagtctgaaattcccaacctggatatcatcggcaagagaattgagaagatcaaacaagagcacgaaaccagctggcattatgaccaggatcacccgtacaagacatgggcgtatcatggctcctacgagaccaaacagacagggagcgcctcttccatggttaatggagtggtccgcctccttaccaagccttgggacgtgctgcccacagtgacccagatggctatgacggatacaaccccttttggccaacagcgggtcttcaaagaaaaggttgacaccagaacacaggagcccaaggaagggacgaaaaagctgatgaaaattaccgccgagtggctctggaaggagctgggcaaaaagaaaacacctcgcatgtgtaccagagaagagtttacacggaaggtgcgcagcaacgctgcccttggcgctatcttcaccgatgaaaataagtggaaatctgccagagaggcggtggaggactcccggttttgggaactggtcgataaggagagaaacctccacctggaagggaaatgcgagacatgtgtgtataatatgatgggaaagcgggagaaaaagctgggcgagttcggcaaggccaaagggagccgcgctatttggtacatgtggctcggagccagatttctggagttcgaagctcttggctttctgaacgaggaccactggttctctcgggaaaattccctcagcgggctggagggagaaggccttcataagctggggtacatcctccgcgatgtttccaaaaaggagggcggagccatgtatgccgacgacaccgcgggctgggatacgagaatcaccctggaggacctgaaaaacgaagagatggtgacaaatcacatggaaggggagcataagaagctcgctgaagccatttttaaactgacctaccagaacaaggtcgtgcgggttcaacgccccacaccgagaggaaccgtgatggatatcattagccggcgcgaccagagaggctctgggcaggtcggaacgtatggccttaatacattcaccaacatggaggcccaactgatccggcagatggagggggaaggcgtgttcaaaaatattcagcacctcacagctaccgaggaaatcgccgttcagaactggctggctcgcgtgggaagagagcggcttagccgcatggccatctccggcgatgactgcgtcgtgaagcctctggatgacagatttgcgtctgccctcacggctctgaacgatatggggaaaattcggaaggacatccaacagtgggagcccagcagaggatggaatgattggacccaggtccccttctgctcccatcactttcacgaactgattatgaaggacggccgcgtgctcgttgtgccttgtcggaaccaggatgagctgatcgggagagcccgcatttctcaaggagctggctggagccttcgggaaacagcctgcctggggaaatcctacgcgcagatgtggtctctcatgtatttccatagacgcgacctgcggcttgccgctaatgccatctgtagcgctgtcccgtcccactgggtgcccaccagcagaacaacctggtctattcatgccaagcacgagtggatgacaaccgaagacatgctgacggtgtggaaccgcgtttggatccaggagaatccttggatggaggataaaacacccgtggaatcctgggaggaaatcccttacctcggcaagcgggaggaccagtggtgcggaagcctgattggcctgacctctagagctacctgggccaaaaacatccaagcggccattaatcaggtccgctccctcatcgggaacgaagagtatacagattacatgcccagcatgaagcggtttagacgggaggaagaggaagctggagtgctgtggtga

SEQ ID NO: 20343 - RNA, 9876 nt, synthetic construct
  misc_feature 1..9876: note = derived and/or modified CDS sequence (opt5) from DENV-2__AF169684__SS-prME
  source 1..9876: mol_type = other RNA
agcgctggcatgatcattatgctgatccccaccgtgatggctttccacctgacaacgagaaatggggaacctcatatgattgtctccatccaggaaaagggaaaatctctgctttttaagaccgaagacggcgttaatatgtgcacactgatggccatggatctcggggaactgtgtgaagacaccattacatacaaatgcccgcttctgcggcaaaatgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcagaatccccttcgaaatcatggacctcgagaaacgctacgttctgggacggctgattacggtgaaccctatcgtcaccgaaaaggattccccggtgaacattgaggccgaacccccttttggcgacagctacatcattatcggggttgagcccggccagctcaaactgaattggttcaagaagggatctagcattggccaaatgtttgagacaaccatgagaggggctaaacgcatggccatccttggagatacagcctgggacttcggctccctcgggggagtgtttacctctatcggcaaggctctccatcaggtcttcggggccatttatggcgcggcttttagcggagtgtcctggacgatgaaaatcctgattggcgtgatcattacatggatcgggatgaacagccggtctacctccctgagcgtttctcttgtcctcgtgggaatcgtgaccctgtacctgggcgtcatggtgcaggccgattccgggtgtgttgtgagctggaagaataaagaactcaagtgcggatccggcattttcatcacagacaacgtccacacctggacagagcagtataagtttcaacctgaatctcccagcaaactggcctccgctattcagaaggcccaggaggaagggatctgtggcattagatctgtgacgcgccttgagaatctgatgtggaaacagatcaccccggagctcaaccacatcctggctgaaaatgaggttaagctgacaattatgaccggagatatcaaaggcattatgcaagccgggaagcggagccttagacctcagcccacagaactcaaatactcctggaagacctggggaaaggcgaaaatgctgagcacggagtctcataaccagaccttcctgatcgacggccctgaaacagccgagtgccccaataccaaccgcgcttggaactccctcgaggtggaagattatgggtttggagtcttcacaaccaacatttggctgaaacttaaagagaagcaggacgccttttgtgacagcaaactgatgtctgctgccatcaaggataatcgggcggtgcacgccgacatgggctactggatcgaatccgctctcaacgatacatggaagattgagaaagccagcttcatcgaggttaagaattgccattggcctaaatctcacaccctgtggagcaacggcgtgctggaatccgagatgattatccccaagaaccttgctgggccggtcagccaacacaattatagacctggataccatacgcagattgccggcccctggcacctcgggaaactggaaatggacttcgatttttgtgacggaacaaccgtggtggtcaccgaggattgcggcaaccgcgggccctctctgcggacaaccacggcctccggaaagctcatcacagaatggtgctgtagaagctgcaccctgcctccgcttcggtaccgcggcgaggacggctgttggtatgggatggagattagacccctgaaggaaaaagaggaaaatctcgttaactccctggtgacagctggacatggccaggtggataatttctctctgggggtccttggaatggcgctctttctggaggaaatgctgcggaccagagtgggcacaaagcacgccatcctcctggttgctgtgagcttcgtcacccttatcacggggaacatgtcctttaaagacctgggacgcgtggttgtgatggtcggcgccaccatgacagatgacattggcatgggggtgacctacctcgccctgctggctgccttcaaggttcggcctacatttgcggctggacttctgctcagaaaactgacctctaaggagctcatgatgacgacaatcggcattgtgctgcttagccaatccaccatccccgagacaattctggaactcaccgatgccctggccctggggatgatggtccttaagatcgtgcgcaatatggagaaatatcagctggctgtgaccatcatggccattctctgcgtccctaacgcggttatcctgcagaatgcttggaaggtgtcttgtacaattctcgccgtggtcagcgtgagccccctgatccttacgagctctcagcagaagaccgactggattcctctggccctcacaatcaagggactgaaccccaccgctatcttcctgacaaccctttccagaacgaataaaaagcggagctggccgctgaacgaagccattatggctgttggcatggtgtctatcctcgcctccagcctgctcaaaaatgacattcctatgacagggcccctggtcgcgggaggccttctgaccgtgtgctacgttctgaccggccgctctgccgatctcgagctggaaagagctacagacgtgaagtgggaggatcaggccgagatctcccggagctcccctattcttagcatcaccatttctgaagacgggagcatgtccatcaagaacgaggaagaggagcagacactgacgatcctcattcgcaccggactgctcgtcatctctggcctgtttcccgtgagcattccgatcacagctgccgcctggtatctttgggaagtcaaaaagcagagagctggggtgctgtgggatgttccttctccccctcccatgggaaaagcggagctggaagacggcgcctaccggattaagcaaaaagggatcctcggatatagccagatcggcgctggcgtgtacaaggaggggaccttccatacaatgtggcacgtcacccgcggagccgtgctgatgcacaagggcaaaagaattgaacccagctgggccgatgttaagaaagaccttatctcctacgggggaggctggaagctggagggggagtggaaagaaggagaggaagtgcaggtcctcgctctggagcctggcaagaatccgcgggccgtgcagacgaagcccggcctctttaaaaccaacacagggaccattggagcggtgtctctggatttcagccctggcacatccgggagccccatcattgacaagaaaggaaaggttgtcggcctttatgggaacggagtggtgacccgctctggcgcttacgtctccgccatcgcccaaacagagaaatccatcgaggataatcctgagattgaagacgatatctttagaaagcggagactgacgattatggacctgcatcccggcgctgggaagaccaaaaagtatctccctgccatcgtgcgcgaggcgattaaacggggactgagaacacttatcctggctccgacccgcgttgtggccgccgaaatggaggaagctctccggggcctgcccattagataccagacccctgccatccgcgctgagcacacagggcgggagatcgtcgacctcatgtgtcatgccacgttcaccatgagactgctttctcccgtgcgcgttcctaactataatctgattatcatggatgaagcgcacttcacagaccccgcctccattgctgcccggggatacatcagcaccagagtggagatgggcgaagctgccgggatttttatgacagccaccccgcctggctcccgggatcccttcccccagtctaacgctcctatcatcgacgaggagcgcgaaattcccgagagaagctggaactccggacatgaatgggtcacggattttaagggcaaaacagtgtggttcgttcctagcatcaaggcggggaacgacattgccgcttgcctgcggaagaatggcaaaaaggtgatccaactctctcgcaaaacctttgattccgagtatgtcaagaccagaacaaacgactgggatttcgtggtgaccacagacattagcgaaatgggcgccaattttaaagccgagcgggtcatcgatccgagacgctgtatgaagcccgttatcctgaccgacggggaggaacgggtgattcttgctggacctatgcccgtgacgcacttctctgccgcgcagagacgcggccggatcgggagaaaccctaaaaatgagaacgaccagtacatttacatgggcgaacccctggagaatgatgaagactgcgctcactggaaggaggccaagatgctcctggataacatcaatacaccggagggaattatccctagcatgtttgaacccgagcgcgaaaaagtcgacgccattgatggcgagtatcggctgagaggggaagctcgcaagaccttcgtggacctcatgagacggggagatcttcctgtttggctggcctacaaagtggcggccgagggcatcaactatgctgaccgcagatggtgttttgatgggatcaagaacaatcagattctggaggaaaacgtcgaggtggaaatctggacaaaagagggagagcggaagaagctcaaaccccgctggctggacgccagaatttactccgatcctcttgctctgaaggagttcaaagagttcgccgctggccggaagtctctcgccctgaatctgatcaccgaaatggggagactccccacgtttatgacccagaaaacccgcgacgcgcttgataacctggccgttctgcataccgctgaggccggcggacgggcttataatcacgccctcagcgaactgccggagacacttgagaccctgctcctgctgacactccttgccaccgtgacgggcgggattttcctgtttctgatgtccggaagaggcatcgggaagatgacactcggaatgtgctgcatcattaccgcttctatcctgctttggtacgcgcagattcagcctcattggatcgccgctagcattatcctggagttctttctcatcttcctgctgattcccgagcccgaaaagcagcgcacccctcaagacaaccagctcacatatgtcgtgatcgccattcttaccgtcgtggccgctacaatggccaatgagatgggctttctggagaaaacgaagaaagacctgggcttcgggtccatcgcgacccagcagccggagagcaacattctcgatatcgacctgcggcccgcctctgcttggacactttacgccgttgctaccacatttgtgacccctatgctgagacactccattgagaatagctccgtgaacgtctctctcacggccatcgcgaatcaagccaccgttctgatgggactgggcaaggggtggcccctcagcaaaatggatatcggagtgcctcttctggctattggctgttactcccaggtgaaccccatcacactgaccgccgctctcctgcttctggtcgcccactatgctattatcgggcctggactccaggccaaggcgacacgggaagcccagaagcgcgctgccgctggcattatgaaaaatccgaccgtggacggcatcacggttatcgatctggaccccattccttacgatcccaagttcgagaaacaactggggcaagtgatgctccttgtcctgtgcgtgacacaggtcctgatgatgagaaccacatgggccctctgtgaagccctgacccttgcgaccggacctatctctacactgtgggagggcaaccccgggcggttttggaatacgaccattgctgtgagcatggccaacatcttccgcggatcctatctcgctggcgccgggctgctgtttagcattatgaagaatacaaccaacacaagacggggaaccggcaacatcggcgaaacgctcggggagaaatggaagtctcgccttaatgccctgggaaaatccgagttccaaatctacaaaaagagcggcattcaggaagttgacagaacactggctaaggaggggatcaagcggggagaaaccgatcatcacgccgtgtctcgcggctccgcgaaactcagatggttcgtcgagcggaacatggtgaccccggaggggaaggttgtggacctgggatgcggcagaggcgggtggagctattactgtggaggccttaaaaatgtccgcgaagtgaaggggctgacaaagggaggccctgggcatgaggaacccattcccatgtctacctatggatggaacctcgtgcggctgcagagcggcgttgatgtctttttcatccctcccgagaaatgcgacacactgctctgtgatattggcgaatcctctcctaatccgacggtggaggccgggagaacccttcgcgtgctgaacctggtcgagaattggctcaacaataacacacagttttgcatcaaggttctgaatccctacatgcctagcgtgatcgagaaaatggaggcccttcaacggagatacggaggcgccctggtgcgcaaccccctctcccggaatagcacccacgaaatgtattgggtctccaacgcttctgggaatattgtgagctccgttaacatgatctctagaatgctgattaaccgcttcacaatgaagcataaaaaggccacctacgagcctgacgtggacctgggaagcggcacgcggaatatcgggattgaatccgaggtccccaacctcgatatcattggaaagagaatcgagaaaatcaagcaggaacacgagacctcttggcactatgaccaggatcatccgtacaaaacatgggcgtatcacggcagctacgaaaccaagcagacaggctccgccagctctatggtgaatggggttgtgcgccttctgaccaaaccttgggacgtcctgcccacagtgacccaaatggctatgacggatacaaccccttttggacagcagcgggtgttcaaggagaaggtcgacaccagaacacaggaacccaaagagggcacgaagaaactcatgaagattaccgccgagtggctgtggaaagaacttgggaagaaaaagacacctcgcatgtgtaccagagaggaatttacacggaaggttcgctccaacgctgccctgggagctatcttcaccgatgagaataaatggaagtccgccagagaggcggtggaagactctcggttttgggagctcgtggataaagaaagaaacctgcatctggagggcaagtgcgaaacatgtgtctataatatgatggggaaacgggagaagaagctcggagagttcggcaaagccaagggctcccgcgctatttggtacatgtggctgggggccagatttcttgagttcgaggctctgggatttctcaacgaagaccactggttcagccgggaaaattctctgtccggcgtggaaggggagggacttcacaaactgggctacatcctccgcgatgttagcaagaaagaagggggagccatgtatgccgacgacaccgcgggatgggatacgagaattaccctggaagacctgaagaacgaggaaatggtgacaaatcatatggagggcgaacacaagaaactcgctgaggccatcttcaagctgacctaccaaaacaaagtcgtgcgggttcagcgccccacaccgagagggaccgtgatggatatcatttcccggcgcgaccagagaggaagcggccaagtcgggacgtatggacttaatacatttaccaacatggaggcccagctgatccggcagatggaaggcgagggggtgttcaagaatattcagcatctcacagctaccgaagagatcgccgttcaaaactggctggctcgcgtgggcagagagcggctttctcgcatggccattagcggagatgactgcgtcgtgaaacctctggatgacagatttgcgtccgccctcacggctctgaacgatatgggcaagatccggaaggacatccagcagtgggaaccctctagagggtggaatgattggacccaggtccccttctgcagccaccattttcacgagctgattatgaaagacggacgcgtgctcgttgtgccttgtcggaaccaagatgaactgatcggcagagcccgcatttcccagggggctggatggtctcttcgggagacagcctgcctgggcaagagctacgcgcagatgtggtccctcatgtatttccacagacgcgacctgcggcttgccgctaatgccatctgttctgctgtcccgagccattgggtgcccacctccagaacaacctggagcattcacgccaaacatgaatggatgacaaccgaggacatgctgacggtgtggaaccgcgtttggatccaggagaatccttggatggaagataagacacccgtggagtcttgggaagagattccttacctcgggaaacgggaagaccaatggtgcggctccctgatcggactgaccagcagagctacctgggccaagaacatccaggcggccattaatcaggtccgctctctcatcggcaacgaggagtatacagattacatgccctccatgaagcggtttagacgggaagaggaagaggctggggtgctgtggtga

SEQ ID NO: 20344 - RNA, 9876 nt, synthetic construct
  misc_feature 1..9876: note = derived and/or modified CDS sequence (opt5) from DENV-2__AF169685__SS-prME
  source 1..9876: mol_type = other RNA
agcgctggcatgatcattatgctgatccccaccgtgatggctttccacctgaccacgagaaatggggagcctcatatgattgtctccatccaggaaaagggaaaatctctgctttttaagaccgaggacggcgttaatatgtgcacgctgatggccatggatctcggggaactgtgtgaggacaccattacatacaaatgcccgcttctgcggcaaaatgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcagaatccccttcgaaatcatggacctcgagaaacgctacgttctgggacggctgattacggtgaaccctatcgtcaccgaaaaggattccccggtgaacattgaggccgaacccccttttggcgacagctacatcattatcggggttgagcccggccagctcaaactgaattggttcaagaagggatctagcattggccaaatgtttgagacaaccatgagaggggctaaacgcatggccatccttggagatacagcctgggacttcggctccctcgggggagtgtttacctctatcggcaaggctctccatcaggtcttcggggccatttatggcgcggcttttagcggagtgtcctggacgatgaaaatcctgattggcgtgatcattacatggatcgggatgaacagccggtctacctccctgagcgtttctcttgtcctcgtgggaatcgtgaccctgtacctgggcgtcatggtgcaggccgattccgggtgtgttgtgagctggaagaataaagaactcaagtgcggatccggcattttcatcacagacaacgtccacacctggacagagcagtataagtttcaacctgaatctcccagcaaactggcctccgctattcagaaggcccaggaggaagggatctgtggcattagatctgtgacgcgccttgagaatctgatgtggaaacagatcaccccggagctcaaccacatcctggctgaaaatgaggttaagctgacaattatgaccggagatatcaaaggcattatgcaagccgggaagcggagccttagacctcagcccacagaactcaaatactcctggaagacctggggaaaggcgaaaatgctgagcacggagtctcataaccagaccttcctgatcgacggccctgaaacagccgagtgccccaataccaaccgcgcttggaactccctcgaggtggaagattatgggtttggagtcttcacaaccaacatttggctgaaacttaaagagaagcaggacgccttttgtgacagcaaactgatgtctgctgccatcaaggataatcgggcggtgcacgccgacatgggctactggatcgaatccgctctcaacgatacatggaagattgagaaagccagcttcatcgaggttaagaattgccattggcctaaatctcacaccctgtggagcaacggcgtgctggaatccgagatgattatccccaagaaccttgctgggccggtcagccaacacaattatagacctggataccatacgcagattgccggcccctggcacctcgggaaactggaaatggacttcgatttttgtgacggaacaaccgtggtggtcaccgaggattgcggcaaccgcgggccctctctgcggacaaccacggcctccggaaagctcatcacagaatggtgctgtagaagctgcaccctgcctccgcttcggtaccgcggcgaggacggctgttggtatgggatggagattagacccctgaaggaaaaagaggaaaatctcgttaactccctggtgacagctggacatggccaggtggataatttctctctgggggtccttggaatggcgctctttctggaggaaatgctgcggaccagagtgggcacaaagcacgccatcctcctggttgctgtgagcttcgtcacccttatcacggggaacatgtcctttaaagacctgggacgcgtggttgtgatggtcggcgccaccatgacagatgacattggcatgggggtgacctacctcgccctgctggctgccttcaaggttcggcctacatttgcggctggacttctgctcagaaaactgacctctaaggagctcatgatgacgacaatcggcattgtgctgcttagccaatccaccatccccgagacaattctggaactcaccgatgccctggccctggggatgatggtccttaagatcgtgcgcaatatggagaaatatcagctggctgtgaccatcatggccattctctgcgtccctaacgcggttatcctgcagaatgcttggaaggtgtcttgtacaattctcgccgtggtcagcgtgagccccctgatccttacgagctctcagcagaagaccgactggattcctctggccctcacaatcaagggactgaaccccaccgctatcttcctgacaaccctttccagaacgaataaaaagcggagctggccgctgaacgaagccattatggctgttggcatggtgtctatcctcgcctccagcctgctcaaaaatgacattcctatgacagggcccctggtcgcgggaggccttctgaccgtgtgctacgttctgaccggccgctctgccgatctcgagctggaaagagctacagacgtgaagtgggaggatcaggccgagatctccgggagctcccctattcttagcatcaccatttctgaagacggaagcatgtccatcaagaacgaggaagaggagcagacactgacgatcctcattcggaccggcctgctcgtcatctctgggctgtttcccgtgagcattccgatcacagctgccgcctggtatctttgggaagtcaaaaagcagcgcgctggagtgctgtgggatgttccttctccccctcccatgggcaaagcggagctggaagacggggcctacagaattaagcaaaaaggaatcctcggctatagccagatcggcgctggggtgtacaaggagggaaccttccatacaatgtggcacgtcacccggggcgccgtgctgatgcacaaggggaaacgcattgaacccagctgggccgatgttaagaaagaccttatctcctacggaggcgggtggaagctggagggagagtggaaagaaggcgaggaagtgcaggtcctcgctctggagcctggcaagaatccgagagccgtgcagacgaagcccgggctctttaaaaccaacacaggaaccattggcgcggtgtctctggatttcagccctgggacatccggaagccccatcattgacaagaaaggcaaggttgtcgggctttatggaaacggcgtggtgacccggtctggcgcttacgtctccgccatcgcccaaacagagaaatccatcgaggataatcctgagattgaagacgatatctttcgcaagagacggctgacgattatggacctgcatcccggggctggaaagaccaaaagatatctccctgccatcgtgcgcgaggcgattaagcggggcctgagaacacttatcctggctccgacccgcgttgtggccgccgaaatggaggaagctctccgggggctgcccattagataccagacccctgccatccgcgctgagcacacaggacgggagatcgtcgacctcatgtgtcatgccacgttcaccatgagactgctttctcccgtgcgcgttcctaactataatctgattatcatggatgaagcgcacttcacagaccccgcctccattgctgcccggggctacatcagcaccagagtggagatgggggaagctgccggcatttttatgacagccaccccgcctggatcccgggatcccttcccccagtctaacgctcctatcatcgacgaggagcgcgaaattcccgagagaagctggaactccggccatgaatgggtcacggattttaaagggaagacagtgtggttcgttcctagcatcaaagcgggaaacgacattgccgcttgcctgcggaagaatggcaagaaagtgatccaactctctcgcaagacctttgattccgagtatgtcaaaaccagaacaaacgactgggatttcgtggtgaccacagacattagcgaaatgggggccaattttaaggccgagcgggtcatcgatccgagacgctgtatgaaacccgttatcctgaccgacggagaggaacgggtgattcttgctggccctatgcccgtgacgcacttctctgccgcgcagagacgcgggcggatcggcagaaaccctaagaatgagaacgaccagtacatttacatgggagaacccctggagaatgatgaagactgcgctcactggaaagaggccaagatgctcctggataacatcaatacaccggagggcattatccctagcatgtttgaacccgagcgcgaaaaggtcgacgccattgatggggagtatcggctgagaggagaagctcgcaaaaccttcgtggacctcatgagacggggcgatcttcctgtttggctggcctacaaggtggcggccgaggggatcaactatgctgaccgcagatggtgttttgatggaatcaaaaacaatcagattctggaggaaaacgtcgaggtggaaatctggacaaaggagggcgagcggaaaaagctcaagccccgctggctggacgccagaatttactccgatcctcttgctctgaaagagttcaaggagttcgccgctgggcggaaatctctcgccctgaatctgatcaccgaaatgggcagactccccacgtttatgacccaaaagacacgcgacgcgcttgataacctggccgttctgcataccgctgaggccggaggccgggcttataatcacgccctcagcgaactgccggagacacttgagaccctgctcctgctgacactccttgccaccgtgacagggggaattttcctgtttctgatgtccggcagagggatcggaaaaatgacactcggcatgtgctgcatcattaccgcttctatcctgctttggtacgcgcagattcagcctcattggatcgccgctagcattatcctggtcttctttctcatcgtgctgctgattcccgaacccgagaagcagcgcacccctcaagacaaccagctcacatatgtcgtgatcgccattcttaccgttgtggccgctacaatggccaatgaaatgggcttcctggagaagacgaaaaaggacctggggtttggatccatcgcgacccagcagccggaaagcaacattctcgatatcgacctgcggcccgcctctgcttggacactttacgccgtggctaccacattcgtcacccctatgctgagacactccattgagaatagctccgttaacgtgtctctcacggccatcgcgaatcaagccaccgtgctgatgggcctggggaaaggatggcccctcagcaagatggatatcggcgtccctcttctggctattgggtgttactcccaggtgaaccccatcacactgaccgccgctctcctgcttctggttgcccactatgctattatcggacctggcctccaggccaaagcgacacgggaggcccagaagcgcgctgccgctggcattatgaagaatccgaccgtggacgggatcacggtcatcgatctggaccccattccttacgatcccaaatttgaaaagcaactgggacaggtgatgctccttgtcctgtgcgtgacacaggttctgatgatgagaaccacatgggccctctgtgaggccctgacccttgcgaccggccctatctctacactgtgggaagggaaccccggacggttctggaatacgaccattgctgtgagcatggccaacatctttcgcggctcctatctcgctggggccggactgctgttcagcattatgaaaaatacaaccaacacaagacggggcaccggcaacatcggggagacgctcggagaaaagtggaaatctcgccttaatgccctgggcaagtccgagtttcaaatctacaaaaagagcgggattcaggaggtcgacagaacactggctaaggaaggaatcaaacggggcgagaccgatcatcacgccgtgtctcgcgggtccgcgaagctcagatggttcgttgaacggaacatggtgaccccggagggaaaagtcgtggacctgggctgcggcagagggggatggagctattactgtggcgggcttaagaatgtgcgcgaggttaaaggactgacaaagggcgggcctggacatgaagaacccattcccatgtctacctatggctggaacctcgtccggctgcagagcggcgtggatgtgttctttatccctcccgaaaagtgcgacacactgctctgtgatattggggagtcctctcctaatccgacggtcgaagccggaagaacccttcgcgttctgaacctggtggagaattggctcaacaataacacacagttctgcatcaaagtgctgaatccctacatgcctagcgtcatcgagaagatggaagcccttcaacggagatacggcggggccctggtgcgcaaccccctctcccggaatagcacccacgagatgtattgggtttccaacgcttctggaaatattgtgagctccgtcaacatgatctctagaatgctgattaaccgctttacaatgcggcataaaaaggccacctacgaacctgacgtggacctgggcagcgggacgagaaatatcggaattgagtccgaagttcccaacctcgatatcattggcaaacgcatcgagaagatcaagcaggagcacgaaacctcttggcactatgaccaggatcatccgtacaaaacatgggcgtatcacggcagctacgagaccaagcagacagggtccgccagctctatggtgaatggagtcgtgcggcttctgaccaaaccttgggacgtgctgcccacagtcacccaaatggctatgacggatacaacccctttcggccagcagagagtttttaaggaaaaagtggacacccgcacacaggagcccaaggaagggacgaagaaactcatgaagattaccgccgagtggctgtggaaagagcttggaaagaaaaagacacctagaatgtgtacccgggaagagttcacacgcaaagtgagatccaacgctgccctgggcgctatctttaccgatgaaaataagtggaaaagcgcccgggaggcggtcgaggactctagattctgggaactcgtggataaggagcggaacctgcatctggaagggaagtgcgagacatgtgtttataatatgatgggaaaacgcgaaaagaaactcggcgagtttggcaaggccaaggggtccagagctatttggtacatgtggctgggagcccggttccttgagtttgaagctctgggcttcctcaacgaggaccactggtttagccgcgaaaattctctgtccggggtggagggagaaggccttcacaaactggggtacatcctcagagatgtcagcaagaaagagggcggagccatgtatgccgacgacaccgcgggctgggatacgcggattaccctggaggacctgaagaacgaagagatggtgacaaatcatatggaaggggagcacaaaaagctcgctgaagccatcttcaagctgacctaccaaaacaaagttgtgcgcgtccagagacccacaccgcggggaaccgtgatggatatcatttcccgcagagaccagcggggcagcgggcaagttggaacgtatggccttaatacattcaccaacatggaggcccagctgatccgccagatggagggggaaggcgtgtttaagaatattcagcatctcacagctaccgaggaaatcgccgtccaaaactggctggctagagtgggacgggagcgcctttctagaatggccattagcggcgatgactgcgtcgtgaaacctctggatgaccggttcgcgtccgccctcacggctctgaacgatatggggaagatcagaaaagacatccagcagtgggagccctctcgcggatggaatgattggacccaggttcccttttgcagccaccatttccacgaactgattatgaaggacggccgggtgctcgtcgtgccttgtagaaaccaagatgagctgatcgggcgcgcccggatttcccagggagctggctggtctcttagagaaacagcctgcctggggaagtcctacgcgcagatgtggtccctcatgtattttcaccgccgggacctgagacttgccgctaatgccatctgttctgctgtgccgagccattgggttcccacctcccgcacaacctggagcattcacgccaaacatgagtggatgacaaccgaagacatgctgacggtgtggaaccgggtctggatccaggagaatccttggatggaggataagacacccgtggaatcttgggaggaaattccttacctcggcaaaagagaggaccaatggtgcggatccctgatcggcctgaccagccgcgctacctgggccaagaacatccaggcggccattaatcaggttcggtctctcatcgggaacgaagagtatacagattacatgccctccatgaaaagattccggagagaggaagaggaagctggagtgctgtggtga

SEQ ID NO: 20345 - RNA, 9876 nt, synthetic construct
  misc_feature 1..9876: note = derived and/or modified CDS sequence (opt5) from DENV-2__AF169686__SS-prME
  source 1..9876: mol_type = other RNA
agcgctggcatgatcattatgctgatccccaccgtgatggctttccacctcacgacgagaaatggggagcctcatatgattgtctccatccaagaaaagggaaaatctctgctttttaagaccgaggacggcgttaatatgtgcacactgatggccatggatctcggggaactgtgtgaggacaccattacatacaaatgcccgcttctgcggcaaaatgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcagaatccccttcgaaatcatggacctcgagaaacgctacgttctgggacggctgattacggtgaaccctatcgtcaccgaaaaggattccccggtgaacattgaggccgaacccccttttggcgacagctacatcattatcggggttgagcccggccagctcaaactgaattggttcaagaagggatctagcattggccaaatgtttgagacaaccatgagaggggctaaacgcatggccatccttggagatacagcctgggacttcggctccctcggcggggtgtttacctctatcgggaaggctctccatcaggtcttcggggccatttatggcgcggcttttagcggagtgtcctggacgatgaaaatcttcattggcgtgatcattacatggatcgggatgaacagccggtctacctccctgagcgtttctctggtccttgtgggaatcgtgaccctctacctgggcgtcatggtgcaggccgattccgggtgtgttgtgagctggaagaataaagaactgaagtgcggatccggcatttttatcacagacaacgtccacacctggacagagcagtataagttccaacctgaatctcccagcaaactcgcctccgctattcagaaggcccaggaggaagggatctgtggcattagatctgtgacgcgcctggagaatcttatgtggaaacagatcaccccggagctgaaccacatcctcgctgaaaatgaggttaagctgacaattatgaccggagatatcaaaggcattatgcaagccgggaagcggagcctgagacctcagcccacagaacttaaatactcctggaagacctggggaaaggcgaaaatgctcagcacggagtctcataaccagacctttctgatcgacggccctgaaacagccgagtgccccaataccaaccgcgcttggaactccctggaggtggaagattatgggttcggagtctttacaaccaacatttggctcaagctgaaagagaagcaggacgccttctgtgacagcaaacttatgtctgctgccatcaaggataatcgggcggtgcacgccgacatgggctactggatcgaatccgctctgaacgatacatggaagattgagaaagccagcttcatcgaggttaagaattgccattggcctaaatctcacaccctctggagcaacggcgtgctggaatccgagatgattatccccaagaacctggctgggccggtcagccaacacaattatagacctggataccatacgcagattgccggcccctggcaccttgggaaactcgaaatggactttgatttctgtgacggaacaaccgtggtggtcaccgaggattgcggcaaccgcgggccctctctgcggacaaccacggcctccggaaagctgatcacagaatggtgctgtagaagctgcaccctccctccgctgcggtaccgcggcgaggacggctgttggtatgggatggagattagaccccttaaggaaaaagaggaaaatctggttaactccctcgtgacagctggacatggccaggtggataatttttctctgggggtcctgggaatggcgcttttcctcgaggaaatgctgcggaccagagtgggcacaaagcacgccatcctgctcgttgctgtgagctttgtcaccctgatcacggggaacatgtccttcaaagaccttggacgcgtggttgtgatggtcggcgccaccatgacagatgacattggcatgggggtgacctacctggccctcctggctgcctttaaggttcggcctacattcgcggctggactgcttctgagaaaactcacctctaaggagctgatgatgacgacaatcggcattgtgctcctgagccaatccaccatccccgagacaattcttgaactgaccgatgccctcgccctggggatgatggtcctgaagatcgtgcgcaatatggagaaatatcagcttgctgtgaccatcatggccattctgtgcgtccctaacgcggttatcctccagaatgcttggaaggtgtcttgtacaattctggccgtggtcagcgtgagccccctgatcctgacgagctctcagcagaaaaccgactggattcctcttgccctgacaatcaagggactcaaccccaccgctatctttctgacaaccctgtccagaacgaataaaaagcggagctggccggttaacgaagccattatggctgtgggcatggtctctatccttgcctccagcctgctcaaaaatgacattcctatgacagggcccctggtggcgggaggcctcctgaccgtttgctacgtgcttaccggccgctctgccgatctggagctggaaagagctacagacgtcaagtgggaggatcaggccgagatctccgggagctcccctattctcagcatcaccatttctgaagacggaagcatgtccatcaagaacgaggaagaggagcagacactgacgatccttattcggaccggcctgctcgtgatctctgggctgttccccgtcagcattccgatcacagctgccgcctggtatctctgggaagtgaaaaagcagcgcgctggagttctgtgggatgtgccttctccccctcccatgggcaaagcggagcttgaagacggggcctacagaattaagcaaaaaggaatcctgggctatagccagatcggcgctggggtctacaaggagggaacctttcatacaatgtggcacgtgacccggggcgccgttctgatgcacaaggggaaacgcattgaacccagctgggccgatgtgaagaaagacctcatctcctacggaggcgggtggaagctggagggagagtggaaagaaggcgaggaagtccaggtgcttgctctggagcctggcaagaatccgagagccgtgcagacgaagcccggactcttcaaaaccaacacaggaaccattggcgcggtttctctggattttagccctgggacatccggaagccccatcattgacaagaaaggcaaggtcgtggggctctatggaaacggcgtggtcacccggtctggcgcttacgtgtccgccatcgcccaaacagagaaatccatcgaggataatcctgagattgaagacgatatcttccgcaagagacggctgacgattatggaccttcatcccggggctggaaagaccaaaaagtatctgcctgccatcgttagagaggcgattaaacgcggcctgcggacactcatcctggctccgaccagagtggtcgccgccgaaatggaggaagcccttcgcgggctgcccattcggtaccagacccctgccatcagagctgagcacacaggacgcgagatcgtggacctcatgtgtcatgccacgttcaccatgcggctgctctctcccgttagagtgcctaactataatctgattatcatggatgaagcgcactttacagaccccgcctccattgctgcccgcggctacatcagcacccgggtcgagatgggggaagctgccggcattttcatgacagccaccccgcctggatccagagatccctttccccagtctaacgctcctatcatcgacgaggagcgggaaattcccgagcgcagctggaactccggccatgaatgggtgacggatttcaaggggaaaacagtttggtttgtgcctagcatcaaggcgggaaacgacattgccgcttgccttagaaagaatggcaaaaaggtcatccaactgtctcggaaaaccttcgattccgagtatgtgaagacccgcacaaacgactgggattttgtggtcaccacagacattagcgaaatgggggccaatttcaaagccgagagagttatcgatccgcggagatgtatgaagcccgtgatcctgaccgacggagaggaacgcgtgattctcgctggccctatgcccgtcacgcacttttctgccgcgcagcggagagggcgcatcggccggaaccctaaaaatgagaacgaccagtacatttacatgggagaacccctggagaatgatgaagactgcgctcactggaaggaggccaagatgcttctggataacatcaatacaccggagggcattatccctagcatgttcgaacccgagagagaaaaagtggacgccattgatggggagtatcgcctccggggagaagctagaaagacctttgttgacctgatgcgcagaggcgatctgcctgtgtggctcgcctacaaagtcgcggccgaggggatcaactatgctgaccggcgctggtgtttcgatggaatcaagaacaatcagattcttgaggaaaacgtggaggttgaaatctggacaaaagagggcgagagaaagaagctgaaaccccggtggctggacgcccgcatttactccgatcctctcgctctgaaggagttcaaagagtttgccgctgggagaaagtctcttgccctgaatctcatcaccgaaatgggccggctgcccacgttcatgacccagaaaaccagagacgcgctggataacctcgccgtgcttcataccgctgaggccggaggccgcgcttataatcacgccctgagcgaactgccggagacactcgagaccctgcttctgctcacactgctggccaccgtcacaggcgggatttttctcttccttatgtccgggcgggggatcggaaagatgacactgggcatgtgctgcatcattaccgcttctatcctgctctggtacgcgcagattcagcctcattggatcgccgctagcattatcctggtgtttttccttatcgtcctgctcattcccgaacccgagaagcagagaacccctcaagacaaccagctgacatatgtggttatcgccattctgaccgtggtggccgctacaatggccaatgaaatgggctttctcgagaaaacgaagaaagaccttgggttcggatccatcgcgacccagcagccggaaagcaacattctggatatcgacctgcgccccgcctctgcttggacactctacgccgtcgctaccacatttgttacccctatgctgcggcactccattgagaatagctccgtgaacgtgtctcttacggccatcgcgaatcaagccaccgtcctgatgggcctcgggaagggatggcccctgagcaaaatggatatcggcgtgcctctgctcgctattgggtgttactcccaggttaaccccatcacacttaccgccgctctgctgctcctggtggcccactatgctattatcggacctggccttcaggccaaggcgacaagagaggcccagaagcgggctgccgctggcattatgaaaaatccgaccgtcgacgggatcacggtgatcgatctggaccccattccttacgatcccaagttcgaaaaacaactcggacaggtcatgctgctggtgctctgcgttacacaggtgcttatgatgcgcaccacatgggccctgtgtgaggccctgaccctcgcgaccggccctatctctacactgtgggaagggaaccccggaagattttggaatacgaccattgctgtcagcatggccaacatcttccggggctcctatcttgctggggccggactgctctttagcattatgaagaatacaaccaacacacgcagaggcaccggcaacatcggggagacgctgggagaaaaatggaagtctcggctgaatgccctcggcaaatccgagttccaaatctacaaaaagagcgggattcaggaggtggaccgcacacttgctaaggaaggaatcaagagaggcgagaccgatcatcacgccgtttctcgggggtccgcgaaactgcgctggttcgtggaaagaaacatggtcaccccggagggaaaggtggtggacctgggctgcggcagagggggatggagctattactgtggcgggctcaaaaatgttcgggaggtcaagggactgacaaagggcgggcctggacatgaagaacccattcccatgtctacctatggctggaaccttgtgcgcctgcagagcggcgtggatgtctttttcacacctcccgaaaaatgcgacacgctcctgtgtgatatcggggagtcctctcctaatccgaccgttgaagccggacggacactgagagtgctcaaccttgtggagaattggctgaacaataacacccagttttgcattaaggtcctgaatccctacatgcctagcgtgatcgagaaaatggaagctctccaacgccggtacggcggggccctggttagaaaccccctttcccgcaatagcacacacgagatgtattgggtgtccaacgcttctggaaatatcgtcagctccgtgaacatgatttctcggatgctgatcaacagattcaccatgaagcataaaaaggccacgtacgaacctgacgttgacctcggcagcgggacccgcaatattggaatcgagtccgaagtgcccaacctggatattatcggcaagcggattgagaaaatcaagcaggagcacgaaacatcttggcactatgaccaggatcatccgtacaaaacctgggcgtatcacggcagctacgagacaaagcagaccgggtccgccagctctatggtcaatggagtggtgagactgctcacaaaaccttgggacgtccttcccaccgttacgcaaatggctatgacagataccaccccttttggccagcagcgcgtgttcaaggaaaaggtggacacacggacgcaggagcccaaagaagggaccaagaaactgatgaagatcacagccgagtggctgtggaaagagctcggaaagaaaaagacccctagaatgtgtacacgcgaagagtttaccagaaaggtccggtccaacgctgccctgggcgctattttcacagatgaaaataaatggaagtccgcccgcgaggcggtggaggactctagattttgggaacttgttgataaagagcggaacctgcatctcgaagggaagtgcgagacctgtgtgtataatatgatgggaaaaagagaaaagaagctgggcgagttcggcaaagccaaggggtcccgggctatctggtacatgtggctgggagcccgctttctcgagttcgaaacgctgggctttcttaacgaggaccactggttcagcagagaaaattctctgtccggggtcgagggagaaggcctccacaaactggggtacattcttcgggatgtgagcaagaaagagggcggagctatgtatgccgacgacaccgccggctgggatacacgcatcaccctggaggacctcaagaacgaagagatggttacaaatcatatggaaggggagcacaagaaactggcggaagctattttcaagctgacctaccaaaacaaagtggtcagagtgcagcggcccacgccgcgcggaacagttatggatatcatctccagacgggaccagcgcggcagcgggcaagtgggaacctatggcctcaatacatttaccaacatggaggcccagctgattagacagatggagggggaaggcgtcttcaagaatatccagcatcttacggccaccgaggaaattgctgtgcaaaactggctggcccgggtcggacgcgagagactctctcggatggctatcagcggcgatgactgcgtggttaaacctctggatgaccgctttgcctccgcgcttacagccctgaacgatatggggaagattagaaaggacatccagcagtgggagccctctcggggatggaatgattggacccaggtgcccttctgcagccaccattttcacgaactcatcatgaaagacggcagagtcctggtggtgccttgtcgcaaccaagatgagctgattgggcgggctagaatctcccagggagccggctggtctctccgcgaaacagcttgcctgggaaagagctacgcccagatgtggtcccttatgtatttccaccggagagacctgcgcctcgcggccaatgctatttgttctgccgttccgagccattgggtgcccacctcccggacaacctggagcatccacgctaaacatgagtggatgacgacagaagacatgctggccgtctggaacagagtgtggattcaggagaatccttggatggaggataagacccccgttgaatcttgggaggaaatcccttaccttggcaaacgcgaggaccaatggtgcggatccctgattggcctcaccagccgggctacatgggccaagaacatccaggcggccatcaatcaggtgagatctctgattgggaacgaagagtataccgattacatgccctccatgaagcgctttcggagagaggaagaggaagctggagtcctgtggtga

SEQ ID NO: 20346 - RNA, 9876 nt, synthetic construct
  misc_feature 1..9876: note = derived and/or modified CDS sequence (opt5) from DENV-2__AF169687__SS-prME
  source 1..9876: mol_type = other RNA
agcgccggcatgatcattatgctgatccccaccgtgatggctttccacctgacaacgcggaacggggagcctcatatgattgtctccatccaggaaaaggggaaatctctgctttttaagaccgaggacggcgttaatatgtgcacactgatggccatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaggaacaggacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcagaatccccttcgaaatcatggacctcgagaaacgctacgttctgggacggctgattacggtgaaccctatcgtcaccgaaaaggattccccggtgaacattgaggccgaacccccttttggcgacagctacatcattatcggggttgagcccggccagctcaaactgaattggttcaagaagggatctagcattggccaaatgtttgagacaaccatgagaggggctaaacgcatggccatccttggagatacagcctgggacttcggctccctcggcggggtgtttacctctatcgggaaggctctccatcaggtcttcggggccatttatggcgcggcttttagcggagtgtcctggacgatgaaaatcctgattggcgtgatcattacatggatcgggatgaacagccggtctacctccctgagcgtttctcttgtcctcgtgggaatcgtgaccctgtacctgggcgtcatggtgcaggccgattccgggtgtgttgtgagctggaagaataaagaactcaagtgcggatccggcattttcatcacagacaacgtccacacctggacagagcagtataagtttcaacctgaatctcccagcaaactggcctccgctattcagaaggcccaggaggaagggatctgtggcattagatctgtgacgcgccttgagaatctgatgtggaaacagatcaccccggagctcaaccacatcctgagcgaaaatgaggttaagctgacaattatgaccggagatatcaaaggcattatgcatgctgggaagcggtcccttagacctcaacccacagaactcaaatacagctggaagacctggggaatcgccaagatgctgtctacggagtcccacaaccagaccttcctgattgacggccctgaaacagcggagtgccccaataccaaccgcgcctggaatagcctcgaggtggaagattatgggtttggagtcttcacaaccaacatctggctgaaacttaaggagaaacaggacgctttttgtgactctaagctgatgtccgccgctatcaaagataatcgggccgtgcatgcggacatgggctactggattgaaagcgccctcaacgatacatggaagatcgagaaggcttctttcattgaggttaaaaattgccactggcctaagagccacaccctgtggtccaacggcgtgctggaaagcgagatgatcattcccaaaaaccttgccgggccggtctctcagcataattatagacctggataccacacgcaaatcgctggcccctggcatctcgggaagctggaaatggacttcgatttttgtgacggaacaaccgtggtggtcaccgaggattgcggcaaccgcgggccctccctgcggacaaccacggccagcggaaaactcattacagaatggtgctgtagatcctgcaccctgcctccgcttcggtaccgcggcgaggacggctgttggtatgggatggagatcagacccctgaaggaaaaggaggaaaatctcgttaactctctggtgacagccggacacggccaggtggataatttcagcctgggggtccttggaatggctctctttctggaggaaatgctgcggaccagagtgggcacaaaacatgcgatcctcctggttgccgtgtccttcgtcacccttattacggggaacatgtcttttaaggacctgggacgcgtggttgtgaccgtcggcgctacaatgaccgatgacatcggcatgggggtgacatacctcgccctgctggccgctttcaaagttcggcctacctttgccgcgggacttctgctcagaaagctgacgagcaaagagctcatgatgacaaccattggcatcgtgctgctttcccagtctacaattcccgagaccatcctggaactcaccgatgctctggccctggggatgatggtccttaagatcgtgcgcaatatggagaagtatcaactggccgtgacaattatggctatcctctgcgtccctaacgccgttattctgcagaatgcgtggaaagtgagctgtacgatcctcgctgtggtctccgtgagccccctgattcttacctcttcccagcagaagacagactggatccctctggccctcaccatcaaaggactgaaccccacagccattttcctgaccacgcttagcagaacaaataagaaacggtcttggccgctgaacgaagctatcatggccgttggcatggtgtccattctcgctagctctctgctcaagaatgacatccctatgaccgggcccctggtcgccggaggccttctgaccgtgtgctacgttctgacaggccgctccgcggatctcgagctggaaagagccaccgacgtgaaatgggaggatcaagctgagattagcgggtccagccctatcctttctattacaatcagcgaagacggatccatgtctatcaagaacgaggaagaggagcagacgctgaccattctcatccggacaggcctgctcgtcattagcgggctgtttcccgtgtccatcccgattaccgccgctgcctggtatctttgggaagtcaagaaacagcgcgccggagtgctgtgggatgttccttctccccctcccatgggcaaggctgagctggaagacggggcgtacagaatcaaacagaagggaatcctcggctatagccaaattggcgccggggtgtacaaagagggaacattccacaccatgtggcacgtcacgcggggcgctgtgctgatgcataaggggaagcgcatcgaaccctcctgggccgatgttaaaaaggaccttatttcttacggaggcgggtggaaactggagggagagtggaaggaaggcgaggaagtgcaggtcctcgccctggagcctggcaaaaatccgagagctgtgcagaccaagcccgggctctttaagacaaacaccggaacaatcggcgccgtgagcctggatttctcccctgggaccagcggatctcccattatcgacaaaaagggcaaagttgtcgggctttatggaaacggcgtggtgacacggtccggcgcgtacgtcagcgctatcgcccagacggaaaagtctattgaggataatcctgagatcgaagacgatatttttcgcaaaagacggctgaccatcatggacctgcaccccggggccggaaagacaaagagatatctccctgctattgtgcgcgaggccatcaaacggggcctgagaacccttattctggcgccgacccgcgttgtggctgccgaaatggaggaagccctccgggggctgcccatcagataccaaacccctgctatccgcgccgagcatacgggacgggagattgtcgacctcatgtgtcacgctaccttcacaatgagactgctttcccccgtgcgcgttcctaactataatctgatcattatggatgaagcccatttcaccgaccccgcgagcatcgccgctcggggctacatttccacaagagtggagatgggggaagccgctggcatctttatgaccgccacgccgcctggatctcgggatcccttcccccagagcaacgcccctatcattgacgaggagcgcgaaatccccgagagatcctggaatagcggccacgaatgggtcacagattttaaggggaaaaccgtgtggttcgttccttctattaaggctggaaacgacatcgcggcctgcctgcggaaaaatggcaagaaggtgattcagctctcccgcaaaacctttgatagcgagtatgtcaagacaagaaccaacgactgggatttcgtggtgacaaccgacatctctgaaatgggggctaattttaaagccgagcgggtcatcgatccgagacgctgtatgaagcccgttattctgacggacggagaggaacgggtgatccttgccggccctatgcccgtgacacacttcagcgctgcccaaagacgcgggcggattggcagaaaccctaaaaatgagaacgaccagtacatctacatgggagaacccctggagaatgatgaagactgcgcgcattggaaggaggctaaaatgctcctggataacattaataccccggagggcatcattccttccatgtttgaacccgagcgcgaaaaggtcgacgccatcgatggggagtatcggctgagaggagaagcccgcaagacattcgtggacctcatgagacggggcgatcttcctgtttggctggcttacaaagtggccgcggaggggatcaactatgccgaccgcagatggtgttttgatggaattaagaacaatcagatcctggaggaaaacgtcgaggtggaaatttggaccaaagagggcgagcggaagaaactcaagccccgctggctggacgctagaatctactctgatcctcttgccctgaaggagttcaaagagttcgctgccgggagaaagagcctcgctctgaatctgattacggaaatgggcagactccccacctttatgacacagaaaacccgcgacgcccttgataacctggcggttctgcacacagccgaggctggaggccgggcctataatcatgctctctccgaactgccggagacccttgagacactgctcctgctgaccctccttgccacggtgacagggggaatcttcctgtttctgatgtctggcagagggatcggaaagatgaccctcggcatgtgctgcattatcaccgccagcattctgctttggtacgctcaaatccagcctcactggattgcggcctccatcatcctggtcttctttctcattgtgctgctgatccccgaacccgagaaacagcgcacacctcaggacaaccaactcacctatgtcgtgattgctatccttacagttgtggccgccacgatggctaatgaaatgggcttcctggagaagaccaagaaagacctggggtttggaagcattgccacacagcagccggaatctaacatcctcgatattgacctgcggcccgcgtccgcctggaccctttacgctgtggccacaaccttcgtcacgcctatgctgagacacagcatcgaaaattcctctgttaacgtgagcctcaccgctatcgccaatcaggcgacagtgctgatgggcctggggaagggatggcccctctccaaaatggatattggcgtccctcttctggccatcgggtgttactctcaagtgaaccccattaccctgacagctgccctcctgcttctggttgctcattatgccatcattggacctggcctccaggctaaggccacccgggaggcgcagaaacgcgccgctgccggcatcatgaagaatccgacggtggacgggatcacagtcattgatctggaccccatcccttacgatcccaagtttgaaaaacagctgggacaagtgatgctccttgtcctgtgcgtgacccaggttctgatgatgagaacaacctgggctctctgtgaggccctgacccttgccacaggccctattagcacgctgtgggaagggaaccccggacggttctggaataccacaatcgcggtgtccatggctaacatttttcgcggcagctatctcgccggggctggactgctgttctctatcatgaagaataccacaaacaccagacggggcacgggcaacatcggggagacactcggagaaaaatggaagtcccgccttaatgccctgggcaaaagcgagtttcagatttacaagaaatctgggatccaagaggtcgacagaaccctggccaaggaaggaattaagcggggcgagaccgatcaccatgctgtgtcccgcgggagcgccaaactcagatggttcgttgaacggaacatggtgacaccggagggaaaggtcgtggacctgggctctggcagagggggatggagctattactgcggcgggcttaaaaatgtgcgcgaggttaagggactgaccaaaggcgggcctggacacgaggaacccatccccatgtccacatatggctggaacctcgtccggctgcagtctggcgtggatgtgttctttattcctcccgaaaagtgtgacacgctgctctgcgatatcggggagagctcccctaatccgaccgtcgaagcgggaagaacacttcgcgttctgaacctggtggagaattggctcaacaataacacccagttctgtatcaaggtgctgaatccctacatgcctagcgtcattgagaaaatggaagcccttcagcggaagtacggcggggctctggtgagaaaccccctctcccgcaattctacacatgagatgtattgggttagcaacgcctccggaaatatcgtgtctagcgtcaacatgatttcccggatgctgatcaacagatttaccatgcgccacaaaaaggctacgtacgaacctgacgtggacctgggctctgggacccggaatattggaatcgagagcgaaattcccaacctcgatatcatcggcaaaagaattgagaagatcaagcaagagcacgaaacatcctggcattatgaccaggatcacccgtacaaaacctgggcctatcatggcagctacgagacaaagcagaccgggtctgcgtccagcatggttaatggagtggtccgccttctgacaaaaccttgggacgtgctgcccaccgtgacgcagatggccatgacagataccacccctttcggccaacagcgggtctttaaggaaaaagttgacacaagaacgcaggagcccaaggaagggaccaagaaactcatgaagattacagctgagtggctgtggaaagagcttggaaagaaaaagacccctcgcatgtgcacaagagaagagttcacccggaaagtgcgctctaacgccgctctgggcgccatctttacagatgaaaataagtggaagtccgctagagaggccgtggaggacagccggttctgggaactcgtcgataaagagagaaacctgcacctggaagggaagtgtgagacctgcgtgtataatatgatgggaaaacgggaaaagaaactcggcgagtttggcaaggcgaaggggtctcgcgccatttggtacatgtggctgggagctagattccttgagtttgaagccctgggcttcctcaacgaggaccactggttttcccgggaaaatagcctgtccggggttgagggagaaggcagccataaacttgggtacatcctgcgcgatgtgtctaagaaagagggcggagctatgtatgccgacgacacggccggctgggataccagaatcacactcgaggacctgaagaacgaagagatggtcaccaatcacatggaaggggagcataaaaagctggcggaagctattttcaagctcacataccagaacaaagtggttcgggtgcaacgccccaccccgagaggaacggtcatggatatcattagccggcgcgaccagagaggctccggacaggtgggaacatatggcctgaataccttcacaaacatggaggcccaacttatccggcagatggagggggaaggcgtttttaagaatattcagcacctgaccgccacggaggaaatcgctgtgcagaactggctcgcccgcgtcggaagagagcggctgtctcgcatggctatcagcggcgatgactgtgtggtcaaacctcttgatgacagattcgcctccgcgctgaccgccctcaacgatatggggaagattcggaaagacatccaacagtgggagccctctagaggatggaatgattggacacaggtgcccttttgcagccatcacttccacgaactgattatgaaggacggccgcgttctggtggtcccttgccggaaccaggatgagctcatcgggagagctcgcatttcccaaggagccggctggtctctgcgggaaaccgcttgtcttggaaagagctacgcccagatgtggtccctgatgtattttcatagacgcgacctccggctggcggccaatgctatctgcagcgccgtgccgtctcactgggtgcccacatccagaaccacatggagcattcatgctaaacacgagtggatgaccacggaagacatgcttacagtttggaaccgcgtgtggatccaggagaatccttggatggaggataagacccccgtcgaatcttgggaggaaatcccttacctgggcaaacgggaggaccagtggtgtggatccctcattggcctgaccagcagagccacatgggctaagaacatccaagccgcgattaatcaggtgcgctccctgatcgggaacgaagagtataccgattacatgccctctatgaaacggttcagacgggaggaagaggaagccggagttctctggtga

SEQ ID NO: 20347 - RNA, 9876 nt, synthetic construct
  misc_feature 1..9876: note = derived and/or modified CDS sequence (opt5) from DENV-2__AF169688__SS-prME
  source 1..9876: mol_type = other RNA
agcgccggcatgatcattatgctgatccccaccgtgatggctttccacctgacaacgagaaatggggaacctcatatgattgtctccatccaggaaaagggaaaatctctgctttttaagaccgaagacggcgttaatatgtgcacactgatggccatggatctcggggaactgtgtgaagacaccattacatacaaatgcccgcttctgcggcaaaatgaacccgaggatatcgactgttggtgcaattccacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaggacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagacatctagcggcaatcttctgtttaccggacatctcaagtgccgcctgagaatggacaaacttcaactgaagggcatgtcctacagcatgtgtaccgggaagttcaaagtcgtgaaggaaattgcggagacacagcacggaacgatcgtcattcgggtgcagtatgagggcgatgggtctccctgcagaatccccttcgaaatcatggacctcgagaaacgctacgttctgggacggctgattaccgtgaaccctatcgtcacagaaaaggattccccggtgaacattgaggccgaacccccttttggcgacagctacatcattatcggggttgagcccggccagctcaaactgaattggttcaagaagggatctagcattggccaaatgtttgagaccacaatgagaggggctaaacgcatggccatccttggagataccgcctgggacttcggctccctcggcggggtgtttacgtctatcgggaaggctctccatcaggtcttcggggccatttatggcgcggcttttagcggagtgtcctggacaatgaaaatcctgattggcgtgatcattacctggatcgggatgaacagccggtctacctccctgagcgtttctcttgtcctcgtgggaatcgtgacactgtacctgggcgtcatggtgcaggccgattccgggtgtgttgtgagctggaagaataaagaactcaagtgcggatccggcattttcatcaccgacaacgtccacacatggacggagcagtataagtttcaacctgaatctcccagcaaactggcctccgctattcagaaggcccaggaggaagggatctgtggcattagatctgtgacccgccttgagaatctgatgtggaaacagatcacaccggagctcaaccacatcctggctgaaaatgaggttaagctgaccattatgacaggagatatcaaaggcattatgcatgccgggaagcggagccttagacctcaacccaccgaactcaaatactcctggaagacgtggggaaaggcgaaaatgctgagcaccgagtctcacaaccagacattcctgatcgacggccctgaaaccgccgagtgccccaatacaaaccgcgcttggaactccctcgaggtggaagattatgggtttggagtcttcaccacaaacatttggctgaaacttaaagagaagcaggacgccttttgtgacagcaaactgatgtctgctgccatcaaggataatcgggcggtgcatgccgacatgggctactggatcgaatccgctctcaacgatacctggaagattgagaaagccagcttcatcgaggttaagaattgccactggcctaaatctcacacgctgtggagcaacggcgtgctggaatccgagatgattatccccaagaaccttgctgggccggtcagccagcataattatagacctggataccacacacaaattgccggcccctggcatctcgggaaactggaaatggacttcgatttttgtgacggaaccaccgtggtggtcacagaggattgcggcaaccgcgggccctctctgcggaccacgacagcctccggaaagctcatcaccgaatggtgctgtagaagctgcacactgcctccgcttcggtaccgcggcgaggacggctgttggtatgggatggagattagacccctgaaggaaaaagaggaaaatctcgttaactccctggtgaccgctggacacggccaggtggataatttctctctgggggtccttggaatggcgctctttctggaggaaatgctgcggacaagagtgggcaccaagcatgccatcctcctggttgctgtgagcttcgtcacgcttatcaccgggaacatgtcctttaaagacctgggacgcgtggttgtgatggtcggcgccacaatgaccgatgacattggcatgggggtgacatacctcgccctgctggctgccttcaaggttcggcctacctttgcggctggacttctgctcagaaaactgacgtctaaggagctcatgatgacaaccatcggcattgtgctgcttagccagtccacaatccccgagaccattctggaactcaccgatgccctggccctggggatgatggtccttaagatcgtgcgcaatatggagaaatatcaactggctgtgacaatcatggccattctctgcgtccctaacgcggttatcctgcagaatgcttggaaggtgtcttgtacgattctcgccgtggtcagcgtgagccccctgatccttaccagctctcagcagaaaacagactggattcctctggccctcaccatcaagggactgaaccccacagctatcttcctgaccacgctttccagaacaaataaaaagcggagctggccgctgaacgaagccattatggctgttggcatggtgtctatcctcgcctccagcctgctcaaaaatgacattcctatgaccgggcccctggtcgcgggaggccttctgaccgtgtgctacgttctgacaggccgctctgccgatctcgagctggaaagagctaccgacgtgaagtgggaggatcaagccgagatctccgggagctcccctattcttagcatcacaatttctgaagacggaagcatgtccatcaagaacgaggaagaggagcagacgctgaccatcctcattcggacaggcctgctcgtcatctctgggctgtttcccgtgagcattccgatcaccgctgccgcctggtatctttgggaagtcaaaaagcagcgcgctggagtgctgtgggatgttccttctccccctcccatgggcaaagcggagctggaagacggggcctacagaattaagcagaaaggaatcctcggctatagccaaatcggcgctggggtgtacaaggagggaacattccacaccatgtggcacgtcacgcggggcgccgtgctgatgcataaggggaaacgcattgaacccagctgggccgatgttaagaaagaccttatctcctacggaggcgggtggaagctggagggagagtggaaagaaggcgaggaagtgcaggtcctcgctctggagcctggcaagaatccgagagccgtgcagaccaagcccgggctctttaaaacaaacaccggaacaattggcgcggtgtctctggatttcagccctgggacctccggaagccccatcattgacaagaaaggcaaggttgtcgggctttatggaaacggcgtggtgacacggtctggcgcttacgtctccgccatcgcccagacggagaagtccatcgaggataatcctgagattgaagacgatatctttcgcaagagacggctgaccattatggacctgcaccccggggctggaaagacaaaaagatatctccctgccatcgtgcgcgaggcgattaagcggggcctgagaacccttatcctggctccgacccgcgttgtggccgccgaaatggaggaagctctccgggggctgcccattagataccaaacccctgctatccgcgctgagcatacgggacgggagatcgtcgacctcatgtgtcacgccaccttcacaatgagactgctttctcccgtgcgcgttcctaactataatctgattatcatggatgaagcgcatttcaccgaccccgcctccattgctgcccggggctacatcagcacaagagtggagatgggggaagctgccggcatttttatgaccgccacgccgcctggatcccgggatcccttcccccagtctaacgctcctatcatcgacgaggagcgcgaaattcccgagagaagctggaactccggccacgaatgggtcacagattttaaagggaagaccgtgtggttcgttcctagcatcaaagcgggaaacgacattgccgcttgcctgcggaagaatggcaagaaagtgatccagctctctcgcaagacctttgattccgagtatgtcaaaacaagaaccaacgactgggatttcgtggtgacaaccgacattagcgaaatgggggccaattttaaggccgagcgggtcatcgatccgagacgctgtatgaaacccgttatcctgacggacggagaggaacgggtgattcttgctggccctatgcccgtgacacacttctctgccgcgcaaagacgcgggcggatcggcagaaaccctaagaatgagaacgaccagtacatttacatgggagaacccctggagaatgatgaagactgcgctcattggaaagaggccaagatgctcctggataacatcaataccccggagggcattatccctagcatgtttgaacccgagcgcgaaaaggtcgacgccattgatggggagtatcggctgagaggagaagctcgcaaaacattcgtggacctcatgagacggggcgatcttcctgtttggctggcctacaaggtggcggccgaggggatcaactatgctgaccgcagatggtgttttgatggaatcaaaaacaatcagattctggaggaaaacgtcgaggtggaaatctggaccaaggagggcgagcggaaaaagctcaagccccgctggctggacgccagaatttactccgatcctcttgctctgaaagagttcaaggagttcgccgctgggcggaaatctctcgccctgaatctgatcacggaaatgggcagactccccacctttatgacacagaagacccgcgacgcgcttgataacctggccgttctgcacacagctgaggccggaggccgggcttataatcatgccctcagcgaactgccggagacccttgagacactgctcctgctgaccctccttgccacggtgacagggggaattttcctgtttctgatgtccggcagagggatcggaaaaatgaccctcggcatgtgctgcatcattaccgcttctatcctgctttggtacgcgcaaattcagcctcactggatcgccgctagcattatcctggtcttctttctcatcgtgctgctgattcccgaacccgagaagcagcgcacacctcaggacaaccaactcacctatgtcgtgatcgccattcttacagttgtggccgctacgatggccaatgaaatgggcttcctggagaagaccaaaaaggacctggggtttggatccatcgcgacacagcagccggaaagcaacattctcgatatcgacctgcggcccgcctctgcttggaccctttacgccgtggctacaaccttcgtcacgcctatgctgagacactccattgagaatagctccgttaacgtgtctctcaccgccatcgcgaatcaggccacagtgctgatgggcctggggaaaggatggcccctcagcaagatggatatcggcgtccctcttctggctattgggtgttactcccaagtgaaccccatcaccctgacagccgctctcctgcttctggttgcccattatgctattatcggacctggcctccaggccaaagcgacccgggaggcccagaagcgcgctgccgctggcattatgaagaatccgacggtggacgggatcacagtcatcgatctggaccccattccttacgatcccaaatttgaaaagcagctgggacaagtgatgctccttgtcctgtgcgtgacccaggttctgatgatgagaacaacctgggccctctgtgaggccctgacccttgcgacaggccctatctctacgctgtgggaagggaaccccggacggttctggaataccacaattgctgtgagcatggccaacatctttcgcggctcctatctcgctggggccggactgctgttcagcattatgaaaaataccacaaacaccagacggggcacgggcaacatcgggaagacactcggagagaaatggaagtctcgccttaatgccctgggcaaaatcgaatttcagatttacaagaagtccgggatccaagaggtcgacagaaccctggctaaagagggaattaagcggggcgaaaccgatcaccatgccgtgagccgcgggtctgcgaaactcagatggttcgttgagcggaacatggtgacaccggaaggaaaggtcgtggacctgggctgcggcagagggggatggtcctattactgtggcgggcttaaaaatgtgcgcgaggttaagggactgaccaagggcgggcctggacacgaggaacccatccccatgagcacatatggctggaacctcgtccggctgcagtctggcgtggatgtgttctttattcctcccgagaaatgcgacacgctgctctgtgatatcggggaaagctcccctaatccgaccgtcgaggccggaagaacacttcgcgttctgaacctggtggaaaattggctcaacaataacacccagttctgcatcaaggtgctgaatccctacatgccttctgtcattgagaaaatggaggcccttcagcggaagtacggcggggccctggtgagaaaccccctcagccgcaattccacacatgaaatgtattgggttagcaacgcttccggaaatatcgtgtctagcgtcaacatgatttcccggatgctgatcaacagatttaccatgcgccacaaaaaggccacgtacgagcctgacgtggacctgggctctgggacccggaatattggaatcgaaagcgagattcccaacctcgatatcatcggcaagagaattgagaaaatcaagcaagagcacgagacatcctggcattatgaccaggatcacccgtacaaaacctgggcgtatcatggctcttacgaaacaaagcagaccgggagcgcctccagcatggttaatggagtggtccgccttctgacaaaaccttgggacgtgctgcccaccgtgacgcagatggctatgacagataccacccctttcggccaacagcgggtctttaaggagaaggttgacacaagaacgcaggaacccaaagaggggaccaagaaactcatgaagattacagccgaatggctgtggaaagagcttggaaagaaaaagacccctcgcatgtgtacaagagaggagttcacccggaaggtgcgctctaacgctgccctgggcgctatctttacagatgagaataaatggaagtccgccagagaagcggtggaggacagccggttctgggagctcgtcgataaagaaagaaacctgcacctggaggggaagtgcgaaacctgtgtgtataatatgatgggaaaacgggagaagaagctcggcgaatttggcaaagccaaggggtctcgcgctatttggtacatgtggctgggagccagattccttgagtttgaggctctgggcttcctcaacgaagaccactggttttcccgggagaatagcctgtctggggttgaaggagagggccttcataaactggggtacatcctccgcgatgtgtccaagaaagaaggcggagccatgtatgccgacgacacggcgggctgggataccagaatcacactggaggacctgaagaacgaggaaatggtcaccaatcacatggagggggaacataagaaactcgctgaggccattttcaagctgacataccagaacaaagtggttcgggtgcaacgccccaccccgagaggaacggtcatggatatcattagccggcgcgaccagagaggctccggacaggtgggaacatatggccttaataccttcacaaacatggaagcccaactgatccggcagatggagggggagggcgtttttaagaatattcagcacctcaccgctacggaagagatcgccgtgcagaactggctggctcgcgtcggaagagaacggcttagccgcatggccatctctggcgatgactgcgtggtcaaacctctggatgacagattcgcgagcgccctcaccgctctgaacgatatggggaagattcggaaggacatccaacagtgggagccctccagaggatggaatgattggacacaggtgcccttttgctctcatcacttccacgagctgattatgaaagacggccgcgttctcgtggtcccttgtcggaaccaggatgaactgatcgggagagcccgcattagccaaggagctggctggtcccttcgggagaccgcctgcctggggaagtcttacgcgcagatgtggagcctcatgtattttcatagacgcgacctgcggcttgccgctaatgccatctgttccgctgtgccgtctcactgggtgcccacaagcagaaccacatggtccattcatgccaaacacgaatggatgaccacggaggacatgctgacagtttggaaccgcgtgtggatccaggaaaatccttggatggaggataagacccccgtcgagagctgggaagagatcccttacctcggcaaacgggaagaccagtggtgcggatctctgattggcctgacctccagagctacatgggccaagaacatccaagcggccattaatcaggtgcgcagcctcatcgggaacgaggaatataccgattacatgccctctatgaagcggttcagacgggaggaggaagaggctggagttctgtggtga

SEQ ID NO: 20348 - RNA, 9873 nt, synthetic construct
  misc_feature 1..9873: note = derived and/or modified CDS sequence (opt5) from DENV-3__AB189125__SS-prME
  source 1..9873: mol_type = other RNA
accagcctctgcctcatgatgatgctgcccgccacccttgctttccacctgacgtcccgggacggagaacctcggatgatcgtggggaagaatgaacgcggaaagtctctcctgtttaagaccgccagcggaattaatatgtgtacccttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatcggcgggacaagcgctctgtggccctggcccctcacgtcgggatgggactcgatacaagagctcaaacctggatgagcgccgagggcgcttggcggcaggtcgaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagcccccgcaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggaaagctcataacggacgcctgattacagccaaccctgtggtcaccaagaaagaggaacccgtgaatatcgaggccgaacccccttttggcgagtctaacattatcattgggatcggcgataaggctcttaagatcaattggtacaaaaagggaagctccattggcaaaatgttcgaagccacagctagaggggcccggagaatggcgatcctcggagacaccgcctgggattttggcagcgtcgggggagttctgaactctctgggcaagatggtccaccagattttcgggtccgcttatacggccctctttagcggcgtgtcttggatcatgaaaattggaatcggcgtgctgcttacatggattgggctgaatagcaagaacacctccatgtctttcagctgcatcgtcatcggaattatcaccctctacctgggcgctgtggttcaggccgacatggggtgtgtgattaattggaagggaaaagagctgaagtgcggctccgggatctttgtcacaaacgaggtgcatacctggacagaacagtataaattccaagcggatagcccgaagcgccttgccacggctattgccggcgcttgggagaatggagtttgtggcatccggtctaccacaagaatggaaaacctcctgtggaaacagatcgccaatgagctgaactacattctctgggaaaataacatcaagctgaccgtggtcgtgggggacattatcggcattcttgagcagggcaaacgcacactgacaccccagcctatggagctcaagtattcctggaagacgtgggggaaagccaagatcgttaccgctgaaatccaaaatagctcttttattatcgatggacccaacacacctgagtgccccaacgcgtcccgggcctggaatgtgtgggaagtcgaggactacggcttcggcgtgtttaccacaaacatttggctgaaactgagagaaatgtatacccagctttgtgaccaccgcctcatgagcgctgccgtgaaggatgagcgggccgtccacgctgacatggggtactggatcgagtcccagaaaaatggatcttggaagctggaaaaggccagcctgattgaggttaaaacatgcacctggccgaagtcccatacgctctggtctaacggcgtgctggaaagcgatatgatcatccctaaatcccttgcggggcccattagccagcacaattacagacctggatatcatacacaaaccgctggcccctggcacctggggaagctcgagctggacttcaactactgcgagggaaccacagtggtcatcaccgaaaattgtggcacgcgcggcccttctctgcggacaaccacagtgtccgggaaacttattcacgagtggtgctgtagaagctgcaccctgcccccgctgcgctatatgggagaagatggctgttggtacgggatggagatccggcctattaacgaaaaggaggagaatatggttaagtctctggtgtccgccggaagcggcaaagtcgacaactttacaatgggggtgctctgcctggccatccttttcgaagaggttatgagaggaaagttcggcaaaaagcatatgattgctggcgtgctgtttaccttcgtcctcctgctgtctgggcagatcacgtggcgggatatggcccgcacccttatcatgattggaagcaatgcgtccgacagaatgggcatgggggtgacatatctggctctcatcgccacctttaaaattcagcccttcctggccctcggatttttcctgcggaaacttacaagcagagaaaacctgctcctgggcgttgggctggctatggccaccacgcttcaactgcccgaggatatcgaacagatggctaatggaattgccctcggcctgatggcgctcaagctgatcacacagtttgagacctaccagctttggacagccctggtgtctctcatgtgttccaacaccatcttcaccctgacagtcgcttggcgcacggccaccctgattcttgctggcatcagcctgctccctgtgtgccaatcctctagcatgcggaaaacagactggctgccgatgaccgtggccgccatgggggtgccccctctccccctgtttattttctcccttaaggatacactgaaaagacgctcttggcctctgaatgagggagttatggctgtgggcctcgtgagcatcctggcgtcctctcttctgagaaacgacgtccccatggccgggcctctcgtggctggaggcctgctcattgcctgttatgttatcaccgggacgagcgccgatctgacagtggaaaaggctgccgacgtcacctgggaggaagaggcggaacagaccggagtgtcccacaaccttatgatcacagttgacgatgacggcaccatgcggattaaagatgacgagacagagaatatcctgacggtgctgctcaagaccgctctgcttattgtcagcggcatctttccctactctattccggccacactgctcgtgtggcatacctggcagaaacagacacaacgctccggggtcctgtgggatgtgccttctccccctgaaacccagaaggccgagctcgaagagggagtttacagaatcaagcagcagggcattttcgggaaaacgcaagtgggagtcggcgtgcagaaggagggggtttttcacaccatgtggcatgtgacacggggagctgtcctgacctataacggcaaacgccttgaaccctcctgggcctccgtgaagaaagacctgatcagctacggcgggggatggagactgtctgcgcagtggcaaaagggcgaggaagtgcaggttatcgctgtcgagccggggaagaatcctaaaaacttccagacaatgcccggaattttccagaccacaacgggcgaaatcggggccattgccctcgattttaagcctggaacctccggcagccccatcattaatcgggagggcaaagtggtggggctgtatggaaacggcgtcgtgacaaagaatgggggatacgtttccggcatcgctcaaaccaacgccgagcccgacgggcctaccccggaacttgaggaagagatgttcaaaaagcgcaatctgacaatcatggatctccaccccggcagcggaaagacgagaaaatatctgcctgctattgtgcgggaagccatcaagcgcagactccggaccctgattcttgcgcccacaagagtcgtggccgctgagatggaggaagccctgaaaggcctgcctatccgctaccagaccacagctaccaagtctgagcacacggggaaagaaattgttgacctcatgtgccatgccacatttaccatgcggctgcttagccccgtgagagtccctaactataatctgatcatcatggatgaggcccacttcaccgacccggcttccattgcggcccgcggatacatctctacacgggtgggcatgggggaagctgccgccatttttatgaccgctacaccccctggaaccgccgatgcgttcccccagagcaacgctcctatccaggacgaggagagagacattcccgaacgctcctggaactctggcaacgattggatcacggactttgccgggaagacagtttggttcgtgccgagcattaaggccggcaatgatatcgctaactgtctccggaaaaacggaaagaaagtcatccaactgtccagaaagacctttgacacagagtaccagaaaaccaagctgaatgattgggacttcgtggtgacgaccgatatttctgaaatgggcgccaactttaaggcggaccgcgtcatcgatcctcggagatgcctcaaacccgttattcttacagacgggcccgagcgggtgatcctggccggacctatgcccgtgaccgtcgctagcgccgctcagcgcagaggccgggtggggcgcaatcctcagaaggagaacgatcaatatattttcacaggacagccgctgaataacgacgaagaccatgcccactggaccgaggctaaaatgctcctggataatatcaacacacccgaaggcatcattcctgcccttttcgagcccgaaagagagaagtccgcggccatcgacggggagtaccggctgaaaggcgaaagcagaaagacctttgttgagctcatgcgccggggagatctgcctgtgtggctggctcataaagtcgcctctgaaggcattaagtatacggacagaaagtggtgcttcgatggggagcgcaataaccagatcctcgaagagaatgtggacgttgagatttggacaaaagaaggagagaagaagaaacttcggcccagatggctggatgctcgcacctactccgacccgctggccctcaaagaatttaaagatttcgccgctggcagaaagagcatcgcgctggaccttgtgaccgagatcgggagagtcccttctcacctggcccaccgcacaagaaacgctctcgataatctggtgatgctgcatacctccgaacacggaggccgggcctatcgccatgccgtcgaggagctccccgaaacaatggagacgcttctgctgctcggcctgatgattcttctgaccgggggagtgatgctctttctgatcagcggcaaaggggttggaaagacatccattggcctgatctgtgtggtggcttctagcgggatgctctggatggccgacattcctcttcagtggatcgcgtccgccattgtcctggagttctttatgatggttctgctcatccccgagcctgagaaacaaagaacaccccaggataaccagctggcttacgtggtgatcggcattcttacactggccgctatcgtcgccgcgaatgaaatgggcctcctggagaccacgaagcgggacctgggcatgagcaaagaaccgggggtggtttctcctacctcctatctcgacgtggatcttcaccccgccagcgcttggacactgtacgccgtcgctaccacagtgattacccccatgctgcgccacacgatcgagaactctacagccaatgtcagcctcgctgccattgcgaaccaagccgtggttctgatgggacttgacaagggctggcctatctccaagatggatctgggggtgccgctcctggctctgggatgctactctcaggtcaaccccctcacccttacagccgctgtgctgctgctcgttacccattatgccatcattggccctgggctgcaggccaaagcgaccagagaagctcagaagcggacagccgctggaatcatgaaaaatcccacggtggacggcattatgaccatcgatcttgaccctgtcatttacgatagcaagttcgagaaacaactgggccaggtgatgctcctggtgctgtgtgccgttcagctccttctgatgagaacatcctgggccttttgcgaggctctgaccctcgccacagggcccatcaccacgctgtgggaaggatctcctggcaagttctggaacacaaccatcgcggtcagcatggccaatatttttcgcgggtcctatcttgctggagccggcctggctttcagcatcatgaagtctgtggggaccggaaaacggggcacaggctcccagggggagaccctcggagaaaagtggaaaaagaaactgaaccaactgagcagaaaggagtttgacctctacaaaaagtccggcattacagaagtggatcgcacggaggccaaggaggggcttaaacggggagaaatcacccaccatgcggtctctagaggcagcgccaagctgcagtggttcgttgagcggaatatggtgattccggaagggcgcgtgatcgacctgggatgtggcagaggcgggtggtcctattactgcgctggactcaaaaaggtcacagaggtgcggggctataccaaagggggacccggccacgaagaacctgttcccatgtctacatacgggtggaacattgtgaagctgatgagcggaaaggatgtcttctaccttcctcccgagaaatgtgacaccctgctctgcgatatcggcgaatccagcccgtctcctacggtggaggaatcccgcaccatcagagttctgaagatggtggagccctggctgaaaaataaccagttttgtattaaggtcctcaatccctatatgcctgccgtgatcgagcatcttgaacggctgcagcgcaaacacggcgggatgctggtgagaaaccccctcagcagaaattctacacacgagatgtactggatttccaacggaaccggcaatatcgtcagctctgttaacatggtgagccgcctgcttctgaatagattcacaatgacctatcggagacctacaattgaaaaggacgtggacctcggggctggaacccgccatgtcaacgccgagccggaaacgcccaacatggatgtgatcggcgagcggatcagacgcattaaggaggaacactcctctacatggcattacgacgatgagaatccttataaaacctgggcttaccacgggagctatgaagttaaggccaccggatccgcgagctccatgatcaacggcgtggtcaaactgctgacaaagccctgggacgtggttcctacggtgacccaaatggccatgacagataccacaccctttggccagcagcgggtcttcaaagagaaggtggacaccagaacaccgaagcctatgcccgggacccgcaaagttatggaaattacggctgagtggctctggcggaccctgggaagaaataagcgccctcggctttgcacaagagaggaatttaccaaaaaggtgcgcacaaacgccgctatgggcgccgtcttcaccgaggaaaatcaatgggattctgcccgggcggctgtggaggacgaagagttttggaaactggtcgatagagagcgcgaactccacaagctggggaaatgtggaagctgcgtgtacaacatgatgggcaagagagagaagaaacttggggagttcggcaaggccaaaggatcccgggccatctggtacatgtggctgggcgctcgctatctcgagtttgaggccctggggttcctgaatgaagaccattggttttctagagagaacagctactccggagttgaaggcgaggggctccacaagctgggatatattcttcgggatatctctaaaatccccggcggggctatgtacgccgacgacacggcgggctgggatacaagaattaccgaagacgatctgcataatgaggagaagatcacacagcagatggaccctgaacaccggcagctcgccaacgctattttcaagctgacctatcaaaataaagtggtcaaggtgcagcgccccacgccgaaaggaaccgtgatggatatcattagcagaaaggaccagcggggctccgggcaggttggaacatacggccttaacacctttacaaatatggaggcccaactgatccgccagatggaaggggagggagtgctcagcaaaaccgatctggaaaaccctcatctgctcgagaagaagatcacacagtggctggagaccaaaggcgtcgaaagacttaagcggatggctatttctggggacgattgcgtggttaaacccatcgacgatcgcttcgccaatgcgctgctcgccctgaacgacatgggcaaggtgagaaaagatattccccagtggcaaccttccaagggatggcacgactggcagcaggtcccgttctgtagccaccattttcacgagcttatcatgaaggacggccggaaactggtggtcccctgccgctctcaggatgaactcattgggagagctcggatctcccaaggagccggctggagcctgaaggagacggcttgtctggggaaagcctatgctcagatgtgggccctcatgtacttccatcgcagagacctgcggcttgcgtctaacgccatttgctccgctgtgcctgttcactgggtgcccacaagccgcaccacctggtccatccacgcccatcaccagtggatgacaaccgaagatatgctgacagtctggaatagagtgtggatcgaggacaacccttggatggaggataagacgcccgttaccacatgggaagacgtgccttacctcggaaaacgggaggatcaatggtgtggcagcctgattgggcttacctctagagccacatgggctcagaatatcctgaccgccattcagcaggtccgcagcctcatcggcaacgaagagtttctggactatatgccctccatgaagcggttcagaaaggaggaagagtctgaaggagcgatttggtga

SEQ ID NO: 20349 - RNA, 9873 nt, synthetic construct
  misc_feature 1..9873: note = derived and/or modified CDS sequence (opt5) from DENV-3__AB189126__SS-prME
  source 1..9873: mol_type = other RNA
accagcctgtgcctcatgatgatgctgcccgccacccttgctttccacctgacgtcccgggacggagagcctcggatgatcgtggggaagaacgaacgcggaaagtctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcagacctggatgagcgccgagggcgcttggagacaggtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacagctggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagcccccgcaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggaaagctcataacggacgcctgattacagccaaccctgtggtcaccaagaaagaggaacccgtgaatatcgaggccgaacccccttttggcgagtctaacattatcattgggatcggcgataaggctcttaagatcaattggtacaaaaagggaagctccattggcaaaatgttcgaagccacagctagaggggcccggagaatggcgatcctcggagacaccgcctgggattttggcagcgtcggcggggttctgaactctctggggaagatggtccaccagattttcgggtccgcttatacggccctctttagcggcgtgtcttggatcatgaaaattggaatcggcgtgctgcttacatggattgggctgaatagcaagaacacctccatgtctttcagctgcatcgtcatcggaattatcaccctctacctgggcgctgtggttcaggccgacatggggtgtgtgattaattggaagggaaaagagctgaagtgcggctccgggatctttgtcacaaacgaggtgcatacctggacagaacagtataaattccaagcggatagcccgaagcgccttgccacggctattgccggcgcttgggagaatggagtttgtggcatccggtctaccacaagaatggaaaacctcctgtggaaacagatcgccaatgagctgaactacattctctgggaaaataacatcaagctgaccgtggtcgtgggggacattatcggagttcttgagcagggcaaacgcacactgacaccccagcctatggagctcaagtattcctggaagacgtgggggaaagccaaggtggtcaccgctgaaattcaaaatagctcttttatcatcgatggacccaacacacctgagtgccccaacgcgtcccgggcctggaatgtgtgggaagtggaggactacggcttcggcgtctttaccacaaacatttggctgaaactgagagaaatgtatacccagctttgtgaccaccgcctcatgagcgctgccgttaaggatgagcgggccgtgcacgctgacatggggtactggatcgagtcccagaaaaatggatcttggaagctggaaaaggccagcctgattgaggtgaaaacatgcacctggccgaagtcccatacgctctggtctaacggcgtcctggaaagcgatatgatcattcctaaatcccttgcggggcccatcagccagcacaattacagacctggatatcatacacaaaccgctggcccctggcacctggggaagctcgagctggacttcaactactgcgagggaaccacagtggttatcaccgaaaattgtggcacgcgcggcccttctctgcggacaaccacagtgtccgggaaacttattcacgagtggtgctgtagaagctgcaccctgcccccgctgcgctatatgggagaagatggctgttggtacgggatggagatccggcctattaacgaaaaggaggagaatatggtcaagtctctggtgtccgccggaagcggcaaagttgacaactttacaatgggggtgctctgcctggccatccttttcgaagaggtcatgagaggaaagttcggcaaaaagcatatgattgctggcatcctgtttattttcgtgctcctgctgtctgggcagatcacctggcgggatatggcccgcacgcttatcatgattggaagcaatgcgtccgacagaatgggcatgggggttacctatctggctctcatcgccacatttaaaattcagcccttcctggccctcggatttttcctgcggaaacttaccagcagagaaaacctgctcctgggcgtggggctggctatggccacaacccttcaactgcccgaggatatcgaacagatggctaatggaattgccctcggcctgatggcgctcaagctgatcacgcagtttgagacataccagctttggaccgccctggtctctctcacatgttccaacaccatcttcaccctgacagtggcttggcgcacggccaccctgattcttgctggcatcagcctgctccctgtgtgccaatcctctagcatgcggaaaacagactggctgccgatgaccgtcgccgccatgggggttccccctctccccctgtttattttctcccttaaggatacactgaaaagacgctcttggcctctgaatgagggagtgatggctgtgggcctcgtcagcatcctggcgtcctctcttctgagaaacgacgtgcccatggccgggcctctcgttgctggaggcctgctcattgcctgttatgtgatcaccgggacgagcgccgatctgacagtcgaaaaggctgccgacgtgacctgggaggaagaggcggaacagaccggagtttcccacaaccttatgatcacagtggacgatgacggcaccatgcggattaaagatgacgagacagagaatatcctgacggtcctgctcaagaccgctctgcttattgtgagcggcatctttccctactctattccggccacactgctcgtctggcatacctggcagaaacagacacaacgctccggggtgctgtgggatgttccttctccccctgaaacccagaaggccgagctcgaagagggagtgtacagaatcaagcagcagggcattttcgggaaaacgcaagtcggagtgggcgttcagaaggagggggtgtttcacaccatgtggcatgtcacacggggagctgtgctgacctataacggcaaacgccttgaacccaattgggcctccgtgaagaaagacctgatctcctacggcgggggatggagactgagcgcgcagtggcaaaagggcgaggaagttcaggtcatcgctgtggagccggggaagaaccctaaaaatttccagacaatgcccggaattttccagaccacaacgggcgaaatcggggccattgccctcgattttaagcctggaacctctggctcccccatcattaaccgggagggcaaagtggtcgggctgtatggaaatggcgtggttacaaagaacgggggatacgtgagcggcatcgctcaaaccaatgccgagcccgacgggcctaccccggaacttgaggaagagatgttcaaaaagcgcaacctgacaatcatggatctccaccccggctccggaaagacgagaaaatatctgcctgctattgtccgggaagccatcaagcgcagactccggaccctgattcttgcgcccacaagagtggttgccgctgagatggaggaagccctgaaaggcctgcctatccgctaccagaccacagctaccaagagcgagcacacggggaaagaaattgtggacctcatgtgccatgccacatttaccatgcggctgctttctcccgtcagagtgcctaattataacctgatcatcatggatgaggcccacttcaccgacccggctagcattgcggcccgcggatacatctccacacgggttggcatgggggaagctgccgccatttttatgaccgctacaccccctggaaccgccgatgcgttcccccagtctaatgctcctatccaggacgaggagagagacattcccgaacgcagctggaactccggcaatgattggatcacggactttgccgggaagacagtgtggttcgtcccgtctattaaggccggcaacgatatcgctaactgtctccggaaaaatggaaagaaagtgatccaactgagcagaaagacctttgacacagagtaccagaaaaccaagctgaacgattgggacttcgtggtcacgaccgatatttccgaaatgggcgccaattttaaggcggaccgcgttatcgatcctcggagatgcctcaaacccgtgattcttacagacgggcccgagcgggtgatcctggccggacctatgcccgtcaccgtggcttctgccgctcagcgcagaggccgggttgggcgcaaccctcagaaggagaatgatcaatatattttcacaggacagccgctgaacaatgacgaagaccatgcccactggaccgaggctaaaatgctcctggataacatcaatacacccgaaggcatcattcctgcccttttcgagcccgaaagagaaaagagcgcggccatcgacggggagtaccggctgaaaggcgaatccagaaagacctttgtggagctcatgcgccggggagatctgcctgtctggctggctcataaagtggccagcgaaggcattaagtatacggacagaaagtggtgcttcgatggggagcgcaacaatcagatcctcgaagagaacatggacgttgagatttggacaaaagaaggagagaagaagaaacttcggcccagatggctggatgctcgcacctactctgacccgctggccctcaaagaatttaaagatttcgccgctggccggaagtccatcgcgctggaccttgtgaccgagatcgggagagtccctagccacctggcccaccgcacaagaaatgctctcgataacctggtgatgctgcatacctctgaacacggaggccgggcctatcgccatgccgtcgaggagctccccgaaacaatggagacgcttctgctgctcggcctgatgattcttctgaccgggggagctatgctctttctgatctccggcaaaggggtgggaaagacaagcattggcctgatctgtgttgtggcctcctctgggatgctctggatggcggacattcctcttcagtggatcgccagcgctattgtgctggagttctttatgatggtcctgctcatccccgagcctgagaaacaaagaacaccccaggataatcagctggcctacgttgtgatcggcattcttacactggctgccatcgtggcggccaacgaaatgggcctcctggagaccacgaagcgggacctgggcatgtccaaagaaccgggggtcgtgcctcccaccagctatctcgacgttgatcttcaccccgcttctgcctggacactgtacgctgtggccaccacagtcattacccctatgctgcgccacacgatcgaaaattccacagctaacgtgagcctcgccgcgattgccaaccaagctgtcgtgctgatgggacttgacaagggctggccgatctctaagatggatctgggggttcccctcctggccctgggatgctacagccaggtgaatcctctcacccttacagctgccgtcctgctgctcgtgacccattatgccatcattggccccgggctgcaggcgaaagctaccagagaagcccagaagcggacagctgccggaatcatgaaaaaccctacggttgacggcattatgaccatcgatcttgaccccgtgatttacgattccaagttcgagaaacaactgggccaggtcatgctcctggtgctgtgtgccgtgcagctccttctgatgagaacatcttgggctttttgcgaggccctgaccctcgcgacagggcctatcaccacgctgtgggaaggaagcccgggcaagttctggaatacaaccatcgccgtttccatggctaacatttttcgcgggtcttatcttgccggagctggcctggccttcagcatcatgaagtccgtcgggaccggaaaacggggcacaggcagccagggggagaccctcggagaaaagtggaaaaagaaactgaatcaactgtctagaaaggagtttgacctctacaaaaagtccggcattacagaagtggatcgcacggaggcgaaggaggggcttaaacggggagaaatcacccaccatgccgtgagcagaggctccgctaagctgcagtggttcgtcgagcggaacatggttattcccgaagggcgcgtgatcgacctgggatgtggcagaggcgggtggtcttattactgcgccggactcaaaaaggtgacagaggtccggggctataccaaagggggacctggccacgaggaacccgtgcctatgagcacatacgggtggaatattgttaagctgatgtccggaaaggatgtgttctaccttcccccggagaaatgtgacaccctgctctgcgatatcggcgaatctagcccttcccccacggtcgaggaaagccgcaccatcagagtgctgaagatggttgagccctggctgaaaaacaatcagttttgtattaaggtgctcaacccttatatgcccacagtcatcgagcatcttgaacggctgcagcgcaaacacggcgggatgctggtgagaaatcctctctctcggaactccacccacgagatgtactggattagcaatggaacaggcaacatcgtgtcttccgtcaatatggttagccgcctgcttctgaacagattcaccatgacacatcggagaccgaccattgaaaaggacgtggacctcggggctggaacgcgccacgtgaacgccgagcccgaaacacctaatatggatgtcatcggcgagcggatcagacgcattaaggaggaacattctagcacctggcactatgacgatgagaacccctacaaaacctgggcttatcacgggtcctacgaagtgaaggccacaggatctgcgagctccatgatcaatggcgttgtgaaactgctgacgaagccttgggacgtcgtgcccaccgttacacaaatggccatgaccgatacaaccccgtttggccagcagcgggtgttcaaagagaaggtcgacacaagaacccctaagcccatgcctgggacgcgcaaagtgatggaaattaccgctgagtggctctggcggacactgggaagaaacaagcgcccccggctttgcaccagagaggaatttaccaagaaggttcgcaccaatgccgctatgggcgccgtgttcacggaggaaaaccaatgggatagcgcccgggcggctgtcgaggacgaagagttttggaaactggtggatagagagcgcgaactccataagctggggaaatgtggatcctgcgtctataatatgatgggcaagagagagaagaaacttggggagttcggcaaggccaaaggatctcgggccatctggtacatgtggctgggcgctcgctacctcgagtttgaggccctggggttcctgaacgaagaccactggtttagcagagaaaattcctattctggagtggaaggcgaggggctccataagctgggatacattcttcgggatatcagcaaaatccctggcggggctatgtatgccgacgacacagcgggctgggataccagaattacagaagacgatctgcacaacgaggagaagatcacccagcagatggaccccgaacatcggcagctcgccaatgctattttcaagctgacgtaccaaaacaaagttgtgaaggtccagcgcccgacccctaaaggaacagtgatggatatcatttccagaaaggaccagcggggctctggacaggtgggaacctatggccttaatacatttaccaacatggaggcccaactgatccgccagatggaaggggagggagttctcagcaaaacagatctggaaaatccccacctcctcgagaagaagatcacccagtggctggagacgaaaggcgtggaaagacttaagcggatggctatttccggggacgattgcgtcgtgaaacccatcgacgatcgcttcgccaacgcgctgctcgccctgaacgacatgggcaaggttagaaaagatattcctcagtggcaaccgagcaagggatggcacgactggcaacaggtgcccttctgttctcatcactttcatgagcttatcatgaaggacggccggaaactggtcgtgccttgccgcccccaggatgaactcattgggagagctcggatctcccaaggagccggctggagcctgaaggagacagcttgtctggggaaagcctacgctcagatgtgggccctcatgtatttccaccgcagagacctgcggcttgcgtctaatgccatttgctccgctgtccctgtgcactgggttcccaccagccgcaccacatggtctatccatgcccaccatcagtggatgaccacagaagatatgctgacggtgtggaacagagtctggatcgaggacaatccttggatggaggataagacccccgtgacaacctgggaagacgttccgtacctcggaaaacgggaggatcaatggtgtggctccctgattgggcttacaagcagagccacctgggctcagaacatcctgacggccattcaacaggtgcgctccctcatcggcaatgaagagtttctggactacatgcctagcatgaagcggttcagaaaggaggaggagctggaaggagcgatttggtga

SEQ ID NO: 20350 - RNA, 9873 nt, synthetic construct
  misc_feature 1..9873: note = derived and/or modified CDS sequence (opt5) from DENV-3__AB189127__SS-prME
  source 1..9873: mol_type = other RNA
accagcctgtgcctcatgatgatgctgcccgccacccttgctttccacctgacgtcccgggacggagagcctcggatgatcgtggggaagaatgaacgcggaaagtctctcctgtttaagaccgccagcggcattaatatgtgtacacttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcaaacctggatgagcgccgagggcgcttggcggcaggtcgaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagcccccgcaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggaaagctcataacggacgcctgattacagccaaccctgtggtcaccaagaaagaggaacccgtgaatatcgaggccgaacccccttttggcgagtctaacattatcattgggatcggcgataaggctcttaagatcaattggtacaaaaagggaagctccattggcaaaatgttcgaagccacagctagaggggcccggagaatggcgatcctcggagacaccgcctgggattttggcagcgtcggcggggttctgaactctctggggaagatggtccaccagattttcgggtccgcttatacggccctctttagcggcgtgtcttggatcatgaaaattggaatcggcgtgctgcttacatggattgggctgaatagcaagaacacctccatgtctttcagctgcatcgtcatcggaattatcaccctctacctgggcgctgtggttcaggccgacatggggtgtgtgattaattggaagggaaaagagctgaagtgcggctccgggatctttgtcacaaacgaggtgcatacctggacagaacagtataaattccaagcggatagcccgaagcgccttgccacggctattgccggcgcttgggagaatggagtttgtggcatccggtctaccacaagaatggaaaacctcctgtggaaacagatcgccaatgagctgaactacattctctgggaaaataacatcaagctgaccgtggtcgtgggggacattatcggagttcttgagcagggcaaacgcacactgacaccccagcctatggagctcaagtattcctggaagacgtgggggaaagccaaggtggtcaccgctgaaattcaaaatagctcttttatcatcgatggacccaacacacctgagtgccccaacgcgtcccgggcctggaatgtgtgggaagtggaggactacggcttcggcgtctttaccacaaacatttggctgaaactgagagaaatgtatacccagctttgtgaccaccgcctcatgagcgctgccgttaaggatgagcgggccatccacgctgacatggggtactggattgagtcccagaaaaatggatcttggaagctggaaaaggccagcctgatcgaggtgaaaacatgcacctggccgaagtcccatacgctctggtctaacggcgtgctggaaagcgatatgattatccctaaatcccttgcggggcccatcagccagcacaattacagacctggatatcatacacaaaccgctggcccctggcacctggggaagctcgagctggacttcaactactgcgagggaaccacagtcgtgattaccgaaaattgtggcacgcgcggcccttctctgcggacaaccacagtttccgggaaacttatccacgagtggtgctgtagaagctgcaccctgcccccgctgcgctatatgggagaagatggctgttggtacgggatggagattcggcctatcaacgaaaaggaggagaatatggtgaagtctctggtctccgccggaagcggcaaagtggacaactttacaatgggggttctctgcctggccattcttttcgaagaggtgatgagaggaaagttcggcaaaaagcatatgatcgctggcattctgtttatgttcgtcctcctgctgtctgggcagatcacctggcgggatatggcccgcacgcttatcatgattggaagcaatgcgtccgacagaatgggcatgggggtgacctatctggctctcatcgccacatttaaaattcagcccttcctggccctcggatttttcctgcggaaacttaccagcagagaaaacctgctcctgggcgttgggctggctatggccacaacccttcaactgcccgaggatatcgaacagatggctaatggaattgccctcggcctgatggcgctcaagctgatcacgcagtttgagacataccagctttggaccgccctggtgtctctcacatgttccaacaccatcttcaccctgacagtcgcttggcgcacggccaccctgattcttgctggcatcagcctgctccctgtgtgccaatcctctagcatgcggaaaacagactggctgccgatgaccgtggccgccatgggggtgccccctctccccctgtttattttctcccttaaggatacactgaaaagacgctcttggcctctgaatgagggagttatggctgtgggcctcgtgagcatcctggcgtcctctcttctgagaaacgacgtccccatggccgggcctctcgtggctggaggcctgctcattgcctgttatgttatcaccgggacgagcgccgatctgacagtggaaaaggctgccgacgtcacctgggaggaagaggcggaacagaccggagtgtcccacaaccttatgatcacagttgacgatgacggcaccatgcggattaaagatgacgagacagagaatatcctgacggtgctgctcaagaccgctctgcttattgtcagcggcatctttccctactctattccggccacactgctcgtgtggcatacctggcagaaacagacacaacgctccggggtcctgtgggatgtgccttctccccctgaaacccagaaggccgagctcgaagagggagtttacagaatcaagcagcagggcattttcgggaaaacgcaagtgggagtcggcgtgcagaaggagggggtttttcacaccatgtggcatgtgacacggggagctgtcctgacctataacggcaaacgccttgaaccctcctgggcctccgtgaagaaagacctgatcagctacggcgggggatggagactgtctgcgcagtggcaaaagggcgaggaagtgcaggttatcgctgtcgagccggggaagaatcctaaaaacttccagacaatgcccggaattttccagaccacaacgggcgaaatcggggccattgccctcgattttaagcctggaacctccggcagccccatcattaatcgggagggcaaagtggtggggctgtatggaaacggcgtcgtgacaaagaatgggggatacgtttccggcatcgctcaaaccaacgccgagcccgacgggcctaccccggaacttgaggaagagatgttcaaaaagcgcaatctgacaatcatggatctccaccccggcagcggaaagacgagaaaatatctgcctgctattgtgcgggaagccatcaagcgcagactccggaccctgattcttgcgcccacaagagtcgtggccgctgagatggaggaagccctgaaaggcctgcctatccgctaccagaccacagctaccaagtctgagcacacggggaaagaaattgttgacctcatgtgccatgccacatttaccatgcggctgcttagccccgtgagagtccctaactataatctgatcatcatggatgaggcccacttcaccgacccggcttccattgcggcccgcggatacatctctacacgggtgggcatgggggaagctgccgccatttttatgaccgctacaccccctggaaccgccgatgcgttcccccagagcaacgctcctatccaggacgaggagagagacattcccgaacgctcctggaactctggcaacgattggatcacggactttgccgggaagacagtttggttcgtgccgagcattaaggccggcaatgatatcgctaactgtctccggaaaaacggaaagaaagtcatccaactgtccagaaagacctttgacacagagtaccagaaaaccaagctgaatgattgggacttcgtggtgacgaccgatatttctgaaatgggcgccaactttaaggcggaccgcgtcatcgatcctcggagatgcctcaaacccgttattcttacagacgggcccgagcgggtgatcctggccggacctatgcccgtgaccgtcgctagcgccgctcagcgcagaggccgggtggggcgcaatcctcagaaggagaacgatcaatatattttcacaggacagccgctgaataacgacgaagaccatgcccactggaccgaggctaaaatgctcctggataatatcaacacacccgaaggcatcattcctgcccttttcgagcccgaaagagagaagtccgcggccatcgacggggagtaccggctgaaaggcgaaagcagaaagacctttgttgagctcatgcgccggggagatctgcctgtgtggctggctcataaagtcgcctctgaaggcattaagtatacggacagaaagtggtgcttcgatggggagcgcaataaccagatcctcgaagagaatatggacgtggagatttggacaaaagaaggagagaagaagaaacttcggcccagatggctggatgctcgcacctactccgacccgctggccctcaaagaatttaaagatttcgccgctggcagaaagagcatcgcgctggaccttgttaccgagatcgggagagtgccttctcacctggcccaccgcacaagaaacgctctcgataatctggtcatgctgcatacctccgaacacggaggccgggcctatcgccatgccgtggaggagctccccgaaacaatggagacgcttctgctgctcggcctgatgattcttctgaccgggggagctatgctctttctgatcagcggcaaaggggtcggaaagacatccattggcctgatctgtgtggttgcctctagcgggatgctctggatggcggacattcctcttcagtggatcgcctccgctattgtgctggagttctttatgatggtgctgctcatccccgagcctgagaaacaaagaacaccccaggataaccagctggcctacgtcgttatcggcattcttacactggctgccatcgtggcggccaatgaaatgggcctcctggagaccacgaagcgggacctgggcatgagcaaagaaccgggggtggtccctcccacctcttatctcgacgtggatcttcaccccgcttccgcctggacactgtacgctgttgccaccacagtgattacccctatgctgcgccacacgatcgagaacagcacagctaatgtctctctcgccgcgattgccaaccaagctgtggtcctgatgggacttgacaagggctggccgatcagcaagatggatctgggggtgcccctcctggccctgggatgctactcccaggttaaccctctcacccttacagctgccgtgctgctgctcgtcacccattatgccatcattggccccgggctgcaggcgaaagctaccagagaagcccagaagcggacagctgccggaatcatgaaaaatcctacggtggacggcattatgaccatcgatcttgaccccgttatttacgattctaagttcgagaaacaactgggccaggtgatgctcctggtcctgtgtgccgtgcagctccttctgatgagaacaagctgggctttttgcgaggccctgaccctcgcgacagggcctatcaccacgctgtgggaaggatccccgggcaagttctggaacacaaccatcgccgtgtctatggctaatatttttcgcgggagctatcttgccggagctggcctggccttctccatcatgaaaagcgttgggaccggaaaacggggcacaggctctcagggggagaccctcggagaaaagtggaaaaagaaactgaaccaactgtccagaaaggagtttgacctctacaaaaagagcggcattacagaagtcgatcgcacggaggcgaaggaggggcttaaacggggagaaatcacccaccatgccgtgtccagaggctctgctaagctgcagtggttcgtggagcggaatatggtcattcccgaagggcgcgttatcgacctgggatgtggcagaggcgggtggagctattactgcgccggactcaaaaaggtgacagaggtgcggggctataccaaagggggacctggccacgaagaacccgtccctatgtccacatacgggtggaacattgtgaagctgatgtctggaaaggatgttttctaccttcccccggagaaatgtgacaccctgctctgcgatatcggcgaaagctcccctagccccacggtggaggaatctcgcaccatcagagtcctgaagatggtggagccctggctgaaaaataaccagttttgtattaaggttctcaatccttatatgcccacagtgatcgagcatcttgaacggctgcagcgcaaacacggcgggatgctggtcagaaaccctctctcccggaatagcacccacgagatgtactggatttctaacggaacaggcaatatcgtgtccagcgtgaacatggtctctcgcctgcttctgaatagattcaccatgacacatcggagaccgaccattgaaaaggacgttgacctcggggctggaacgcgccacgtgaacgccgagcccgaaacacctaacatggatgtgatcggcgagcggatcagacgcattaaggaggaacatagctccacctggcactatgacgatgagaatccctacaaaacctgggcttatcacgggtcttacgaagtcaaggccacaggaagcgcgtccagcatgatcaacggcgtggttaaactgctgacgaagccttgggacgtggtccccaccgtgacacaaatggccatgaccgatacaaccccgtttggccagcagcgggttttcaaagagaaggtggacacaagaacccctaagcccatgcctgggacgcgcaaagtcatggaaattaccgctgagtggctctggcggacactgggaagaaataagcgcccccggctttgcaccagagaggaatttaccaagaaggtgcgcaccaacgccgctatgggcgccgttttcacggaggaaaatcaatgggattccgcccgggcggctgtggaggacgaagagttttggaaactggtcgatagagagcgcgaactccataagctggggaaatgtggatcttgcgtgtataacatgatgggcaagagagagaagaaacttggggagttcggcaaggccaaaggaagccgggccatctggtacatgtggctgggcgctcgctacctcgagtttgaggccctggggttcctgaatgaagaccactggttttccagagagaactcttatagcggagtcgaaggcgaggggctccataagctgggatacattcttcgggatatctccaaaatccctggcggggctatgtatgccgacgacacagcgggctgggataccagaattacagaagacgatctgcacaatgaggagaagatcacccagcagatggaccccgaacatcggcagctcgccaacgctattttcaagctgacgtaccaaaataaagtggttaaggtgcagcgcccgacccctaaaggaacagtcatggatatcatttctagaaaggaccagcggggcagcggacaggtgggaacctatggccttaacacatttaccaatatggaggcccaactgatccgccagatggaaggggagggagtgctctccaaaacagatctggaaaacccccacctcctcgagaagaagatcacccagtggctggagacgaaaggcgttgaaagacttaagcggatggctattagcggggacgattgcgtggtcaaacccatcgacgatcgcttcgccaatgcgctgctcgccctgaacgacatgggcaaggtgagaaaagatattcctcagtggcaaccgtctaagggatggcacgactggcagcaggttcccttctgttcccatcactttcatgagcttatcatgaaggacggccggaaactggtggtcccttgccgcccccaggatgaactcattgggagagctcggatcagccaaggagccggctggtctctgaaggagacagcttgtctggggaaagcctacgctcagatgtgggccctcatgtatttccaccgcagagacctgcggcttgcgtccaacgccatttgcagcgctgtgcctgtccactgggtgcccacctctcgcaccacatggtccatccatgcccaccatcagtggatgaccacagaagatatgctgacggtttggaatagagtgtggatcgaggacaacccttggatggaggataagacccccgtcacaacctgggaagacgtgccgtacctcggaaaacgggaggatcaatggtgtggcagcctgattgggcttacatccagagccacctgggctcagaatatcctgacggccattcagcaggttcgcagcctcatcggcaacgaagagtttctggactacatgccttctatgaagcggttcagaaaggaggaagaactggaaggagcgatttggtga

SEQ ID NO: 20351 - RNA, 9873 nt, synthetic construct
  misc_feature 1..9873: note = derived and/or modified CDS sequence (opt5) from DENV-3__AB189128__SS-prME
  source 1..9873: mol_type = other RNA
accagcctctgcctcatgatgatcctgcccgccacccttgctttccacctgacgtcccgggacggagaacctcggatgattgtggggaagaacgaacgcggaaagtctctcctgtttaagaccgccagcggcatcaatatgtgtacccttattgcgatggatctgggggaaatgtgcgacgataccgtgacctacaaatgtccgctcatcaccgaagttgagcccgaagacattgattgctggtgtaacctgacctccacctgggtgacgtatggaacctgcaatcaggctggcgagcatcggcgggacaagcgctctgtggccctggcccctcacgtcgggatgggactcgatacaagaacccaaacatggatgagcgctgagggcgcctggagacaggtggaaaaagttgagacctgggctttccgccatcccggctttacggtgctggcccttttcctggcgcactttatcgggacatccctcacccagaaggtcgtgatcttcattctgcttatgctggttacaccttctatgaccatgagatgtgtgggagtcggcaaccgggactttgtggaagggctcagcggagccacctgggtggatgtcgttctggagcatggcgggtgcgtgacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattacgtctgtaaacacacctatgtggatcggggctgggggaacggatgcggcctgttcgggaagggaagccttgttacatgcgcgaagtttcaatgtctggagtctatcgagggcaaagtggtccagcacgaaaatctcaagtacaccgtgattatcacagttcatacgggggaccagcaccaggtgggaaacgagacccaaggcgtcacagccgaaatcacaccccaggcttccacagtggaggccattctgcctgaatatggcaccctggggctcgagtgcagcccccgcacgggactggacttcaatgagatgatccttctgaccatgaaaaacaaggcttggatggtccatagacagtggtttttcgatctccctctgccctggacatctggcgccaccacagaaaccccgacgtggaataaaaaggagcttctggtgacatttaaaaacgcccacgctaagaagcaagaagttgtggtcctcgggtcccaggagggagcgatgcacaccgccctgacaggcgctaccgaaattcagaccagcgggggcacatctatcttcgccggacatctgaaatgtcggctcaagatggacaaactggagcttaagggcatgtcctacgccatgtgcctgaatgctttcgtgctcaaaaaggaggttagcgaaacgcagcacgggaccattctgatcaaggtggagtataaaggagaagatgccccttgtaagatccccttttccacagaggacggccaagggaaagcgcataacggacgcctgattaccgctaaccctgtcgtgacaaagaaagaggaacccgtgaatatcgaggccgaaccccctttcggcgagtctaacattgttatcgggattggcgataaggcccttaagatcaattggtacaaaaagggaagctccatcggcaaaatgtttgaagctaccgccagaggggctcggagaatggccattctcggagacacggcgtgggatttcggcagcgtcgggggagtgctgaactctctgggcaagatggtgcaccagatctttgggtccgcctacacagctctcttcagcggcgtctcttggattatgaaaatcggaattggcgtgctgcttacctggatcgggctgaatagcaagaacacctccatgtcttttagctgcattgttatcggaatcattacactctatctgggcgccgtggtccaggctgacaccgggtgtgtgatcaattggaagggaaaagagctgaagtgcggctccgggattttcgttacaaacgaggtgcatacgtggaccgaacagtacaaatttcaagccgatagcccgaagcgccttgcgacagccatcgctggcgcctgggagaatggagtctgtggcattcggtctaccacaagaatggaaaacctcctgtggaaacagatcgctaatgagctgaactatatcctctgggaaaataacattaagctgaccgtggttgtgggggacatcattggagtccttgagcagggcaaacgcacgctgacaccccagcctacagagctcaagtactcctggaagacctgggggaaagccaagatcgtgacagccgaaacccaaaatagctctttcattatcgatggacccaacacacctgagtgcccctccgctagccgggcgtggaacgtgtgggaagtcgaggaatatggctttggcgttttcaccacgaatatctggctgaaactgagagagatgtacacacagctttgtgaccaccgcctcatgtccgccgctgtgaaggacgagcgggccgtgcacgccgatatggggtattggattgaatctcagaaaaacggaagctggaagctggagaaggcttccctgatcgaagtcaaaacctgcacctggccgaagtctcatacactctggagcaatggcgtgctggagtccgacatgattatccctaaaagccttgccgggcccatttctcagcacaactacagacctggataccatacccaaacggcgggcccctggcacctggggaagctcgagctggattttaattattgcgaaggaacaaccgttgtgatcacagagaactgtggcacccgcggcccttccctgcggacaaccacggtcagcgggaaacttatccacgaatggtgctgtagatcttgcaccctgcccccgctgcgctacatgggagaggacggctgttggtatgggatggaaattcggcctatcaatgagaaggaggaaaacatggtgaagtccctggttagcgctggatctggcaaagtggataatttcacaatgggggtcctctgcctggccattcttttcgaggaagtgatgagaggaaagtttggcaaaaagcatatgatcgccggcgttctgttcacctttgtgctcctgctgagcgggcagattacatggcgggacatggctcgcacccttatcatgattggatccaacgccagcgatagaatgggcatgggggtcacgtacctggcgctcatcgctacattcaaaatccagccctttctggccctcggattctttctgcggaaacttacctctagagagaatctgctcctgggcgtggggctggccatggctacaacccttcaactgcccgaagacattgagcagatggccaacggaatcgctctcggcctgatggccctcaagctgattacccagttcgagacatatcagctttggacggcgctggtgtccctcatgtgtagcaataccatctttacactgaccgtcgcctggcgcacagctaccctgattcttgccggcatctccctgctccctgtttgccaatctagctccatgcggaaaacggattggctgccgatgacagtggctgccatgggggtgccccctctccccctgttcatcttttctcttaaggacaccctgaaaagacgcagctggcctctgaacgaaggagtcatggccgtgggcctcgtttccattctggcttctagccttctgagaaatgatgtgcccatggcggggcctctcgtcgccggaggcctgctcatcgcttgttacgtgattaccgggacatccgccgacctgaccgttgagaaggccgctaacgtgacatgggaagaggaagccgagcagacgggagtcagccacaaccttatgatcaccgtggatgacgacggcacaatgcggattaaagatgacgagaccgaaaatatcctgacagtcctgctcaagaccgcgctgcttatcgtgtctggcattttcccctattccatcccggctacgctgctcgtttggcatacctggcagaaacagacacaacgcagcggggtgctgtgggatgtcccttctccccctgagacccagaaggccgaactcgaggacggagtgtacagaattaagcagcagggcatctttgggaaaacacaagttggagtgggcgtccagaaggagggggtgttccacaccatgtggcatgtgacacggggagccgttctgacgcacaacggcaaacgccttgaacccaattgggcttccgtcaagaaagatctgattagctacggcgggggatggagactgtctgcccagtggcaaaagggcgaggaagtccaggtgatcgcggtcgagccggggaagaaccctaaaaatttccagaccatgcccggaatttttcagacaaccaccggcgaaatcggggctatcgccctcgacttcaagcctggaacatccggcagccccattatcaaccgggagggcaaagtggttgggctgtatggaaatggcgtggtcacgaagaacgggggatacgtgtccggcattgcccaaaccaatgctgagcccgatgggcctacaccggaacttgaggaagagatgtttaaaaagcgcaacctgaccatcatggacctccaccccggcagcggaaagacaagaaaatatctgcctgccattgttcgggaagctatcaagcgcagactccggaccctgatccttgcccccacgagagtggtcgcggccgagatggaggaagctctgaaaggcctgcctattcgctaccagacaaccgccaccaagtctgagcatacagggaaagaaatcgtggatctcatgtgccacgctaccttcacaatgcggctgcttagccccgttagagtgcctaattataacctgattatcatggacgaggcccattttaccgatccggcctccattgctgcgcgcggatacatctctacgcgggtcggcatgggggaagccgctgccatcttcatgacagccacaccccctggaacagctgacgcctttccccagagcaatgcgcctattcaggatgaggagagagacatccccgaacgctcctggaactctggcaatgagtggattaccgacttcgctgggaagacggtgtggtttgtgccgagcatcaaggccggcaacgatattgccaactgtctccggaaaaatggaaagaaagtcatccaactgtccagaaagaccttcgacacagaatatcagaaaaccaagctgaacgattgggactttgttgtgacaaccgatatttctgagatgggcgctaatttcaaggccgaccgcgtgatcgatcctcggagatgcctcaaacccgtcatccttacagacgggcccgagcgggtgattctggcgggacctatgcccgttaccgtggccagcgctgcccagcgcagaggccgggtcgggcgcaaccctcagaaggaaaatgatcaatacatcttcacgggacagccgctgaacaatgacgaggatcacgctcattggacagaagccaaaatgctcctggacaacattaatacccccgagggcatcattcctgctctttttgaacccgagagagagaagtccgccgcgatcgacggggaataccggctgaaaggcgagagcagaaagaccttcgtggaactcatgcgccggggagatctgcctgtttggctggcccacaaagtggcttctgagggcatcaagtatacagacagaaagtggtgctttgatggggaacgcaacaatcagattctcgaggagaacatggacgtcgaaatctggaccaaagagggagaaaagaagaaacttcggcccagatggctggatgcccgcacatactccgacccgctggctctcaaagagttcaaagattttgccgccggcagaaagagcattgctctggaccttgtgacggaaatcgggagagtcccttctcacctggcgcatcgcaccagaaatgccctcgataacctggtgatgctgcacacatccgagcatggaggccgggcttatcgccacgccgttgaggaactccccgagaccatggaaacacttctgctgctcggcctgatgattcttctgaccgggggagccatgctgttcctgatcagcggcaaagggatcggaaagacgtccattggcctgatctgtgtggtggcttctagcgggatgctctggatggccgacgtccctcttcagtggattgcgtccgccatcgttctggagtttttcatgatggtgctgctcattcccgagcctgaaaaacaaagaacaccccaggataatcagctggcttacgtggtcatcggcattcttacactggccgctatcgtggccgcgaacgagatgggcctcctggaaaccacaaagcgggacctgggcatgagcaaagagccgggggttgtgtctcctatctcctatctcgatgtcgaccttcaccccgccagcgcttggaccctgtacgccgtggctacgacagtcattacccccatgctgcgccatacaatcgaaaattctaccgccaacgtgagcctcgctgccattgcgaaccaagccgttgtgctgatgggacttgacaagggctggcctatctccaagatggatctgggggtcccgctcctggctctgggatgctattctcaggtgaatcccctcacccttacagccgctgttctgctgctcgtgacgcactacgccattatcggccctgggctgcaggccaaagcgaccagagaggctcagaagcggacagccgctggaatcatgaaaaaccccaccgtcgacggcattatgacaatcgatcttgaccctgtgatttacgatagcaagtttgagaaacaactgggccaggtgatgctcctgatcctgtgtgccgttcagctccttctgatgagaacctcctgggccttctgcgaagctctgacgctcgccacagggcccattaccaccctgtgggagggatctcctggcaagttttggaatacaaccatcgcggtcagcatggccaacatcttccgcgggtcctatcttgctggagccggcctggcttttagcattatgaagtctgtggggacaggaaaacggggcacgggctcccagggggaaaccctcggagagaagtggaaaaagaaactgaatcaactgagcagaaaggagttcgacctctacaaaaagtccggcatcacagaggtggatcgcaccgaggccaaggaagggcttaaacggggagagattacacatcacgcggtctctagaggcagcgccaagctgcagtggttcgttgaacggaacatggtgatcccggaggggcgcgtgattgacctgggatgtggcagaggcgggtggtcctattactgcgctggactcaaaaaggtcaccgaagtgcggggctatacgaaagggggacccggccatgaggagcctgttcccatgtctacctacgggtggaatatcgtgaagctgatgagcggaaaggatgtcttttatcttcctcccgaaaaatgtgacacactgctctgcgatattggcgagtccagcccgtctcctaccgtggaagagtcccgcacaatcagagttctgaagatggtggagccctggctgaaaaacaatcagttctgtatcaaggtcctcaacccctacatgcctaccgtgattgaacaccttgagcggctgcagcgcaaacacggcgggatgctggtgagaaatcccctcagccggaactctacacatgaaatgtactggatctccaatggaaccggcaacattgtcagctctgttaatatggtgagccgcctgcttctgaacagatttacgatgacacaccggagacctaccatcgagaaggacgtggatctcggggccggaacccgccatgtcaacgctgaaccggagacacccaatatggacgtgattggcgagcggatcagacgcatcaaggaagaacactcctctacgtggcactatgacgatgaaaacccttacaaaacctgggcctatcatgggagctacgaggttaaggctacaggatccgccagctccatgattaatggcgtggtcaaactgctgaccaagccctgggacgtggttcctacagtgacccaaatggcgatgacagataccacgcccttcggccagcagcgggtctttaaagaaaaggtggacaccagaacaccgcgccctatgcccgggacccggaaggttatggagatcacagccgagtggctctggagaaccctgggacgcaacaaacggcctagactttgcacgcgcgaagagttcacaaagaaagtgcggaccaatgctgccatgggcgctgtctttacagaagagaaccaatgggattctgccagagccgcggtggaagacgaggagttctggaagctggtcgatcgcgaaagagagctccacaaactggggaagtgtggaagctgcgtgtataatatgatgggcaaacgggaaaagaaacttggggagtttggcaaagctaagggatcccgcgccatttggtacatgtggctgggcgccagatatctcgagttcgaagctctggggtttctgaacgaggaccattggttctctcgggaaaatagctactccggagttgagggcgaagggctccacaaactgggatacatccttagagatatttctaagatccccggcggggccatgtatgctgacgataccgccggctgggacacgcggatcaccgaggacgatctgcataacgaggagaagattacacagcagatggaccctgagcaccgccagctcgcgaatgccatctttaagctgacctaccaaaacaaggtggtcaaagtgcagagacccacaccgaagggaaccgtgatggatattatcagccggaaagaccagcgcggctccgggcaggttggaacatatggccttaataccttcacgaacatggaagctcaactgattagacagatggagggggaaggagtgctcagcaaggccgatctggagaatcctcacctcctcgagaaaaagatcacacagtggctggaagctgagggcgtcgaacggcttaagcgcatggccatctctggggacgattgcgtggttaaacccattgacgatagattcgcgaacgccctgctcgctctgaacgacatgggcaaggtgcggaaagatatcccccagtggcaaccttccaagggatggcatgactggcagcaggtcccgttttgtagccaccatttccacgagcttattatgaaagatggccgcaagctggtggtcccctgcagacctcaggacgaactcatcgggcgggcccgcatttctcaaggagctggctggtccctgaaggagaccgcctgtctggggaaggcttacgcccagatgtgggcgctcatgtattttcacagacgggacctgcgccttgccagcaatgctatctgctctgccgtgcccgttcattgggtgcctacctccagaacaacctggagcattcacgcccatcaccagtggatgacaacggaggatatgctgaccgtctggaaccgggtgtggatcgaagacaatccctggatggaggataagacacctgttaccacatgggaagacgtgccctacctcggaaaaagagaggatcaatggtgtggctccctgatcgggcataccagccgcgctacgtgggcccagaacattcttaccgcgatccagcaggtccggtctctgattggcaatgaggagttcctcgactatatgccgagcatgaagagatttcgcaaagaggaagagtccgaaggagctatctggtga

SEQ ID NO: 20352 - RNA, 9873 nt, synthetic construct
  misc_feature 1..9873: note = derived and/or modified CDS sequence (opt5) from DENV-3__AB214879__SS-prME
  source 1..9873: mol_type = other RNA
accagcctgtgcctcatgatgatgctgcccgccacacttgctttccacctgacgtcccgggacggagagcctcggatgatcgtggggaagaacgagcgcgggaaatctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccagacatggatgagcgctgagggcgcctggagacaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagttgtgcagcacgaaaatctcaagtataccgtcattatcacagtgcatacgggggaccagcaccaggttggaaacgagacccaaggcgtgacagccgaaatcacaccccaggcttccacagtcgaggccgtgctgcctgaatacggcaccctggggctcgagtgcagcccccgcacgggactggactttaatgagatgattcttctgaccatgaaaaacaaggcttggatggtccatagacagtggttctttgatctccctctgccctggacatctggcgccaccacagaaaccccgacgtggaataaaaaggagcttctggtgacattcaaaaacgcccacgctaagaagcaagaagttgtggtcctcgggtcccaggagggagcgatgcacaccgccctgacaggcgctaccgaaatccagaccagcgggggcacatctgtgtttgccggacatctgaaatgtcggctcaagatggacaaactggagcttaagggcatgtcctatgccatgtgcagcaatgctttcgttctgaaaaaggaggtgtccgaaacgcagcacgggaccattctcatcaaggtcgagtacaaaggagaagatgccccttgtaagattcccttctctacagaggacggccaagggaaagcgcataacggacgcctgatcaccgctaaccctgtggtgacaaagaaagaggaacccgttaatatcgaggccgaacccccttttggcgagagcaacattatcattgggatcggcgataaggccctgaagattaattggtacaaaaagggatccagcatcggcaaaatgttcgaagctaccgccagaggggctcggagaatggccatccttggagacacggcgtgggattttggctctgtcgggggagtgctcaactccctgggcaagatggtgcaccagattttcgggagcgcctatacagctctgttttctggcgtcagctggatcatgaaaattggaatcggcgtgctcctgacctggattgggcttaattccaagaacacctctatgagcttctcctgcatcgttattggaatcatcacactgtacctcggcgccgtggtccaggctgacatggggtgtgtgattaattggaagggaaaagagctgaagtgcggcagcgggatctttgttaccaacgaggtgcatacatggacggaacagtataaattccaagccgattctccgaagcgcctggcgaccgccattgctggcgcctgggagaatggagtctgtggcatccggtccacaaccagaatggaaaaccttctctggaaacagattgctaatgagctgaactacatcctgtgggaaaataacatcaagctcacagtggttgtgggggacattatcggagtcctggagcagggcaaacgcacccttacgccccagcctatggagctgaagtatagctggaagacctgggggaaagccaagattgtgacagccgaaacccaaaattcttcctttatcattgatggacccaacacacctgagtgccccagcgcttcccgggcgtggaacgtgtgggaagtcgaggactacggcttcggcgtttttaccacaaatatctggctcaaactgagagaaatgtatacccagctgtgtgaccaccgccttatgtctgccgctgtgaaggatgagcgggccgtgcacgccgacatggggtactggatcgagagccagaaaaacggatcctggaagctcgaaaaggcttctctgattgaggtcaaaacgtgcacatggcccaagagccataccctgtggtccaatggcgtgctcgaaagcgatatgatcattcctaaatctctggccgggcccatctcccagcacaactacagacctggatatcatacccaaacagcgggcccctggcaccttgggaagctggagctcgacttcaattactgcgagggaaccacggttgtgattacagaaaactgtggcacccgcggccctagcctgcggacaaccacagtctctgggaaactgatccacgagtggtgctgtagatcctgcacccttcccccgctccgctatatgggagaagatggctgttggtacgggatggagatccggcctattaatgaaaaggaggagaacatggtcaagagcctggtttctgctggaagcggcaaagtggacaattttacgatgggggtcctgtgcctcgccatcctgttcgaagaggtgatgagaggaaagttcggcaaaaagcatatgattgccggcgttctttttaccttcgtgctgctcctgtccgggcagatcacatggcgggatatggctcgcaccctgattatgatcggaagcaacgcctctgacagaatgggcatgggggtcacatatcttgcgctgattgctacctttaaaatccagcccttcctcgccctgggatttttcctccggaagctgacgtccagagaaaatcttctgctcggcgtggggctggccatggctacaaccctgcaacttcccgaggatatcgaacagatggccaacggaattgctctgggcctcatggccctgaagctcatcacacagtttgagacctaccagctgtggaccgcgcttacaagcctgatgtgttccaatacgattttcaccctcacagtggcctggcgcaccgctacactgatcctggccggcatttctcttctgcctgtctgccaaagctcctctatgcggaaaaccgactggctcccgatgacggttgctgccatgggggtgccccctctgcccctctttatcttcagcctgaaggatacacttaaaagacgctcctggcctctgaacgagggagtgatggccgtcggcctggtgtctatcctcgctagctccctgcttagaaatgacgttcccatggcggggcctctggtggccggaggcctcctgattgcttgttatgtcatcaccgggaccagcgccgatctcacagtggaaaaggccgctgacgttacctgggaggaagaggccgaacagacaggagtgtctcacaacctgatgattacggtcgacgatgacggcaccatgcggatcaaagatgacgagacagagaacattcttaccgtgctgctgaagacagcgctcctgatcgtctccggcatctttccctacagcattccggctacccttctggtgtggcatacgtggcagaaacagacccaacgctctggggttctctgggatgtgcctagcccgcctgaaacacagaaggccgagctggaagagggagtctacagaatcaagcagcagggcattttcgggaaaacccaagtgggagttggcgtgcagaaggagggggtctttcacacaatgtggcatgtgacccggggagccgtgctcacacacaatggcaaacgcctggaacccaactgggctagcgttaagaaagaccttatctcttatggcgggggatggagactgtccgcccagtggcaaaagggcgaggaagtccaggtgattgcggtggagccggggaagaatcctaaaaacttccagacgatgcccggaatcttccagaccacaaccggcgaaattggggctatcgccctggattttaagcctggaaccagcggctcccccatcattaatcgggagggcaaagtcgtggggctctacggaaacggcgttgtgacaaagagcgggggatatgtctctggcatcgcccaaacgaatgctgagcccgacgggcctaccccggaactggaggaagagatgttcaaaaagcgcaaccttacaattatggatctgcaccccggcagcggaaagaccagaaaatacctccctgccatcgtgcgggaagctattaagcgcagactgcggacactcatcctggcccccaccagagttgtggcggccgagatggaggaagctcttaaaggcctgcctatccgctatcagacgacagccaccaagtccgagcataccgggaaagaaattgtcgacctgatgtgccacgctacatttaccatgcggctcctgtctcccgtgagagttcctaattacaaccttatcattatggatgaggcccatttcacagacccggccagcatcgctgcgcgcggatatatttccacccgggtgggcatgggggaagccgctgccatctttatgacggccacaccccctggaaccgctgatgccttcccccagtctaatgcgcctatccaggacgaggagagagacattcccgaacgcagctggaactccggcaatgattggatcacagactttgctgggaagaccgtctggttcgtgccgtctattaaggccggcaacgatatcgccaattgtctgcggaaaaacggaaagaaagtgattcaactcagcagaaagacgtttgacaccgagtaccagaaaacaaagctgaacgattgggacttcgtcgttaccacagatatctccgaaatgggcgctaattttaaggccgaccgcgtgattgatcctcggagatgcctgaaacccgtgatcctcaccgacgggcccgagcgggtcatccttgcgggacctatgcccgtgacagttgccagcgctgcccagcgcagaggccgggtggggcgcaaccctcagaaggagaatgatcaatacattttcaccggacagccgctgaacaatgacgaagaccacgctcattggacggaggccaaaatgctgctcgataacatcaatacacccgaaggcattatccctgctctgttcgagcccgaaagagagaagtctgccgcgattgacggggagtatcggcttaaaggcgaatccagaaagacctttgtcgagctgatgcgccggggagatctccctgtgtggctggcccacaaagttgctagcgaaggcatcaagtacaccgacagaaagtggtgcttcgatggggagcgcaacaatcagatcctggaagagaacatggacgtggagatttggacaaaagaaggagagaagaaaaagctccggcccagatggcttgatgcccgcacctattctgacccgctggctctgaaagaatttaaggatttcgccgccggccggaagtccatcgcttttgacctcgtcacagagattgggagagtgcctagccacctggcgcatcgcacgagaaatgcccttgataacctggtcatgctccacacctccgaacatggaggccgggcttaccgccacgccgtggaggagctgcccgaaacaatggagaccctgctccttctgggcctgatgatcctcctgacagggggagccatgcttttcctgatttctggcaaagggatcggaaagaccagcatcggcctcatttgtgttgtggcttccagcgggatgctgtggatggccgacatccctctgcagtggattgcgtctgccatcgtgctcgaatttttcatgatggtccttctgattcccgagcctgagaaacaaagaacgccccaggataatcagctggcttatgttgtgatcggcattctcaccctggccgctatcgtggccgcgaacgaaatgggccttctggagacaaccaagcgggacctcggcatgtccaaagaaccgggggtcgtgagccctacatcttacctggacgttgatctgcaccccgccagcgcttggaccctctatgccgtggctacgacagtcatcacccccatgcttcgccatacaattgaaaattccaccgccaacgtgtctctggctgccatcgcgaatcaagccgtcgtgctgatgggactcgacaagggctggcctattagcaagatggatctgggggttccgcttctggctctcggatgctactcccaggtgaaccccctgaccctgacagccgctgtcctccttctggtgacgcactacgccatcattggccctgggctgcaggccaaagcgaccagagaagctcagaagcggacagccgctggaatcatgaaaaaccccaccgttgacggcatcatgacaattgatctcgaccctgtgatctatgattctaagtttgagaaacaactgggccaggtcatgcttctggtgctctgtgccgtgcagctgctgctcatgagaaccagctgggccttctgcgaggctcttacgctggccacagggcccattaccaccctgtgggaaggatcccctggcaagttttggaatacaaccatcgcggttagcatggccaacattttccgcgggtcttacctcgctggagccggcctggctttttccatcatgaagtccgtcgggacaggaaaacggggcacgggctcccagggggagacccttggagaaaagtggaaaaagaaactgaatcaactctctagaaaggagttcgacctgtataaaaagagcggcatcacagaagtggatcgcaccgaggccaaggaggggctgaaacggggagaaattacacatcacgcggtgtccagaggctctgccaagctccagtggttcgtcgagcggaacatggttatcccggaagggcgcgtgattgaccttggatgtggcagaggcgggtggagctactattgcgctggactgaaaaaggtgaccgaggtccggggctacacgaaagggggacccggccatgaggaacctgtgcccatgtccacctatgggtggaatatcgttaagctgatgagcggaaaggatgtgttttacctccctcccgagaaatgtgacacactgctttgcgatattggcgaatcttccccgagccctaccgtcgaggaatctcgcacaatcagagtgctgaagatggttgagccctggctcaaaaacaatcagttctgtattaaggtgctgaacccctacatgcctaccgtcatcgagcacctggaacggctccagcgcaaacacggcgggatgcttgtgagaaatcccctgtcccggaacagcacacatgagatgtattggatctctaatggaaccggcaacattgtgagctccgtcaatatggtttctcgcctgctcctgaacagatttacgatgacataccggagacctaccatcgaaaaggacgtggaccttggggccggaacccgccacgtgaatgctgagccggaaacacccaacatggatgtcattggcgagcggatcagacgcattaaggaggaacatagctccacgtggcactatgacgatgagaacccttacaaaacctgggcctatcacgggagctacgaagtgaaggctacaggatccgcctctagcatgatcaatggcgttgtgaaactgctcaccaagccctgggacgtcgtgcctacagttacccaaatggcgatgacagataccacgcccttcggccagcagcgggtgtttaaagagaaggtcgacaccagaacaccgaagcctatgcccgggacccgcaaagtgatggaaatcacagccgagtggctgtggcggaccctgggaagaaacaagcgccctcggctctgcacgagagaggagttcaccaaaaaggttcgcaccaatgctgccatgggcgctgtgtttacagaggaaaaccaatgggattccgcccgggccgcggtcgaggacgaagagttctggaaactggtggatagagagcgcgaacttcataagctggggaaatgtggatcttgcgtctataatatgatgggcaagagagagaagaaactcggggaatttggcaaggctaaaggaagccgggccatttggtacatgtggctgggcgcccgctaccttgagttcgaggctctggggtttctcaacgaagaccactggttctccagagaaaattcttatagcggagtggaaggcgaggggctgcataagctgggatacatcctccgggatatttccaaaatccccggcggggccatgtatgctgacgacaccgccggctgggatacgagaattaccgaagacgatctgcacaacgaggagaagatcacacagcagatggaccctgaacatcggcagcttgcgaatgccatctttaagctgacctaccaaaacaaagttgtgaaggtccagcgccccacaccgaaaggaaccgtgatggatattatcagcagaaaggaccagcggggctctggacaggtgggaacatatggcctcaataccttcacgaacatggaggctcaactgattcgccagatggaaggggagggagttctttccaaaacagatctggaaaatcctcacctcctggagaagagaatcacccagtggctggagaccaagggcgtggaacggctcaaacgcatggccattagcggggacgattgcgtcgtgaagcccatcgacgatagattcgctaacgccctgcttgcgctgaatgacatgggcaaagttcggaaggatatcccccagtggcaaccttctaaaggatggcacgactggcaacaggtgccgttttgttcccatcacttccatgagctcattatgaaggacggccgcaagctggtcgtgccctgcagacctcaggatgaacttatcgggcgggcccgcattagccaaggagctggctggtctctgaaagagacagcctgtctcgggaaggcttacgcccagatgtgggctctgatgtattttcacagacgggacctgcgcctcgcctccaacgcgatctgcagcgccgtccccgtgcactgggttcctacctccagaacaacgtggagcattcatgctcaccatcagtggatgaccacagaagatatgctgaccgtgtggaaccgggtctggatcgaggacaatccctggatggaggataaaacacctgtgaccacgtgggaagacgttccctaccttggaaagagagaggatcaatggtgtggctctctgattgggctcaccagccgcgccacatgggcccagaacatcctgaccgctatccaacaggtgcggtcccttattggcaatgaagagttcctggactacatgccgtctatgaaaagatttcgcaaggaggaagagagcgaaggagccatctggtga

SEQ ID NO: 20353 - RNA, 9873 nt, synthetic construct
  misc_feature 1..9873: note = derived and/or modified CDS sequence (opt5) from DENV-3__AB214880__SS-prME
  source 1..9873: mol_type = other RNA
accagcctgtgcctcatgatgatgctgcccgccacccttgctttccacctgacgtcccgggacggcgagcctcggatgatcgtggggaagaacgagcgcgggaaatctctcctgtttaagaccgccagcggcattaatatgtgtacccttatcgcgatggatctgggggagatgtgcgacgataccgttacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggagacaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagttgtgcagcacgaaaatctcaagtataccgtcattatcacagtgcatacgggggaccagcaccaggttggaaacgagacccaaggcgtgacagccgaaatcacaccccaggcttccacagtcgaggccgtgctgcctgaatacggcaccctggggctcgagtgcagcccccgcacgggactggactttaatgagatgattcttctgaccatgaaaaacaaggcttggatggtccatagacagtggttctttgatctccctctgccctggacatctggcgccaccacagaaaccccgacgtggaataaaaaggagcttctggtgacattcaaaaacgcccacgctaagaagcaagaagttgtggtcctcgggtcccaggagggagcgatgcacaccgccctgacaggcgctaccgaaatccagaccagcgggggcacatctatttttgccggacatctgaaatgtcggctcaagatggacaaactggagcttaagggcatgtcctatgccatgtgcagcaatgctttcgtgctgaaaaaggaggtttccgaaacgcagcacgggaccatcctcattaaggtggagtacaaaggagaagatgccccttgtaagatccccttctctacagaggacggccaagggaaagcgcataacggacgcctgatcaccgctaaccctgtcgtgacaaagaaagaggaacccgtgaatattgaggccgaacccccttttggcgagagcaacatcattatcgggattggcgataaggccctgaagatcaattggtacaaaaagggatccagcatcggcaaaatgttcgaagctaccgccagaggggctcggagaatggccattcttggagacacggcgtgggattttggctctgttgggggagtcctcaactccctgggcaagatggtgcaccagatcttcgggagcgcctatacagctctgttttctggcgtgagctggattatgaaaatcggaattggcgtcctcctgacctggatcgggcttaattccaagaacacctctatgagcttctcctgcattgtgatcggaatcattacactgtacctcggcgccgttgtgcaggctgacatggggtgtgtcatcaattggaagggaaaagagctgaagtgcggcagcgggatttttgtgaccaacgaggttcatacatggacggaacagtataaattccaagccgattctccgaagcgcctggcgaccgccatcgctggcgcctgggagaatggagtgtgtggcattcggtccacaaccagaatggaaaaccttctctggaaacagatcgctaatgagctgaactacatcctgtgggaaaataacattaagctcacagtcgtggttggggacatcattggagtgctggagcagggcaaacgcacccttacgccccagcctatggagctgaagtatagctggaagacctgggggaaagccaagatcgtcacagccgaaacccaaaattcttcctttattatcgatggacccaacacacctgagtgccccagcgcttcccgggcgtggaacgtgtgggaagtggaggactacggcttcggcgtctttaccacaaatatctggctcaaactgagagaaatgtatacccagctgtgtgaccaccgccttatgtctgccgctgttaaggatgagcgggccgtgcacgccgacatggggtactggattgagagccagaaaaacggatcctggaagctcgaaaaggcttctctgatcgaggtgaaaacgtgcacatggcccaagagccataccctgtggtccaatggcgtcctcgaaagcgatatgattatccctaaatctctggccgggcccatttcccagcacaactacagacctggatatcatacccaaacagcgggcccctggcaccttgggaagctggagctcgacttcaattactgcgagggaaccacggtggttatcacagaaaactgtggcacccgcggccctagcctgcggacaaccacagtgtctgggaaactgatccacgagtggtgctgtagatcctgcacccttcccccgctccgctatatgggagaagatggctgttggtacgggatggagattcggcctatcaatgaaaaggaggagaacatggtcaagagcctggtgtctgctggaagcggcaaagttgacaattttacgatgggggtgctgtgcctcgccattctgttcgaagaggtcatgagaggaaagttcggcaaaaagcatatgatcgccggcgtgctttttaccttcgttctgctcctgtccgggcagattacatggcgggatatggctcgcaccctgatcatgattggaagcaacgcctctgacagaatgggcatgggggtgacatatcttgcgctgatcgctacctttaaaatccagcccttcctcgccctgggatttttcctccggaagctgacgtccagagaaaatcttctgctcggcgtcgggctggccatggctacaaccctgcaacttcccgaggatattgaacagatggccaacggaatcgctctgggcctcatggccctgaagctcattacacagtttgagacctaccagctgtggaccgcgcttgccagcctgatgtgttccaatacaatcttcacgctcaccgtggcttggcgcacagccaccctgattctggctggcatctctcttctgcctgtgtgccaaagctcctctatgcggaaaacagactggctcccgatgaccgtcgccgccatgggggttccccctctgcccctctttatcttcagcctgaaggatacgcttaaaagacgctcctggcctctgaacgagggagtgatggctgtgggcctggtctctattctcgcgagctccctgcttagaaatgacgtgcccatggccgggcctctggttgctggaggcctcctgatcgcctgttatgtgattacagggaccagcgccgatctcaccgtcgaaaaggctgccgacgtgacatgggaggaagaggcggaacagaccggagtttctcacaacctgatgatcacagtggacgatgacggcacgatgcggattaaagatgacgagaccgagaacatccttacagtcctgctgaagaccgctctcctgatcgtgtccggcatttttccctacagcatcccggccacacttctggtctggcatacctggcagaaacagacgcaacgctctggggtgctctgggatgttcctagcccgcctgaaacccagaaggccgagctggaagagggagtgtacagaattaagcagcagggcatcttcgggaaaacacaagtcggagtgggcgttcagaaggagggggtgtttcacaccatgtggcatgtcacacggggagctgtgctcacccacaatggcaaacgcctggaacccaactgggccagcgtgaagaaagaccttatttcttatggcgggggatggagactgtccgcgcagtggcaaaagggcgaggaagttcaggtcatcgctgtggagccggggaagaatcctaaaaacttccagacaatgcccggaattttccagacgaccacaggcgaaatcggggccatcgccctggattttaagcctggaaccagcggctcccccattatcaatcgggagggcaaagtggtcgggctctacggaaacggcgtggttaccaagagcgggggatatgtgtctggcattgctcaaacaaatgccgagcccgacgggcctacgccggaactggaggaagagatgttcaaaaagcgcaaccttaccatcatggatctgcaccccggcagcggaaagacaagaaaatacctccctgctattgtccgggaagccatcaagcgcagactgcggaccctcatcctggcgcccacaagagtggttgccgctgagatggaggaagcccttaaaggcctgcctattcgctatcagaccacggctacaaagtccgagcataccgggaaagaaatcgtggacctgatgtgccacgccacctttacaatgcggctcctgtctcccgtcagagtgcctaattacaaccttattatcatggatgaggcccatttcaccgacccggctagcattgcggcccgcggatatatctccacacgggttggcatgggggaagctgccgccatctttatgaccgctacgccccctggaacagccgatgcgttcccccagtctaatgctcctattcaggacgaggagagagacatccccgaacgcagctggaactccggcaatgattggattaccgactttgccgggaagacagtgtggttcgtcccgtctatcaaggccggcaacgatattgctaattgtctgcggaaaaacggaaagaaagtgatccaactcagcagaaagacctttgacacggagtaccagaaaaccaagctgaacgattgggacttcgtggtcacaaccgatatttccgaaatgggcgccaattttaaggcggaccgcgttatcgatcctcggagatgcctgaaacccgtgatcctcacagacgggcccgagcgggtgattcttgccggacctatgcccgtcaccgtggctagcgccgctcagcgcagaggccgggttgggcgcaaccctcagaaggagaatgatcaatacatcttcacaggacagccgctgaacaatgacgaagaccacgcccattggaccgaggctaaaatgctgctcgataacattaatacgcccgaaggcatcattcctgccctgttcgagcccgaaagagagaagtctgcggccatcgacggggagtatcggcttaaaggcgaatccagaaagacatttgtggagctgatgcgccggggagatctccctgtctggctggctcacaaagtggccagcgaaggcatcaagtacaccgacagaaagtggtgcttcgatggggagcgcaacaatcagattctggaagagaacatggacgttgagatctggaccaaagaaggagagaagaaaaagctccggcccagatggcttgatgctcgcacatattctgacccgctggccctgaaagaatttaaggatttcgccgctggccggaagtccattgcgtttgacctcgtgaccgagatcgggagagtccctagccacctggcccatcgcacaagaaatgctcttgataacctggtgatgctccacacgtccgaacatggaggccgggcctaccgccacgccgtcgaggagctgcccgaaaccatggagacactgctccttctgggcctgatgattctcctgaccgggggagctatgcttttcctgatctctggcaaagggatcggaaagacaagcattggcctcatctgtgtggttgcctccagcgggatgctgtggatggcggacattcctctgcagtggatcgcctctgctattgtgctcgaatttttcatgatggtgcttctgatccccgagcctgagaaacaaagaacaccccaggataatcagctggcctatgtcgttattggaatcctcacgctggctgccatcgtggcggccaacgaaatgggccttctggagaccacaaagcgggacctcggcatgtccaaagaaccgggggtggtcagccctacctcttacctggacgtggatctgcaccccgctagcgcctggacactctatgctgttgccaccacggtgattacacccatgcttcgccataccatcgaaaattccacagctaacgtctctctggccgcgattgccaatcaagctgtggtcctgatgggactcgacaagggctggcctatcagcaagatggatctgggggtgccgcttctggccctcggatgctactcccaggttaaccccctgaccctgaccgctgccgtgctccttctggtcacacactacgccattatcggccctgggctgcaggcgaaagctacgagagaagcccagaagcggaccgctgccggaatcatgaaaaaccccacagtggacggcattatgaccatcgatctcgaccctgttatttatgattctaagtttgagaaacaactgggccaggtgatgcttctggtcctctgtgccgtgcagctgctgctcatgagaacaagctgggctttctgcgaggcccttaccctggcgacggggcccatcacaaccctgtgggaaggatcccctggcaagttttggaataccacaattgccgtgagcatggctaacatcttccgcgggtcttacctcgccggagctggcctggccttttccatcatgaagtccgttgggaccggaaaacggggcacaggctcccagggggagacgcttggagaaaagtggaaaaagaaactgaatcaactctctagaaaggagttcgacctgtataaaaagagcggcattaccgaagtcgatcgcacagaggcgaaggaggggctgaaacggggagaaatcacccatcacgccgtgtccagaggctctgctaagctccagtggttcgtggagcggaacatggtcattccggaagggcgcgttatcgaccttggatgtggcagaggcgggtggagctactattgcgccggactgaaaaaggtgacagaggtgcggggctacaccaaagggggacccggccatgaggaacctgtccccatgtccacgtatgggtggaatattgtgaagctgatgagcggaaaggatgtcttttacctccctcccgagaaatgtgacaccctgctttgcgatatcggcgaatcttccccgagccctacagtggaggaatctcgcaccattagagtcctgaagatggtggagccctggctcaaaaacaatcagttctgtatcaaggttctgaacccctacatgcctacagtgatcgagcacctggaacggctccagcgcaaacacggcgggatgcttgtcagaaatcccctgtcccggaacagcacccatgagatgtattggatttctaatggaacaggcaacatcgtgagctccgtgaatatggtctctcgcctgctcctgaacagatttaccatgacgtaccggagacctacaattgaaaaggacgttgaccttggggctggaacccgccacgtgaatgccgagccggaaacccccaacatggatgtgatcggcgagcggattagacgcatcaaggaggaacatagctccacatggcactatgacgatgagaacccttacaaaacgtgggcttatcacgggagctacgaagtcaaggccaccggatccgcgtctagcatgatcaatggcgtggttaaactgctcacaaagccctgggacgtggtccctaccgtgacacaaatggccatgaccgatacaacccccttcggccagcagcgggtttttaaagagaaggtggacacgagaaccccgaagcctatgcccgggacacgcaaagtcatggaaattaccgctgagtggctgtggcggacactgggaagaaacaagcgccctcggctctgcaccagagaggagttcacgaaaaaggtgcgcacaaatgccgctatgggcgccgtttttaccgaggaaaaccaatgggattccgcccgggcggctgtggaggacgaagagttctggaaactggtcgatagagagcgcgaacttcataagctggggaaatgtggatcttgcgtgtataatatgatgggcaagagagagaagaaactcggggaatttggcaaggccaaaggaagccgggccatctggtacatgtggctgggcgctcgctaccttgagttcgaggccctggggtttctcaacgaagaccactggttctccagagaaaattcttatagcggagtcgaaggcgaggggctgcataagctgggatacattctccgggatatctccaaaattcccggcggggctatgtatgccgacgacacagcgggctgggataccagaatcacggaagacgatctgcacaacgaggagaagatcacccagcagatggaccctgaacatcggcagcttgccaatgctatttttaagctgacataccaaaacaaagtggttaaggtgcagcgccccaccccgaaaggaacagtcatggatatcattagcagaaaggaccagcggggctctggacaggtgggaacctatggcctcaatacattcaccaacatggaggcccaactgatccgccagatggaaggggagggagtgctttccaaaacggatctggaaaatcctcacctcctggagaagagaattacacagtggctggagaccaagggcgttgaacggctcaaacgcatggctatcagcggggacgattgcgtggtcaagcccatcgacgatagattcgccaacgcgctgcttgccctgaatgacatgggcaaagtgcggaaggatattccccagtggcaaccttctaaaggatggcacgactggcagcaggttccgttttgttcccatcacttccatgagctcatcatgaaggacggccgcaagctggtggtcccctgcagacctcaggatgaacttattgggcgggctcgcatcagccaaggagccggctggtctctgaaagagaccgcttgtctcgggaaggcctacgctcagatgtgggccctgatgtattttcacagacgggacctgcgcctcgcgtccaacgccatttgcagcgctgtgcccgtccactgggtgcctacatccagaaccacatggagcatccatgcccaccatcagtggatgacgaccgaagatatgctgacagtttggaaccgggtgtggattgaggacaatccctggatggaggataaaacccctgtcacaacctgggaagacgtgccctaccttggaaagagagaggatcaatggtgtggctctctgatcgggctcacgagccgcgccacctgggctcagaacatcctgacagccattcagcaggttcggtcccttatcggcaatgaagagttcctggactacatgccgtctatgaaaagatttcgcaaggaggaagagagcgaaggagcgatttggtga

SEQ ID NO: 20354 - RNA, 9873 nt, synthetic construct
  misc_feature 1..9873: note = derived and/or modified CDS sequence (opt5) from DENV-3__AB214881__SS-prME
  source 1..9873: mol_type = other RNA
accagcctgtgcctcatgatgatgctgcccgccacccttgctttccacctgacgtccagagacggcgagcctcggatgatcgtggggaagaacgaacgcggaaaatctctcctgtttaagaccgccagcggcattaatatgtgtacccttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccagacatggatgagcgctgagggcgcctggcggcaggtcgaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagttgtgcagcacgaaaatctcaagtataccgtcattatcacagtgcatacgggggaccagcaccaggttggaaacgagacccaaggcgtgacagccgaaatcacaccccaggcttccacagtcgaggccgtgctgcctgaatacggcaccctggggctcgagtgcagcccccgcacgggactggactttaatgagatgattcttctgaccatgaaaaacaaggcttggatggtccatagacagtggttctttgatctccctctgccctggacatctggcgccaccacagaaaccccgacgtggaataaaaaggagcttctggtgacattcaaaaacgcccacgctaagaagcaagaagttgtggtcctcgggtcccaggagggagcgatgcacaccgccctgacaggcgctaccgaaatccagaccagcgggggcacatctatttttgccggacatctgaaatgtcggctcaagatggacaaactggagcttaagggcatgtcctatgccatgtgcagcaatgctttcgtgctgaaaaaggaggtttccgaaacgcagcacgggaccatcctcattaaggtggagtacaaaggagaagatgccccttgtaagatccccttctctacagaggacggccaagggaaagcgcataacggacgcctgatcaccgctaaccctgtcgtgacaaagaaagaggaacccgtgaatattgaggccgaacccccttttggcgagagcaacatcattatcgggattggcgataaggccctgaagatcaattggtacaaaaagggatccagcatcggcaaaatgttcgaagctaccgccagaggggctcggagaatggccattcttggagacacggcgtgggattttggctctgttgggggagtcctcaactccctgggcaagatggtgcaccagatcttcgggagcgcctatacagctctgttttctggcgtgagctggattatgaaaatcggaattggcgtcctcctgacctggatcgggcttaattccaagaacacctctatgagcttctcctgcattgtgatcggaatcattacactgtacctcggcgccgttgtgcaggctgacatggggtgtgtcatcaattggaagggaaaagagctgaagtgcggcagcgggatttttgtgaccaacgaggttcatacatggacggaacagtataaattccaagccgattctccgaagcgcctggcgaccgccatcgctggcgcctgggagaatggagtgtgtggcattcggtccacaaccagaatggaaaaccttctctggaaacagatcgctaatgagctgaactacatcctgtgggaaaataacattaagctcacagtcgtggttggggacatcattggaatcctggagcagggcaaacgcacccttacgccccagcctatggagctgaagtatagctggaagacctgggggaaagccaagattgtgacagccgaaacccaaaattcttcctttatcatcgatggacccaacacacctgagtgccccagcgcttcccgggcgtggaacgtctgggaagtggaggactacggcttcggcgtgtttaccacaaatatttggctcaaactgagagaaatgtatacccagctgtgtgaccaccgccttatgtctgccgctgtcaaggatgagcgggccgttcacgccgacatggggtactggatcgagagccagaaaaacggatcctggaagctcgaaaaggcttctctgattgaggtgaaaacgtgcacatggcccaagagccataccctgtggtccaatggcgtgctcgaaagcgatatgatcattcctaaatctctggccgggcccatctcccagcacaactacagacctggatatcatacccaaacagcgggcccctggcaccttgggaagctggagctcgacttcaattactgcgagggaaccacggtcgtgatcacagaaaactgtggcacccgcggccctagcctgcggacaaccacagtttctgggaaactgattcacgagtggtgctgtagatcctgcacccttcccccgctccgctatatgggagaagatggctgttggtacgggatggagatccggcctattaatgaaaaggaggagaacatggtcaagagcctggtctctgctggaagcggcaaagtggacaattttacgatgggggttctgtgcctcgccatcctgttcgaagaggtgatgagaggaaagttcggcaaaaagcatatgattgccggcgtcctttttaccttcgtgctgctcctgtccgggcagatcacatggcgggatatggctcgcaccctgattatgatcggaagcaacgcctctgacagaatgggcatgggggttacatatcttgcgctgatcgctacctttaaaattcagcccttcctcgccctgggatttttcctccggaagctgacgtccagagaaaatcttctgctcggcgtggggctggccatggctacaaccctgcaacttcccgaggatatcgaacagatggccaacggaattgctctgggcctcatggccctgaagctcatcacacagtttgagacctaccagctgtggaccgcgcttgccagcctgatgtgttccaatacaattttcacgctcaccgtcgcttggcgcacagccaccctgatcctggctggcatctctcttctgcctgtgtgccaaagctcctctatgcggaaaacagactggctcccgatgaccgtggccgccatgggggtgccccctctgcccctctttattttcagcctgaaggatacgcttaaaagacgctcctggcctctgaacgagggagttatggctgtgggcctggtgtctatcctcgcgagctccctgcttagaaatgacgtccccatggccgggcctctggtggctggaggcctcctgattgcctgttatgttatcacagggaccagcgccgatctcaccgtggaaaaggctgccgacgtcacatgggaggaagaggcggaacagaccggagtgtctcacaacctgatgattacagttgacgatgacggcacgatgcggatcaaagatgacgagaccgagaacatccttacagtgctgctgaagaccgctctcctgattgtctccggcatctttccctacagcattccggccacacttctggtgtggcatacctggcagaaacagacgcaacgctctggggtcctctgggatgtgcctagcccgcctgaaacccagaaggccgagctggaagagggagtttacagaatcaagcagcagggcattttcgggaaaacacaagtgggagtcggcgtgcagaaggagggggtttttcacaccatgtggcatgtgacacggggagctgtcctcacccacaatggcaaacgcctggaacccaactgggccagcgtgaagaaagaccttatctcttatggcgggggatggagactgtccgcgcagtggcaaaagggcgaggaagtgcaggttattgctgtcgagccggggaagaatcctaaaaacttccagacaatgcccggaatcttccagacgaccacaggcgaaatcggggccattgccctggattttaagcctggaaccagcggctcccccatcattaatcgggagggcaaagtggtggggctctacggaaacggcgtcgtgaccaagagcgggggatatgtttctggcatcgctcaaacaaatgccgagcccgacgggcctacgccggaactggaggaagagatgttcaaaaagcgcaaccttaccattatggatctgcaccccggcagcggaaagacaagaaaatacctccctgctatcgtgcgggaagccatcaagcgcagactgcggaccctcattctggcgcccacaagagtcgtggccgctgagatggaggaagcccttaaaggcctgcctatccgctatcagaccacggctacaaagtccgagcataccgggaaagaaattgttgacctgatgtgccacgccacctttacaatgcggctcctgtctcccgtgagagtccctaattacaaccttatcattatggatgaggcccatttcaccgacccggctagcatcgcggcccgcggatatatctccacacgggtgggcatgggggaagctgccgccatttttatgaccgctacgccccctggaacagccgatgcgttcccccagtctaatgctcctatccaggacgaggagagagacattcccgaacgcagctggaactccggcaatgattggatcaccgactttgccgggaagacagtttggttcgtgccgtctattaaggccggcaacgatatcgctaattgtctgcggaaaaacggaaagaaagtcattcaactcagcagaaagacctttgacacggagtaccagaaaaccaagctgaacgattgggacttcgtggtgacaaccgatatctccgaaatgggcgccaattttaaggcggaccgcgtcatcgatcctcggagatgcctgaaacccgttattctcacagacgggcccgagcgggtgatccttgccggacctatgcccgtgaccgtcgctagcgccgctcagcgcagaggccgggtggggcgcaaccctcagaaggagaatgatcaatacattttcacaggacagccgctgaacaatgacgaagaccacgcccattggaccgaggctaaaatgctgctcgataacatcaatacgcccgaaggcattatccctgccctgttcgagcccgaaagagagaagtctgcggccatcgacggggagtatcggcttaaaggcgaatccagaaagacatttgttgagctgatgcgccggggagatctccctgtgtggctggctcacaaagtcgccagcgaaggcattaagtacaccgacagaaagtggtgcttcgatggggagcgcaacaatcagatcctggaagagaacatggacgtggagatttggaccaaagaaggagagaagaaaaagctccggcccagatggcttgatgctcgcacatattctgacccgctggccctgaaagaatttaaggatttcgccgctggccggaagtccatcgcgtttgacctcgttaccgagattgggagagtgcctagccacctggcccatcgcacaagaaatgctcttgataacctggtcatgctccacacgtccgaacatggaggccgggcctaccgccacgccgtggaggagctgcccgaaaccatggagacactgctccttctgggcctgatgatcctcctgaccgggggagctatgcttttcctgatctctggcaaagggattggaaagacaagcatcggcctcatttgtgtcgtggcctccagcgggatgctgtggatggcggacatccctctgcagtggattgcctctgctatcgttctcgaatttttcatgatggtgcttctgattcccgagcctgagaaacaaagaacaccccaggataatcagctggcctatgtggtcatcggaatcctcacgctggctgccattgttgcggccaacgaaatgggccttctggagaccacaaagcgggacctcggcatgtccaaagaaccgggggtggtgagccctacctcttacctggacgtcgatctgcaccccgctagcgcctggacactctatgctgtggccaccacggttatcacacccatgcttcgccataccattgaaaattccacagctaacgtgtctctggccgcgatcgccaatcaagctgtcgtgctgatgggactcgacaagggctggcctattagcaagatggatctgggggtcccgcttctggccctcggatgctactcccaggtgaaccccctgaccctgaccgctgccgttctccttctggtgacacactacgccatcatcggccctgggctgcaggcgaaagctacgagagaagcccagaagcggaccgctgccggaattatgaaaaaccccacagtcgacggcatcatgaccattgatctcgaccctgtgatctatgattctaagtttgagaaacaactgggccaggttatgcttctggtgctctgtgccgtccagctgctgctcatgagaacaagctgggctttctgcgaggcccttaccctggcgacggggcccattacaaccctgtgggaaggatcccctggcaagttttggaataccacaatcgccgtgagcatggctaacatcttccgcgggtcttacctcgccggagctggcctggccttttccattatgaagtccgtggggaccggaaaacggggcacaggctcccagggggagacgcttggagaaaagtggaaaaagaaactgaatcaactctctagaaaggagttcgacctgtataaaaagagcggcatcaccgaagttgatcgcacagaggcgaaggaggggctgaaacggggagaaattacccatcacgccgtctccagaggctctgctaagctccagtggttcgtggagcggaacatggtgatcccggaagggcgcgtcattgaccttggatgtggcagaggcgggtggagctactattgcgccggactgaaaaaggttacagaggtgcggggctacaccaaagggggacccggccatgaggaacctgtgcccatgtccacgtatgggtggaatatcgtcaagctgatgagcggaaaggatgtgttttacctccctcccgagaaatgtgacaccctgctttgcgatattggcgaatcttccccgagccctacagttgaggaatctcgcaccatcagagtgctgaagatggtcgagccctggctcaaaaacaatcagttctgtatcaaggtgctgaacccctacatgcctacagttattgagcacctggaacggctccagcgcaaacacggcgggatgcttgtgagaaatcccctgtcccggaacagcacccatgagatgtattggatctctaatggaacaggcaacattgtcagctccgtgaatatggtgtctcgcctgctcctgaacagatttaccatgacgtaccggagacctacaatcgaaaaggacgtcgaccttggggctggaacccgccacgttaatgccgagccggaaacccccaacatggatgtgattggcgagcggatcagacgcatcaaggaggaacatagctccacatggcactatgacgatgagaacccttacaaaacgtgggcttatcacgggagctacgaagtgaaggccaccggatccgcgtctagcatgattaatggcgtcgtgaaactgctcacaaagccctgggacgttgtgcctaccgtcacacaaatggccatgaccgatacaacccccttcggccagcagcgggtgtttaaagagaaggttgacacgagaaccccgaagcctatgcccgggacacgcaaagtgatggaaatcaccgctgagtggctgtggcggacactgggaagaaacaagcgccctcggctctgcaccagagaggagttcacgaaaaaggtccgcacaaatgccgctatgggcgccgtgtttaccgaggaaaaccaatgggattccgcccgggcggctgttgaggacgaagagttctggaaactggtggatagagagcgcgaacttcataagctggggaaatgtggatcttgcgtctataatatgatgggcaagagagagaagaaactcggggaatttggcaaggccaaaggaagccgggccatttggtacatgtggctgggcgctcgctaccttgagttcgaggccctggggtttctcaacgaagaccactggttctccagagaaaattcttatagcggagtggaaggcgaggggctgcataagctgggatacatcctccgggatatttccaaaatccccggcggggctatgtatgccgacgacacagcgggctgggataccagaatcacggaagacgatctgcacaacgaggagaagattacccagcagatggaccctgaacatcggcagcttgccaatgctatctttaagctgacataccaaaacaaagtcgtgaaggttcagcgccccaccccgaaaggaacagtgatggatattatcagcagaaaggaccagcggggctctgggcaggtcggaacctatggcctcaatacattcaccaacatggaggcccaactgattcgccagatggaaggggagggagtgctttccaaaacggatctggaaaatcctcacctcctggagaagagaatcacacagtggctggagaccaagggcgtggaacggctcaaacgcatggctatcagcggggacgattgcgttgtgaagcccattgacgatagattcgccaacgcgctgcttgccctgaatgacatgggcaaagtccggaaggatatcccccagtggcaaccttctaaaggatggcacgactggcaacaggtgccgttttgttcccatcacttccatgagctcattatgaaggacggccgcaagctggttgtgccctgcagacctcaggatgaacttatcgggcgggctcgcattagccaaggagccggctggtctctgaaagagaccgcttgtctcgggaaggcctacgctcagatgtgggccctgatgtattttcacagacgggacctgcgcctcgcgtccaacgccatctgcagcgctgtccccgtgcactgggtccctacatccagaaccacatggagcattcatgcccaccatcagtggatgacgaccgaagatatgctgacagtgtggaaccgggtttggatcgaggacaatccctggatggaggataaaacccctgtgacaacctgggaagacgtcccctaccttggaaagagagaggatcaatggtgtggctctctgatcgggctcacgagccgcgccacctgggctcagaacattctgacagccatccaacaggtgcggtcccttattggcaatgaagagttcctggactacatgccgtctatgaaaagatttcgcaaggaggaggagctcgaaggagcgatctggtga

SEQ ID NO: 20355 - RNA, 9873 nt, synthetic construct
  misc_feature 1..9873: note = derived and/or modified CDS sequence (opt5) from DENV-3__AB214882__SS-prME
  source 1..9873: mol_type = other RNA
accagcctgtgcctcatgatgatgctgcccgccacccttgctttccacctgacgtccagagacggagagcctcggatgatcgtggggaagaacgagcgcggaaaatctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccagacatggatgagcgctgagggcgcctggcggcaggtcgaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagttgtgcagcacgaaaatctcaagtataccgtcattatcacagtgcatacgggggaccagcaccaggttggaaacgagacccaaggcgtgacagccgaaatcacaccccaggcttccacagtcgaggccgtgctgcctgaatacggcaccctggggctcgagtgcagcccccgcacgggactggactttaatgagatgattcttctgaccatgaaaaacaaggcttggatggtccatagacagtggttctttgatctccctctgccctggacatctggcgccaccacagaaaccccgacgtggaataaaaaggagcttctggtgacattcaaaaacgcccacgctaagaagcaagaagttgtggtcctcgggtcccaggagggagcgatgcacaccgccctgacaggcgctaccgaaatccagaccagcgggggcacatctatttttgccggacatctgaaatgtcggctcaagatggacaaactggagcttaagggcatgtcctatgccatgtgcagcaatgctttcgtgctgaaaaaggaggtttccgaaacgcagcacgggaccatcctcattaaggtggagtacaaaggagaagatgccccttgtaagatccccttctctacagaggacggccaagggaaagcgcataacggacgcctgatcaccgctaaccctgtcgtgacaaagaaagaggaacccgtgaatattgaggccgaacccccttttggcgagagcaacatcattatcgggattggcgataaggccctgaagatcaattggtacaaaaagggatccagcatcggcaaaatgttcgaagctaccgccagaggggctcggagaatggccattcttggagacacggcgtgggattttggctctgttgggggagtcctcaactccctgggcaagatggtgcaccagatcttcgggagcgcctatacagctctgttttctggcgtgagctggattatgaaaatcggaattggcgtcctcctgacctggatcgggcttaattccaagaacacctctatgagcttctcctgcattgtgatcggaatcattacactgtacctcggcgccgttgtgcaggctgacatggggtgtgtcatcaattggaagggaaaagagctgaagtgcggcagcgggatttttgtgaccaacgaggttcatacatggacggaacagtataaattccaagccgattctccgaagcgcctggcgaccgccatcgctggcgcctgggagaatggagtgtgtggcattcggtccacaaccagaatggaaaaccttctctggaaacagatcgctaatgagctgaactacatcctgtgggaaaataacattaagctcacagtcgtggttggggacatcaccggcattctggagcagggcaaacgcacgcttacaccccagcctatggagctgaagtatagctggaagacatgggggaaagccaagatcgtgaccgccgaaacacaaaattcttcctttattatcgatggacccaacacccctgagtgccccagcgcttcccgggcgtggaacgtctgggaagtggaggactacggcttcggcgtgtttacaaccaatatctggctcaaactgagagaaatgtatacgcagctgtgtgaccaccgccttatgtctgccgctgtcaaggatgagcgggccgttcacgccgacatggggtactggattgagagccagaaaaacggatcctggaagctcgaaaaggcttctctgatcgaggtgaaaacatgcacctggcccaagagccataccctgtggtccaatggcgtgctcgaaagcgatatgattatccctaaatctctggccgggcccatttcccagcacaactacagacctggatatcatacacaaaccgcgggcccctggcaccttgggaagctggagctcgacttcaattactgcgagggaacgacagtcgtgatcaccgaaaactgtggcacacgcggccctagcctgcggaccacaaccgtttctgggaaactgatccacgagtggtgctgtagatcctgcacgcttcccccgctccgctatatgggagaagatggctgttggtacgggatggagattcggcctatcaatgaaaaggaggagaacatggtcaagagcctggtctctgctggaagcggcaaagtggacaattttaccatgggggttctgtgcctcgccattctgttcgaagaggtgatgagaggaaagttcggcaaaaagcatatgatcgccggcgtcctttttacattcgtgctgctcctgtccgggcagattacctggcgggatatggctcgcacactgatcatgattggaagcaacgcctctgacagaatgggcatgggggttacctatcttgcgctgatcgctacgtttaaaatccagcccttcctcgccctgggatttttcctccggaagctgacatccagagaaaatcttctgctcggcgtggggctggccatggctaccacactgcaacttcccgaggatattgaacagatggccaacggaatcgctctgggcctcatggccctgaagctcattacccagtttgagacctaccagctgtggacagcgcttgccagcctgatgtgttccaatacgatcttcaccctcacagtcgcttggcgcaccgccacactgattctggctggcatctctcttctgcctgtgtgccaaagctcctctatgcggaaaaccgactggctcccgatgacggtggccgccatgggggtgccccctctgcccctctttatcttcagcctgaaggatacacttaaaagacgctcctggcctctgaacgagggagttatggctgtgggcctggtgtctattctcgcgagctccctgcttagaaatgacgtccccatggccgggcctctggtggctggaggcctcctgatcgcctgttatgttattaccgggaccagcgccgatctcacagtggaaaaggctgccgacgtcacctgggaggaagaggcggaacagacaggagtgtctcacaacctgatgatcacggttgacgatgacggcaccatgcggattaaagatgacgagacagagaacatccttaccgtgctgctgaagacagctctcctgatcgtctccggcatttttccctacagcatcccggccacccttctggtgtggcatacgtggcagaaacagacccaacgctctggggtcctctgggatgtgcctagcccgcctgaaacacagaaggccgagctggaagagggagtttacagaattaagcagcagggcatcttcgggaaaacccaagtgggagtcggcgtgcagaaggagggggtttttcacacaatgtggcatgtgacccggggagctgtcctcacacacaatggcaaacgcctggaacccaactgggccagcgtgaagaaagaccttatttcttatggcgggggatggagactgtccgcgcagtggcaaaagggcgaggaagtgcaggttatcgctgtcgagccggggaagaatcctaaaaacttccagacgatgcccggaattttccagaccacaaccggcgaaatcggggccatcgccctggattttaagcctggaaccagcggctcccccattatcaatcgggagggcaaagtggtggggctctacggaaacggcgtcgtgacaaagagcgggggatatgtttctggcattgctcaaacgaatgccgagcccgacgggcctaccccggaactggaggaagagatgttcaaaaagcgcaaccttacaatcatggatctgcaccccggcagcggaaagaccagaaaatacctccctgctattgtgcgggaagccatcaagcgcagactgcggacactcatcctggcgcccaccagagtcgtggccgctgagatggaggaagcccttaaaggcctgcctattcgctatcagacgacagctaccaagtccgagcataccgggaaagaaatcgttgacctgatgtgccacgccacatttaccatgcggctcctgtctcccgtgagagtccctaattacaaccttattatcatggatgaggcccatttcacagacccggctagcattgcggcccgcggatatatctccacccgggtgggcatgggggaagctgccgccatctttatgacggctacaccccctggaaccgccgatgcgttcccccagtctaatgctcctattcaggacgaggagagagacatccccgaacgcagctggaactccggcaatgattggattacagactttgccgggaagaccgtttggttcgtgccgtctatcaaggccggcaacgatattgctaattgtctgcggaaaaacggaaagaaagtcatccaactcagcagaaagacgtttgacaccgagtaccagaaaacaaagctgaacgattgggacttcgtggtgaccacagatatttccgaaatgggcgccaattttaaggcggaccgcgtcatcgatcctcggagatgcctgaaacccgttatcctcaccgacgggcccgagcgggtgattcttgccggacctatgcccgtgacagtcgctagcgccgctcagcgcagaggccgggtggggcgcaaccctcagaaggagaatgatcaatacatcttcaccggacagccgctgaacaatgacgaagaccacgcccattggacggaggctaaaatgctgctcgataacattaatacacccgaaggcatcattcctgccctgttcgagcccgaaagagagaagtctgcggccatcgacggggagtatcggcttaaaggcgaatccagaaagacctttgttgagctgatgcgccggggagatctccctgtgtggctggctcacaaagtcgccagcgaaggcatcaagtacaccgacagaaagtggtgcttcgatggggagcgcaacaatcagattctggaagagaacatggacgtggagatctggacaaaagaaggagagaagaaaaagctccggcccagatggcttgatgctcgcacctattctgacccgctggccctgaaagaatttaaggatttcgccgctggccggaagtccattgcgtttgacctcgttacagagatcgggagagtgcctagccacctggcccatcgcacgagaaatgctcttgataacctggtcatgctccacacctccgaacatggaggccgggcctaccgccacgccgtggaggagctgcccgaaacaatggagaccctgctccttctgggcctgatgattctcctgacagggggagctatgcttttcctgatctctggcaaagggatcggaaagaccagcattggcctcatctgtgtcgtggcctccagcgggatgctgtggatggcggacattcctctgcagtggatcgcctctgctattgttctcgaatttttcatgatggtgcttctgatccccgagcctgagaaacaaagaacgccccaggataatcagctggcctatgtggtcattggaatcctcaccctggctgccatcgttgcggccaacgaaatgggccttctggagacaaccaagcgggacctcggcatgtccaaagaaccgggggtggtgagccctacatcttacctggacgtcgatctgcaccccgctagcgcctggaccctctatgctgtggccacgacagttattacccccatgcttcgccatacaatcgaaaattccaccgctaacgtgtctctggccgcgattgccaatcaagctgtcgtgctgatgggactcgacaagggctggcctatcagcaagatggatctgggggtcccgcttctggccctcggatgctactcccaggtgaaccccctgaccctgacagctgccgttctccttctggtgacgcactacgccattatcggccctgggctgcaggcgaaagctaccagagaagcccagaagcggacagctgccggaatcatgaaaaaccccaccgtcgacggcattatgacaatcgatctcgaccctgtgatttatgattctaagtttgagaaacaactgggccaggttatgcttctggtgctctgtgccgtccagctgctgctcatgagaaccagctgggctttctgcgaggcccttacgctggcgacagggcccatcaccaccctgtgggaaggatcccctggcaagttttggaatacaaccattgccgtgagcatggctaacatcttccgcgggtcttacctcgccggagctggcctggccttttccatcatgaagtccgtggggacaggaaaacggggcacgggctcccagggggagacccttggagaaaagtggaaaaagaaactgaatcaactctctagaaaggagttcgacctgtataaaaagagcggcattacagaagttgatcgcaccgaggcgaaggaggggctgaaacggggagaaatcacacatcacgccgtctccagaggctctgctaagctccagtggttcgtggagcggaacatggtgattccggaagggcgcgtcatcgaccttggatgtggcagaggcgggtggagctactattgcgccggactgaaaaaggttaccgaggtgcggggctacacgaaagggggacccggccatgaggaacctgtgcccatgtccacctatgggtggaatattgtcaagctgatgagcggaaaggatgtgttttacctccctcccgagaaatgtgacacactgctttgcgatatcggcgaatcttccccgagccctaccgttgaggaatctcgcacaattagagtgctgaagatggtcgagccctggctcaaaaacaatcagttctgtatcaaggtgctgaacccctacatgcctaccgttatcgagcacctggaacggctccagcgcaaacacggcgggatgcttgtgagaaatcccctgtcccggaacagcacacatgagatgtattggatttctaatggaaccggcaacatcgtcagctccgtgaatatggtgtctcgcctgctcctgaacagatttacgatgacataccggagacctaccattgaaaaggacgtcgaccttggggctggaacccgccacgttaatgccgagccggaaacacccaacatggatgtgatcggcgagcggattagacgcatcaaggaggaacatagctccacgtggcactatgacgatgagaacccttacaaaacctgggcttatcacgggagctacgaagtgaaggccacaggatccgcgtctagcatgatcaatggcgtcgtgaaactgctcaccaagccctgggacgttgtgcctacagtcacccaaatggccatgacagataccacgcccttcggccagcagcgggtgtttaaagagaaggttgacaccagaacaccgaagcctatgcccgggacccgcaaagtgatggaaattacagctgagtggctgtggcggaccctgggaagaaacaagcgccctcggctctgcacgagagaggagttcaccaaaaaggtccgcaccaatgccgctatgggcgccgtgtttacagaggaaaaccaatgggattccgcccgggcggctgttgaggacgaagagttctggaaactggtggatagagagcgcgaacttcataagctggggaaatgtggatcttgcgtctataatatgatgggcaagagagagaagaaactcggggaatttggcaaggccaaaggaagccgggccatctggtacatgtggctgggcgctcgctaccttgagttcgaggccctggggtttctcaacgaagaccactggttctccagagaaaattcttatagcggagtggaaggcgaggggctgcataagctgggatacattctccgggatatctccaaaattcccggcggggctatgtatgccgacgacaccgcgggctgggatacgagaatcaccgaagacgatctgcacaacgaggagaagatcacacagcagatggaccctgaacatcggcagcttgccaatgctatttttaagctgacctaccaaaacaaagtcgtgaaggttcagcgccccacaccgaaaggaaccgtgatggatatcattagcagaaaggaccagcggggctctgggcaggtcggaacatatggcctcaataccttcacgaacatggaggcccaactgatccgccagatggaaggggagggagtgctttccaaaacagatctggaaaatcctcacctcctggagaagagaattacccagtggctggagaccaagggcgtggaacggctcaaacgcatggctatcagcggggacgattgcgttgtgaagcccatcgacgatagattcgccaacgcgctgcttgccctgaatgacatgggcaaagtccggaaggatattccccagtggcaaccttctaaaggatggcacgactggcaacaggtgccgttttgttcccatcacttccatgagctcatcatgaaggacggccgcaagctggttgtgccctgcagacctcaggatgaacttattgggcgggctcgcatcagccaaggagccggctggtctctgaaagagacagcttgtctcgggaaggcctacgctcagatgtgggccctgatgtattttcacagacgggacctgcgcctcgcgtccaacgccatttgcagcgctgtccccgtgcactgggtccctacctccagaacaacgtggagcatccatgcccaccatcagtggatgaccacagaagatatgctgaccgtgtggaaccgggtttggattgaggacaatccctggatggaggataaaacacctgtgaccacgtgggaagacgtcccctaccttggaaagagagaggatcaatggtgtggctctctgatcgggctcaccagccgcgccacatgggctcagaacatcctgaccgccattcaacaggtgcggtcccttatcggcaatgaagagttcctggactacatgccgtctatgaaaagatttcgcaaggaggaagagagcgaaggagcgatttggtga

SEQ ID NO: 20356 - RNA, 9873 nt, synthetic construct
  misc_feature 1..9873: note = derived and/or modified CDS sequence (opt5) from DENV-3__JX669489__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtaccggggagaagatgccccctgtaagattcctttcagcaccgaggacggccaagggaaagcgcacaacggaagactgatcacagctaatcccgttgtgaccaagaaagaggaacccgtcaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgtggggggagttctcaacagcctgggcaaaatggtccatcagatttttgggtctgcctacaccgctctgttctccggcgtgagctgggtgatgaagatcggaattggcgtcctcctgacctggatcgggcttaattctaaaaacacaagcatgtccttttcttgcattgccatcggaatcattaccctgtatctcggcgctgtggttcaggccgacatggggtgtgtgatcaattggaagggaaaagagctgaagtgcggcagcgggattttcgtcacaaacgaggtgcacacgtggaccgaacagtacaagtttcaagcggattcccccaaacgcctggccacagctatcgccggcgcttgggagaatggagtttgtggcattcggagcaccacaagaatggaaaaccttctctggaagcagatcgccaatgagctgaactatatcctgtgggaaaataacattaaactcaccgtggtcgtgggggacatcattggagttctggagcagggcaagcgcacgcttacccctcagcccatggagctgaaatactcttggaagacatgggggaaagccaagatcgtgaccgctgaaacacaaaactccagcttcattatcgatggacctaatacccccgagtgcccgtctgcgtcccgggcctggaacgtctgggaagtggaggactatggctttggcgtgttcacaaccaatatctggctcaagctgagagaagtctacacgcagctgtgtgaccatcgccttatgagcgctgccgttaaagatgagcgggccgtgcacgctgacatggggtactggattgagtcccagaagaacggatcttggaaactcgaaaaggccagcctgatcgaggtgaaaacatgcacctggcctaagtcccacaccctgtggtctaatggcgtcctcgaaagcgatatgattatccccaagtccctggcggggcctattagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgatccacgagtggtgctgtagaagctgcacgcttccgcctctccggtatatgggagaagatggctgttggtacgggatggagattcgccccatctctgaaaaagaggagaatatggtcaagtccctggtgagcgccggatctggcaaagttgacaacttcaccatgggggtgctgtgcctcgccattctgtttgaagaggtcatgagaggaaagttcggcaagaaacatatgatcgctggcgtgcttttcacatttgttctgctcctgagcgggcagattacctggcgggatatggcccacacactgatcatgattggatccaatgcgagcgacagaatgggcatgggggtgacctatcttgctctgatcgccacgttcaagatccagccctttctcgccctgggattctttctccgcaaactgacatctcgggaaaaccttctgctcggcgtcgggctggctatggccaccacactgcaacttcctgaggatattgaacagatcgctaatggaattgccctgggcctcatggcgctgaagctcatcacccagttcgagacctaccagctgtggacagcccttatttccctgacgtgtagcaacaccatgtttacactcaccgtggcttggagaacagccaccctgatcctggctggcgtgtcccttctgccggtctgccaatctagctccatgcgcaaaacggactggctccccatggccgttgccgctatgggggtgcctcccctgcctctcttcatcttttctctgaaggatacacttaagagacggagctggcccctgaatgagggagtgatggcggtcggcctggtgtccattctcgcctctagcctgcttcgcaacgacgttcctatggctgggcccctggtggccggaggcctcctgatcgcctgttatgtcattaccgggacctccgctgatctcacagtggaaaaagccgcggacatcacctgggaggaagaggctgaacagacaggagttagccataacctgatgattacggtggacgatgacggcaccatgagaatcaaggatgacgagacagagaatatccttaccgtcctgctgaaaacagccctcctgattgtgtctggcgtcttcccgtactccatccctgccacccttctggtgtggcacacgtggcagaagcagacccaacggagcggggttctctgggatgtgccctctcctcccgaaacacagaaagctgagctggaagagggagtctaccgcattaagcagcagggcatctttgggaaaacccaagtgggagttggcgtgcagaaggagggggtcttccatacaatgtggcacgtgaccagaggagccgtgctcacatataacggcaagcggctggaaccgaattgggcgtccgttaaaaaggaccttattagctacggcgggggatggcgcctgtctgctcagtggcaaaaaggcgaggaagtccaggtgatcgccgtggagcctgggaagaaccccaaaaattttcagacgatgcctggaaccttccagacaaccaccggcgaaattggggccatcgctctggatttcaagcccggaacatccggcagccccatcattaacagagagggcaaggtcgtggggctctatggaaatggcgttgtgacgaaaaacgggggatacgtctccggcatcgcccaaaccaatgctgagcctgacgggccgacacccgaactggaggaagagatgtttaagaaacggaaccttaccattatggatctgcaccctggcagcggaaagacacgcaaatatctccccgccatcgtgagagaagcgattaagcggagactgcgcaccctcatcctggcccctacgcgggttgtggctgccgagatggaggaagctcttaagggcctgcccatcagataccagacaaccgccaccaaatctgagcatacagggcgcgaaattgtcgacctgatgtgccacgccaccttcacaatgcggctcctgagccctgtgagagttccgaattataaccttatcattatggatgaggctcattttaccgaccccgcgtccatcgccgctcgcggatacatttctacgcgggtgggcatgggggaagccgccgctatcttcatgacagccacccctcccggaacagcggatgcttttcctcagagcaatgcccccatccaggacgaggagagagacattccggaacgctcctggaactctggcaatgagtggatcaccgatttcgccgggaagacggtctggtttgtgcctagcattaaagctggcaacgacatcgccaactgtctgcggaagaatggaaaaaaggtgattcaactctccagaaagaccttcgatacagaataccagaaaaccaagctgaacgactgggattttgtcgttacaaccgacatctctgagatgggcgcgaatttcaaagccgatcgggtgattgacccccgcagatgcctgaagcccgtgatcctcacagatgggcctgagcgggtcatccttgctggacccatgcctgtgaccgccgctagcgccgctcagcgcagaggccgggttgggagaaacccgcagaaagaaaatgaccaatatatttttacgggacagcccctgaacaatgatgaggaccacgcccattggacagaagcgaagatgctgctcgacaacatcaatacccctgagggcattatccccgccctgttcgaacctgagcgcgagaagtccgctgccattgatggggaataccggcttaaaggcgagagcagaaagaccttcgtggaactgatgcgccggggagacctccccgtctggctggctcacaaagtggcctctgagggcatcaagtatacagatagaaaatggtgctttgacgggcagcgcaacaatcagatcctggaagagaacatggatgttgagatttggaccaaggaaggagagaaaaagaagctccggccgagatggcttgacgcccgcacatactccgatcctctggctctgaaagaattcaaggactttgcggccggcagaaaaagcatcgctctcgatctggtgacggagattgggcgggtcccctctcaccttgcccatcgcaccagaaatgccctggacaacctcgtgatgctgcacacatccgaacatggaggccgggcttatcgccacgccgtcgaggagctgcctgaaaccatggagacactccttctgctgggcctcatgatcctgcttaccgggggagcgatgctgttcctcattagcggcaaggggatcggaaaaacgtccatcggcctgatttgtgtgatcgcctctagcgggatgctgtggatggctgaaattcccctccaatggatcgcctccgctattgttcttgagtttttcatgatggtgctgctgatccctgagcccgaaaagcagagaaccccgcaggataatcaactcgcctacgtggtcattggaatcctgacacttgcggccatcattgctgccaacgagatgggcctgctcgaaaccacaaagcgggacctgggcatgagcaaagagcctggggttgtgtctcccacctcctatctggatgtggacctccaccccgctagcgcctggacgctttacgctgtcgccacaaccgtgatcacacctatgctgagacataccattgaaaattctaccgcgaacgttagcctggccgctatcgccaaccaggctgtggtcctcatgggactggacaagggctggccgatttccaaaatggatcttggggtgcccctgctcgccctgggatgctactctcaggtcaatcctctgacactcacggccgcggtgcttctgctgatcacccactatgctatcattggccccgggctccaggccaaggctacacgcgaggcccaaaaacggaccgccgctggaatcatgaagaaccctacagttgacggcattatgaccatcgatctggaccccgtgatttacgatagcaagtttgagaaacagcttggccaggtcatgctgctcgtgctgtgtgccgttcagctgctccttatgagaacgtcctgggcgctgtgcgaagccctgacactcgctaccgggcctatcaccacactgtgggagggatctccgggcaagttctggaataccacaatcgccgtgagcatggctaacatttttcgcgggtcctatcttgccggagcgggcctggccttcagcatcatgaaatctgtcgggacgggaaagcggggcaccggctcccaaggggaaacactcggagagaaatggaagaagaaactgaatcagctgagcagaaaggaatttgacctctacaaaaagtccggcattaccgaggtggatcggacagaggctaaagaagggcttaagcgcggagagatcacccatcacgccgtgtctagaggcagcgctaaactgcagtggttcgttgaacggaacatggtcattcccgaggggcgcgtgatcgacctgggatgtggcagaggcgggtggtcctattactgcgccggactcaagaaggtgacggaagtccggggctataccaaagggggacctggccatgaggagcccgttcctatgtctacatacgggtggaatattgtgaagctgatgagcggaaaagatgtgttttaccttcccccggaaaagtgtgacaccctgctctgcgatatcggcgagtccagcccttctcccacagtcgaagagtcccgcaccatcagagtgctgaaaatggttgagccctggctgaagaacaatcagttctgtattaaggtgctcaacccttatatgcccacagtcatcgaacaccttgagcggctgcaacgcaaacacggcgggatgctggtgagaaatcctctcagccggaactctacccatgaaatgtactggatttccaatggaacgggcaacatcgttgctagcgtgaatatggtctctagactgcttctgaaccgcttcacaatgacccaccggagaccgaccattgagaaggacgtggatctcggggccggaacacgccatgtgaacgcggaacccgagacgcctaatatggacgtcatcggcgagcggatcaaaagaattaaggaagagcacaacagcacctggcactatgacgatgaaaatccctacaaaacatgggcctatcatgggtcctacgaggttaaggctaccggatctgccagctccatgatcaacggcgtggtgaagctgctgacaaaaccttgggacgtcgtgcccatggttacccagatggctatgacagataccacgccgtttggccagcaacgcgtgttcaaggaaaaagtcgacacccggacacctagaagcatgcccgggacccgccgggtgatgggaattacagccgagtggctctggagaaccctgggccgcaataagaaacctcggctttgcacgagagaggaatttacaaagaaggttcgcaccaacgccgcgatgggggctgtgttcacagaggaaaatcagtgggattccgccaaagccgctgtcgaggacgaagatttttggaagctggtggacagagagcgggagctccacaaactgggaaagtgtggctcttgcgtttataacatgatggggaaacgcgaaaagaaacttggcgagttcggaaaggccaagggcagcagagctatctggtacatgtggctgggggcccggtacctcgaatttgaggcgctgggattcctgaatgaggatcattggttttccagagaaaactcttatagcggcgtggagggggaaggactccacaaactgggctacattcttcgggacatctccaagatccccgggggcgccatgtatgctgatgacaccgccggatgggacacgcgcattaccgaggatgacctgcataatgaagagaaaatcacacagcagatggatcctgagcacagacaactcgctaacgccattttcaagctgacctaccagaataaagtcgtgaaggtccagcggcccacaccgaccggcacagtgatggacatcatttctcgcaaggatcagagagggagcggacaagttggcacctatgggcttaacacgtttacaaatatggaagcgcagctgatccggcagatggagggagaaggcgtgctctccaaagccgacctggagaaccctcacctgcccgaaaagaaaatcacccagtggctcgagaccaagggggtcgagcgcctgaaaagaatggctattagcggcgatgactgcgtggtgaagcccatcgatgaccggttcgccaacgctcttctggccctcaatgatatgggaaaggttcgcaaagacattcctcaatggcagccgtctaagggctggcatgattggcagcaggtgcccttttgttcccaccatttccacgaactgatcatgaaagacgggagaaagcttgtcgtgccttgccggccccaagacgagctgattggacgcgctagaatcagccagggcgccgggtggtctctccgggaaacagcgtgtctgggaaaagcctacgctcagatgtggtccctgatgtatttccaccgcagagatctccggctggccagcaacgccatttgctctgctgttcctgtgcattgggtccccacctccagaacaacgtggagcatccacgcccatcaccaatggatgaccacagaggacatgcttaccgtgtggaatcgcgtctggatcgaagataacccttggatggaggacaagacacccgtgaccacgtgggagaatgttccgtacctgggcaagcgggaagatcagtggtgtgggtccctcattggcctgaccagcagagcgacatgggctcagaacatccctaccgccattcagcaagtgcgctctcttatcggaaatgaggaatttctggactacatgcccagcatgaaacggttcagaaaggaggaggaatccgagggcgccatttggtga

SEQ ID NO: 20357 - RNA, 9873 nt, synthetic construct
  misc_feature 1..9873: note = derived and/or modified CDS sequence (opt5) from DENV-3__JX669498__SS-prME
  source 1..9873: mol_type = other RNA
accagcctgtgcctcatgatgatcctgcccgccgctcttgccttccacctgacgtccagagacggcgaacctcggatgattgtggggaagaacgaacgcggaaaatctctcctgtttaagacggcgtccggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgaaagacggcgcgacaagagatctgtggccctggctcctcacgtcgggatgggactggatacccggacacagacctggatgagcgccgaaggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagtctattgagggcaaagttgtgcagtatgaaaatctcaagtacacagtcatcatcaccgtgcacacaggggaccagcatcaggttggaaacgagacgcaaggcgtgaccgctgaaattacaccccaggcctccaccacagaggctatcctgcctgaatatggcaccctggggctcgagtgcagccccagaacgggactggacttcaatgagatgattcttctgaccatgaaaaacaaggcctggatggtccaccggcagtggtttttcgatctccctctgccctggacatctggcgccaccacagaaaccccgacgtggaatcgcaaagagcttctggtgacatttaagaacgctcatgcgaaaaagcaagaagtcgtggttctcgggtcccaggagggagccatgcacaccgctctgacaggcgccaccgaaatccagaatagcgggggcacctctattttcgccggacacctgaagtgtagactcaaaatggacaagctggagcttaaaggcatgtcctacgctatgtgcacaaacacgtttgtgctgaagaaagaggtcagcgaaacccagcatgggacaatcctcatcaaggtggagtacaagggagaagatgccccttgtaaaattcccttctccaccgaggacggccaagggaaggcgcacaacggacggctgatcacagctaatcctgttgtgaccaaaaaggaggaacccgtcaacattgaggccgaaccccctttcggcgagtctaatatcgtgattgggacgggcgataacgccctgaaaatcaattggtataagaagggaagctccatcggcaaaatgtttgaagctacagccagaggggctcgccggatggccattcttggagacaccgcgtgggatttcggcagcgtcgggggagttctcaactctctgggcaagatggtccatcagatctttgggtccgcctacaccgctctgttcagcggcgtgtcttgggtgatgaaaattggaatcggcgtcctcctgacatggattgggcttaatagcaagaacacctccatgtcttttagctgcatcgccattggaatcatcacactgtatctcggcgctgtggttcaggccgacatggggtgtgtgattaattggaaaggaaaggagctgaagtgcggctccgggatcttcgtcacgaacgaggtgcacacctggacagaacagtacaaatttcaagcggatagcccgaagagactggccaccgctattgccggcgcttgggagaatggagtttgtggcatccgctctacaacccggatggaaaaccttctctggaaacagattgccaatgagctgaactatatcctgtgggaaaataacatcaagctcacggtggtcgtgggggacattatcggagttctggagcagggcaaaagaacccttacaccccagcctatggagctgaagtactcctggaaaacctgggggaaggccaagattgtgacagctgaaacccaaaacagctctttcatcattgatggacccaatacacctgagtgcccctccgcgagccgcgcctggaacgtctgggaagtggaggactatggctttggcgtgttcaccacgaatatctggctcaaactgcgggaagtctacacacagctgtgtgaccatagacttatgtccgctgccgttaaggatgagcgcgccgtgcacgctgacatggggtactggatcgagtctcagaaaaacggaagctggaagctcgaaaaagcctccctgattgaggtgaagacctgcacctggccgaagtctcacacactgtggagcaatggcgtcctcgaatccgatatgatcattcctaaaagcctggcggggcccatctctcagcataaccaccggcctggatatcatacccaaacggctggcccctggcaccttgggaagctggagctcgactttaattactgcgagggaacaaccgtggttattacagaaaactgtggcaccagaggcccttccctgcgcacaaccacggtgagcgggaaactgatccacgagtggtgctgtcggtcttgcacccttcccccgctcagatatatgggagaagatggctgttggtacgggatggagatccggcctatttccgaaaaggaggagaatatggtcaaaagcctggtgtctgccggaagcggcaaggttgacaacttcacaatgggggtgctgtgcctcgccatcctgtttgaagaggtcatgcgcggaaagttcggcaaaaagcatatgattgctggcgtgttctttaccttcgttcttctgctctccgggcagatcacatggagagatatggcccacaccctgattatgatcggaagcaatgcgtctgaccggatgggcatgggggtgacgtatctggctcttattgccacatttaaaatccagcccttcctggccctcggatttttcctgagaaagctcacctcccgcgaaaacctgcttctgggcgtcgggctcgctatggccacaaccctgcaactgcccgaggatatcgaacagatggctaatggaattgcccttggcctgatggcgctcaaactgatcacccagtttgagacataccagctctggacggccctgattagccttacctgttccaacacaatgttcaccctgacagtggcttggcggaccgccacgctcatcctggctggcgtgtctctgcttcctgtctgccaaagctcctctatgagaaagacagactggctgccgatggccgttgccgctatgggggtgccccctctccccctgtttattttcagcctcaaggataccctgaaacgcagatcctggcctcttaatgagggagtgatggcggtcggcctggtgtctatcctggccagctccctcctgcggaacgacgttcccatggctgggcctcttgtggccggaggcctgctcatcgcctgttatgtcattaccgggacaagcgctgatctgaccgtggaaaaggccgcggacatcacatgggaggaagaggctgaacagacgggagtttctcataacctcatgattaccgtggacgatgacggcacaatgcgcatcaaagatgacgagaccgagaatattctgacagtccttctgaagaccgccctgctcatcgtgtccggcgtctttccctacagcatcccggccacgctgcttgtgtggcacacctggcagaaacagacacaaagatctggggttctgtgggatgtgccttctccccctgaaacccagaaggctgagctcgaagagggagtctaccggattaaacagcagggcatcttcgggaagacacaagtgggagttggcgtgcagaaggagggggtctttcataccatgtggcacgtgacacgcggagccgtgctgacgtataacggcaaaagactcgaacccaattgggcgagcgttaagaaagacctgattagctacggcgggggatggcggctttccgctcagtggcaaaagggcgaggaagtccaggtgatcgccgtggagccggggaaaaaccctaagaatttccagaccatgcccggaacattccagaccaccacaggcgaaattggggccatcgctctggattttaagcctggaacgagcggctcccccattatcaaccgcgagggcaaagtcgtggggctgtatggaaatggcgttgtgaccaagaacgggggatacgtcagcggcatcgcccaaacaaatgctgagcccgacgggcctaccccggaactcgaggaagagatgttcaaaaagagaaacctgacaattatggatcttcaccccggctctggaaaaacccggaagtatctgcctgccatcgtgcgcgaagcgattaagagacggctcagaacgctgatcctcgcccccacacgcgttgtggctgccgagatggaggaagctctgaaaggccttcctattcggtaccagaccaccgccacaaagagcgagcataccgggagagaaatcgtcgacctgatgtgccacgccacatttaccatgcgcctgctctcccccgtgcgggttcctaattataacctgatcattatggatgaggctcatttcacggacccggcgtctatcgccgctagaggatacattagcacacgcgtgggcatgggggaagccgccgctatctttatgaccgccacaccccctggaaccgcggatgctttcccccagtccaatgcccctattcaggacgaggagcgggacatccccgaaagatcttggaacagcggcaatgagtggatcacggattttgccgggaaaaccgtctggttcgtgccgtccattaaggctggcaacgacatcgccaactgtcttcgcaaaaatggaaagaaggtgattcaactgtctcggaaaacatttgataccgaataccagaagacaaaactcaacgactgggatttcgtcgttaccacagacatcagcgagatgggcgcgaattttaaggccgatagagtgattgaccctcggcgctgcctgaaacccgtgatcctgaccgatgggcccgagagagtcattctcgctggacctatgcccgtgacggccgcttccgccgctcagcggcgcggcagagttgggcggaaccctcagaaggaaaatgaccaatatatcttcacaggacagccgcttaacaatgatgaggaccacgcccattggaccgaagcgaagatgctgctggacaacatcaatacccccgagggcattatccctgccctcttcgaacccgagagagagaaaagcgctgccattgatggggaataccgcctgaagggcgagtctcggaaaacatttgtggaacttatgagacgcggagacctgcctgtctggctcgctcacaaggtggcctccgagggcatcaaatataccgatcggaagtggtgcttcgacgggcagagaaacaatcagattctggaagagaacatggatgttgagatctggacaaaagaaggagagaagaagaaactgcgcccccggtggctcgacgccagaacgtacagcgatccgcttgctctgaaggaatttaaagacttcgcggccggccgcaagtctatcgctctggatctcgtgaccgagattgggagagtcccttcccacctggcccatcggacacgcaatgcccttgacaacctggtgatgctccacaccagcgaacatggaggcagagcttatcggcacgccgtcgaggagctgcccgaaacaatggagaccctgctccttctgggcctgatgatcctcctgacagggggagcgatgctttttctgatttccggcaaagggatcggaaagacctctattggcctcatctgtgtgatcgccagctccgggatgctgtggatggctgaaattcctctgcaatggatcgccagcgctattgttctcgagttctttatgatggtgcttctgatccccgagcctgaaaagcagcgcacaccccaggataatcaactggcctacgtggtcattggaatcctcaccctggcggccattatcgctgccaacgagatgggccttctggaaacaaccaaaagagacctcggcatgtctaaggagccgggggttgtgtcccctacgagctatctggatgtggacctgcaccccgcttctgcctggacactctacgctgtcgccaccacagtgatcacccccatgcttcggcataccattgaaaatagcacagcgaacgtttccctggccgctatcgccaaccaggctgtggtcctgatgggactcgacaaaggctggcctatttctaagatggatctgggggtgccgcttctggccctcggatgctacagccaggtcaatcccctgacgctgaccgccgcggtgctccttctgatcacacactatgctattatcggccctgggctgcaggccaaagctaccagagaggcccaaaagcgcacagccgctggaatcatgaagaaccccaccgttgacggcattatgacgatcgatctcgaccctgtgatttacgattccaaattcgagaagcagctgggccaggtcatgcttctggtgctctgtgccgttcagctgctgctcatgcggacatcttgggcgctttgcgaagccctgaccctggctaccgggcccatcacaaccctctgggagggaagccctggcaaattttggaatacaacgattgccgtgtccatggctaacatcttcagagggagctatctggccggagcgggccttgccttttctatcatgaagtccgtcgggaccggaaaacgcggcacaggcagccaaggggaaaccctgggagagaagtggaagaaaaagctcaatcagctgtcccggaaagagttcgacctgtacaagaaatctggcattacagaggtggatagaaccgaggctaaggaagggctcaaacggggagagatcacgcatcacgccgtgagccgcggctccgctaaacttcagtggtttgttgaaagaaacatggtcattccggaggggcgggtgatcgacctgggatgtggccgcggcgggtggtcttattactgcgccggactgaagaaagtgaccgaagtcagaggctatacaaaagggggacccggccatgaggagcctgttcccatgagcacctacgggtggaatattgtgaaactcatgtccggaaaggatgtgttctacctgcctcccgaaaaatgtgacacacttctgtgcgatatcggcgagagctctccgtcccctaccgtcgaagagagccggacaattcgcgtgctcaagatggttgagccctggctgaagaacaatcagttctgtatcaaagtgctgaacccctatatgcctaccgtcatcgaacacctcgagagacttcaacggaagcacggcgggatgctggtgcgcaatcccctgtctagaaactccacgcatgaaatgtactggattagcaatggaacaggcaacatcgttgcttctgtgaatatggtcagccggctcctgcttaacagatttaccatgacccaccgccggcctacaattgagaaagacgtggatctgggggccggaacgagacatgtgaacgcggaaccggagacccccaatatggacgtcatcggcgagcgcattaagcggatcaaagaagaacacaactccacatggcactatgacgatgaaaatccttacaagacctgggcctatcatgggtcttacgaggttaaggctacaggaagcgcctccagcatgatcaacggcgtggtgaaactcctgaccaagccctgggacgtcgtgcctatggttacacagatggctatgaccgatacgacccccttcggccagcaaagagtgtttaaagaaaaggtcgacacacgcaccccgcggtccatgcctgggacaagacgcgtgatgggaattaccgccgagtggctgtggcggacgctcggcagaaataaaaagccccgcctgtgcacacgggaggagttcaccaagaaagttagaacaaacgccgcgatgggggctgtgtttaccgaggaaaatcagtgggattctgccaaggccgctgtcgaggacgaagatttctggaaacttgtggaccgcgagagagagctgcacaagctcggaaaatgtggcagctgcgtttataacatgatggggaagcgggagaagaagctgggcgagtttggaaaggccaaaggctcccgcgctatctggtacatgtggcttggggccagatacctggagttcgaggcgctcggatttctgaatgaggatcattggttctctcgggaaaacagctattccggcgtggagggggaaggactgcacaagctcggctacattctgagagacatctctaaaattcctgggggcgccatgtatgctgatgacacggccggatgggacacccggatcacagaggatgaccttcataatgaagagaagatcacccagcagatggatcccgagcaccgccaactggctaacgccatttttaaactcacataccagaataaggtcgtgaaggtccagagacctacccccacaggcaccgtgatggacatcattagccggaaagatcagcgcgggtccggacaagttggcacgtatgggctgaacacattcaccaatatggaagcgcagcttatcagacagatggagggagaaggcgtgctgagcaaggccgacctcgagaacccgcatctgcctgagaagaagattacccagtggctggagacaaaaggggtcgagcggctcaagcgcatggctatctctggcgatgactgcgtggtgaagcccatcgatgacagatttggaaacgccctgcttgctctgaatgatatgggcaaagttcggaaggacattccccaatggcagccttccaaagggtggcatgattggcaacaggtgccgttctgtagccaccatttccacgaactcatcatgaaggacggacgcaaactggtcgtgccctgcagacctcaagacgagcttattggccgggcccgcatctctcagggggctggatggtccctgagagaaaccgcctgtctcggcaaggcgtacgcccagatgtggagcctgatgtattttcaccggcgcgatctgagactcgcttctaacgccatttgctccgccgttcccgtgcattgggtccctacaagccggacgacctggtccatccacgctcatcaccaatggatgacaaccgaggacatgctgacagtgtggaatagagtctggattgaagataacccctggatggaggacaagacccctgtgacgacctgggagaatgttccctaccttgggaaacgcgaagatcagtggtgtggcagcctgatcggactcacatctcgggccacctgggcgcagaacatcccgacagctattcagcaagtgagaagcctgatcggcaatgaggagttccttgactacatgccttccatgaagcgctttcggaaagaggaggaatctgagggggccatttggtga

SEQ ID NO: 20358 - RNA, 9873 nt, synthetic construct
  misc_feature 1..9873: note = derived and/or modified CDS sequence (opt5) from DENV-3__KF954946__SS-prME
  source 1..9873: mol_type = other RNA
acaagcctgtgcctcatgatgatcctgcccgccgctcttgccttccacctgacgtcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccatccttcgcaaactgtgtattgagggaaagatcaccaacattacaaccgattccagatgccctacgcagggcgaagcggtgctcccggaggaacaggaccagaattatgtgtgtaaacacacatacgtcgatcggggctgggggaacggatgcggcctgttcgggaagggaagccttgtgacctgcgccaagtttcagtgtctggagcccatcgagggcaaagttgtgcagtatgaaaatctcaagtacaccgtcatcattacagtgcataccggggaccagcaccaggttggaaacgagacacaaggcatcacggctgaaattacccctcaggcctctacaaccgaggctatcctgcccgaatatggcacactggggctcgagtgctcccctcgcaccggactggacttcaatgagatgattcttctgacgatgaaaaacaaggcctggatggtgcatagacagtggtttttcgatctccccctgccgtggaccagcggcgccacaaccgaaacacctacctggaatcggaaagagcttctggtcacgtttaagaacgctcacgcgaaaaagcaagaagtggtcgtgctcgggtctcaggagggagccatgcacacagctctgaccggcgccacagaaatccaaaattccgggggcaccagcatcttcgccggacatctgaagtgtcgcctcaaaatggacaagctggagcttaaaggcatgtcttacgctatgtgcaccaacacatttgttctgaagaaagaggtgtccgaaacgcagcacgggaccattctcatcaaggtcgagtacaagggagaagatgccccctgtaaaattcctttcagcacagaggacggccaagggaaggcgcataacggaagactgatcaccgctaatcccgtggttaccaagaaggaggaacccgtgaacattgaggccgaacctccgttcggcgagtccaatatcgtcatcgggattggcgataacgccctgaaaatcaattggtataagaagggatctagcattggcaaaatgtttgaagctaccgccagaggggctagacgcatggccatccttggagacacggcgtgggatttcggctccgtcggcggggtgctcaacagcctggggaagatggttcaccagatttttgggtctgcctacacagctctgttctccggcgtcagctgggtgatgaaaatcggaattggcgtgctcctgacctggatcgggcttaattctaagaacaccagcatgtccttttcttgcatcgccattggaatcattacactgtatctcggcgctgtcgtgcaggccgacatggggtgtgttatcaattggaaaggaaaggagctgaagtgcggcagcgggattttcgtgaccaacgaggtccatacatggacggaacagtacaaatttcaagcggattcccccaagcggctggccaccgctatcgtgggcgcctgggagaatggagtttgtggcatcagaagcacaacccgcatggaaaaccttctctggaaacagattgctaatgagctgaactatatcctgtgggaaaataacattaagctcacagtggtcgtgggggacaccatcggagttctggagcagggcaaacggacgcttacccctcagcccatggagctgaagtactcttggaaaacatgggggaaggccaagattgtgaccgccgaaacacaaaactccagcttcatcatcgatggacctaatacccccgagtgcccgtctgcttccagagcgtggaacgtctgggaagtggaggactatggctttggcgtgttcacaaccaatatttggctcaaactgcgcgaagtctacacgcagatgtgtgaccaccggctgatgagcgccgctgttaaggatgagagagccgtgcacgccgacatggggtactggatcgagtcccagaaaaacggatcttggaaacttgaaaaagctagcctcattgaggtgaagacatgcacctggcctaagtcccataccctgtggtctaatggcgtcctggaaagcgatatgatcattcccaaatccctcgccgggcctatcagccagcacaactatcgccccggataccatacacaaaccgcgggcccttggcacctggggaaacttgagctggactttaattattgcgagggaacgacagtggttatcaccgaaaactgtggcacacggggcccctctctcagaaccacaaccgtgtccgggaaactgattcacgagtggtgctgtcgcagctgcacgctgccgcctcttcggtacatgggagaagatggctgttggtatgggatggagatcagacccatttctgaaaaggaggagaatatggtcaaatccctcgtgagcgctggatctggcaaggttgacaacttcaccatgggggtgctgtgcctggccatcctctttgaagaggtcatgcggggaaagttcggcaaaaagcatatgattgccggcgtgttctttacattcgttctgcttctgagcgggcagatcacctggcgcgatatggctcacacactcattatgatcggatccaatgccagcgacagaatgggcatgggggtgacctacctggcgctgatcgctacgtttaaaattcagcccttccttgccctgggatttttcctccggaagctgacatctagagaaaacctcctgcttggcgtcgggctggccatggctaccacactccaactgcctgaggatatcgaacagatggccaatggaattgctctgggccttatggccctgaaactcatcacccagtttgagacctatcagctgtggacagcgctcatttccctgacgtgtagcaacaccatcttcacacttaccgtggcctggcgcacagctaccctgatcctcgccggcgtgtccctgctgccggtctgccaatctagctccatgcggaagacggactggcttcccatgacagttgctgccatgggggtgcctcccctgcctctctttattttctctctgaaggataccctcaaaagacgcagctggcccctgaatgagggagtgatggccgtcggccttgtgtccatgctggcttctagcctgctcagaaacgacgttcctatggcggggcccctggtggccggaggccttctgatcgcttgttacgtcattaccgggacatccgccgatctcaccgtggaaaaggccgctgacgttacatgggaggaagaggccgaacagacgggagtgagccataacctgatgatcaccgtcgacgatgacggcacaatgcggattaaagatgacgagaccgagaatatcctcacagtgctgcttaagaccgcgctgctgatcgtctctggcatttttccgtactccatccctgctacgctcctggtgtggcacacctggcagaaacagacacaacgcagcggggttctttgggatgtgccctctcctcccgaaacccagaaggccgagctggaagagggagtctatagaattaaacagcagggcatcctcgggaagacacaagtgggagttggcgtgcagaaggacggggtcttccataccatgtggcacgtgacacggggagccgtgctgacgcacaacggcaaacgcctcgagccgaattgggcttccgttaagaaagatctgattagctacggcgggggatggagactttctgcccagtggcaaaagggcgaagaggtccaggtgatcgcggtggaacctgggaaaaaccccaagaattttcagaccatgcctggaacattccagaccaccacaggcgagattggggctatcgccctggacttcaagcccggaacgtccggcagccccatcattaaccgggaaggcaaagtcgtggggctgtatggaaatggcgttgtgaccaagaacgggggatacgtctccggcatcgcccaaacaaatgctgagcctgatgggccgacccccgagctcgaagaggaaatgtttaaaaagcgcaacctgacaattatggaccttcatcctggcagcggaaaaaccagaaagtatctgcccgccatcgtgcgggaggctattaagcgcagactccggacgctgatcctcgcccctacaagagttgtggcggccgaaatggaggaggctctgaaaggccttcccatccgctaccagaccaccgccacaaagtctgaacacaccgggcgggagattgtcgatctgatgtgccatgctacattcaccatgagactgctcagccctgtgcgcgttccgaattataacctgatcattatggacgaagcccactttacggatcccgcctccatcgctgcgcggggatacatttctacaagagtgggcatgggggaggccgctgccatcttcatgaccgccacacctcccggaaccgctgacgcctttcctcagagcaatgcgcccatccaggacgaggaacgcgatattccggagcggtcctggaactctggcaatgaatggatcacggacttcgctgggaaaaccgtctggtttgtgcctagcattaaggccggcaacgatatcgccaactgtcttcgcaaaaatggaaagaaggtgattcaactgtccagaaaaacattcgacaccgagtaccagaagacaaaactcaacgattgggactttgtcgttaccacagatatctctgaaatgggcgctaatttcaaggccgaccgggtgattgatcccagacggtgcctgaaacccgtgatcctgaccgacgggcctgagcgcgtcatcctcgcgggacccatgcctgtgacggccgctagcgccgctcagagacggggccgcgttgggagaaacccgcagaaggagaatgatcaatatatttttacaggacagccccttaacaatgacgaagaccatgcccactggaccgaggctaagatgctgctggataacatcaatacccctgaaggcattatccccgccctcttcgagcctgaacgggagaaatccgcggccattgacggggagtacagactgaagggcgaaagccgcaaaacattcgtggagcttatgcggagaggagatctgcccgtctggctcgctcacaaggtggcctctgaaggcatcaaatataccgaccgcaagtggtgctttgatgggcagcggaacaatcagatcctggaggaaaacatggacgttgagatttggacaaaagagggagaaaagaagaaactgagaccgcgctggctcgatgctcggacgtactccgaccctcttgccctgaaggagttcaaagattttgccgctggcagaaagagcatcgcgctggacctcgtgaccgaaattgggcgcgtcccctctcatctggcccacagaacacggaatgctcttgataacctggtgatgctccatacctccgagcacggaggccgcgcctatagacacgccgtcgaggaactgcctgagacaatggaaaccctgctccttctgggcctgatgatcctcctgacagggggagctatgcttttcctgattagcggcaaagggatcggaaagacctccatcggcctcatttgtgtgatcgcctctagcgggatgctgtggatggcggagattcccctgcaatggatcgcctccgctattgttctcgaatttttcatgatggtgcttctgatccctgagcccgagaagcagcggacaccgcaggacaatcaactggcctacgtggtcattggaatcctcaccatggctgccatcattgcggccaacgaaatgggcctgcttgagacaaccaaacgcgatctgggcatgagcaaggaacctggggttgtgtctcccacgtcctatctcgacgtggacctgcatcccgctagcgcctggacactgtacgctgtcgccaccacagtgatcacccctatgctcagacacaccattgaaaattctacagctaacgttagccttgccgcgatcgccaaccaggctgtggtcctgctgggactcgataaaggctggccgatttccaagatggacctgggggtgccccttctggccctcggatgctactctcaggtcaatcctctgacgctgaccgctgccgtgctccttctggttacacattatgccatcatcggccccgggctgcaggcgaaagctacccgggaagcccaaaagagaacagctgccggaattatgaagaaccctaccgtggatggcatcattacgatcgacctcgatcccgtcatttacgacagcaaatttgagaagcagctgggccaggtgatgcttctggttctctgtgccgtgcagctgctgctcatgcgcacatcctgggctctttgcgaggccctgaccctggcgaccgggcctatcacaaccctctgggaaggatctccgggcaaattctggaatacaacgatcgccgtcagcatggctaacatttttcgggggtcctatctggccggagctggccttgccttcagcatcatgaagtctgtggggaccggaaaaagaggcacaggctcccaaggggagaccctgggagaaaagtggaagaaaaagctcaatcagctgagccgcaaagagtttgatctgtacaagaaatccggcattacagaagtggaccggaccgaggcgaaggaggggctcaaaagaggagaaacgacccaccatgccgtttctcggggcagcgctaaacttcagtggttcgtcgagcgcaacatggtgatccccgaagggagagtgattgatctgggatgtggccggggcgggtggtcctattactgcgccggactgaagaaagtcacagaggttcgcggctataccaaagggggacctggccacgaggaacccgtgcctatgtctacatacgggtggaatatcgtgaaactcatgagcggaaaggacgtcttttacctgcccccggagaaatgtgatacccttctgtgcgacattggcgaatccagcccttctcccacagtggaggaatccagaaccatccgggttctcaagatggtggagccctggctgaagaacaatcagttctgtatcaaagtcctgaacccttatatgcccgctgtgattgagcacctcgaacgccttcaaagaaagcatggcgggatgctggttcggaatcctctgagccgcaactctacgcacgagatgtactggatctccaatggaacaggcaacattgtgagctctgtcaatatggtgagcagactcctgcttaaccggttcaccatgacccatagacgcccgacaatcgaaaaagatgtggacctgggggccggaacgcggcacgtcaacgctgagcccgaaacccctaatatggacgttattggcgagagaatcaagcgcatcaaagaggaacacaactccacatggcattatgatgacgagaatccctacaagacctgggcctatcacgggtcttacgaagtgaaggcgacaggaagcgcctccagcatgattaacggcgtggtcaaactcctgaccaagccttgggatgtggttcccatggtgacacagatggctatgaccgacacgaccccgtttggccagcaacgggtcttcaaagagaaggtggatacaagaacccctcgccccatgcctgggacacggaaagttatggaaatcaccgccgagtggctgtggagaacgctcggacgcaataagcggcccagactgtgcacacgcgaggaatttaccaagaaagtgcggacaaacgctgccatgggcgccgtcttcaccgaggaaaatcagtgggactccgcgaaggctgccgtggaggatgaagagttttggaaacttgttgacagagagcgcgaactgcataagctcgggaaatgtggatcttgcgtgtataacatgatgggcaagagagagaaaaagctgggggagttcggcaaggccaaaggaagccgggctatttggtacatgtggcttggcgcccgctacctggagtttgaggctctcgggttcctgaatgaagatcactggttttccagagagaactcttatagcggagtcgaaggcgaggggctgcataagctcggatacatcctgcgggacatttccaaaatccctggcggggccatgtatgcggatgacacggccggctgggacaccagaatcacagaagatgaccttcacaatgaggagaagattacccagcagatggatcccgaacaccggctgctcgctaacgccatcttcaaactgacataccaaaataaggtggtcaaggtgcagcgcccgacccctacaggaaccgttatggacattatctctagaaaagatcagcggggcagcggacaggtgggaacgtatggccttaacacatttaccaatatggaggctcaactggtccgccagatggaaggggagggagtgctctccaagaccgacctggaaaacccccatctgcccgagaaaaagattacacagtggctcgagaccaaaggcgtggaaagactgaagcggatggccatcagcggggatgactgcgttgtgaagcctatcgatgaccgcttcgcgaacgcccttctggctctcaatgatatgggcaaagtcagaaaggacattccgcagtggcaaccctctaaaggatggcacgattggcaacaggtgcctttttgttcccatcacttccacgagctgatcatgaaggacggccggaaacttgttgtgccctgccgccctcaggacgaactgattgggagagcccggatcagccaaggagctggctggtctctccgcgagacagcctgtctggggaaggcttacgcccagatgtggtccctgatgtatttccatagacgggatctccgcctggcgagcaacgccatttgctctgctatccccgtccactgggtgcctacgtccagaaccacatggagcattcatgcccaccatcagtggatgaccacagaagacatgcttaccgtctggaatcgggtgtggatcgaggataacccctggatggaggacaagacgccgatcaccacatgggaaaatgttccttacctgggaaaaagagaggatcaatggtgtggctccctcattgggctgaccagccgcgccacatgggctcagaacatccccaccgccattcaacaggtgcggtctcttatcggcaatgaagagtttctggactacatgcctagcatgaagagattccgcaaagaggaagagtccgaaggagcgatttggtga

SEQ ID NO: 20359 - RNA, 9873 nt, synthetic construct
  misc_feature 1..9873: note = derived and/or modified CDS sequence (opt5) from DENV-3__KF954947__SS-prME
  source 1..9873: mol_type = other RNA
accagcctgtgcctcatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcattaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgttctgaagaaagaggtgtccgaaacccagcacgggacaatcctcattaaggtcgagtacaagggagaagatgccccctgtaaaatccctttcagcaccgaggacggccaagggaaggcgcataacggaagactgattacagctaatcccgtggttaccaaaaaggaggaacccgtgaacatcgaggccgaacctccgttcggcgagtccaatattgtcatcgggatcggcgataacgccctgaaaattaattggtataagaagggatctagcatcggcaaaatgtttgaagctacggccagaggggctagacgcatggccattcttggagacacagcgtgggatttcggctccgtcggcggggtgctcaacagcctggggaagatggttcaccagatctttgggtctgcctacaccgctctgttctccggcgtcagctgggtgatgaaaattggaatcggcgtgctcctgacctggattgggcttaattctaagaacacaagcatgtccttttcttgcatcgccatcggaattatcaccctgtatctcggcgctgtcgtgcaggccgacatggggtgtgttattaattggaaaggaaaggagctgaagtgcggcagcgggatcttcgtgacaaacgaggtccatacgtggaccgaacagtacaaatttcaagcggattcccccaagcggctggccacagctattgtgggcgcctgggagaatggagtttgtggcatcagaagcaccacacgcatggaaaaccttctctggaaacagatcgctaatgagctgaactatattctgtgggaaaataacatcaagctcaccgtggtcgtgggggacacgattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgcttccagagcgtggaacgtctgggaagtggaggactatggctttggcgtgttcaccacgaatatctggctcaaactgcgcgaagtctacacacagatgtgtgaccaccggctgatgagcgccgctgttaaggatgagagagccgtgcacgccgacatggggtactggattgagtcccagaaaaacggatcttggaaacttgaaaaagctagcctcatcgaggtgaagacctgcacctggcctaagtcccatacactgtggtctaatggcgtcctggaaagcgatatgattatccccaaatccctcgccgggcctattagccagcacaactatcgccccggataccatacccaaacggcgggcccttggcacctggggaaacttgagctggactttaattattgcgagggaacaaccgtggttatcacagaaaactgtggcacccggggcccctctctcagaacaaccacggtgtccgggaaactgatccacgagtggtgctgtcgcagctgcaccctgccgcctcttcggtacatgggagaagatggctgttggtatgggatggagattagacccatctctgaaaaggaggagaatatggtcaaatccctcgtgagcgctggatctggcaaggttgacaacttcacaatgggggtgctgtgcctggccattctctttgaagaggtcatgcggggaaagttcggcaaaaagcatatgatcgccggcgtgttctttaccttcgttctgcttctgagcgggcagattacatggcgcgatatggctcacaccctcatcatgattggatccaatgccagcgacagaatgggcatgggggtgacgtacctggcgctgatcgctacatttaaaatccagcccttccttgccctgggatttttcctccggaagctgacctctagagaaaacctcctgcttggcgtcgggctggccatggctacaaccctccaactgcctgaggatattgaacagatggccaatggaatcgctctgggccttatggccctgaaactcattacccagtttgagacatatcagctgtggacggcgctcatctccctgacctgtagcaacacaattttcacccttacagtggcctggcgcaccgctacgctgatcctcgccggcgtgtccctgctgccggtctgccaatctagctccatgcggaagacagactggcttcccatgaccgttgctgccatgggggtgcctcccctgcctctctttatcttctctctgaaggataccctcaaaagacgcagctggcccctgaatgagggagtgatggccgtcggccttgtgtccatgctggcttctagcctgctcagaaacgacgttcctatggcggggcccctggtggccggaggccttctgattgcttgttacgtcatcacagggacctccgccgatctcacagtggaaaaggccgctgacgttacgtgggaggaagaggccgaacagaccggagtgagccataacctgatgattacagtcgacgatgacggcaccatgcggatcaaagatgacgagacagagaatattctcaccgtgctgcttaagacggcgctgctgatcgtctctggcatctttccgtactccattcctgctaccctcctggtgtggcacacatggcagaaacagacccaacgcagcggggttctttgggatgtgccctctcctcccgaaacacagaaggccgagctggaagagggagtctatagaatcaaacagcagggcattctcgggaagacccaagtgggagttggcgtgcagaaggacggggtcttccatacaatgtggcacgtgacgcggggagccgtgctgacccacaacggcaaacgcctcgagccgaattgggcttccgttaagaaagatctgatcagctacggcgggggatggagactttctgcccagtggcaaaagggcgaagaggtccaggtgattgcggtggaacctgggaaaaaccccaagaattttcagacaatgcctggaaccttccagaccacaacgggcgagatcggggctattgccctggacttcaagcccggaacctccggcagccccatcatcaaccgggaaggcaaagtcgtggggctgtatggaaatggcgttgtgacaaagaacgggggatacgtctccggcattgcccaaaccaatgctgagcctgatgggccgacacccgagctcgaagaggaaatgtttaaaaagcgcaacctgaccatcatggaccttcatcctggcagcggaaaaacgagaaagtatctgcccgccattgtgcgggaggctatcaagcgcagactccggacactgattctcgcccctaccagagttgtggcggccgaaatggaggaggctctgaaaggccttcccatccgctaccagaccacagccaccaagtctgaacacacagggcgggagatcgtcgatctgatgtgccatgctaccttcacgatgagactgctcagccctgtgcgcgttccgaattataacctgattatcatggacgaagcccactttacagatcccgcctccattgctgcgcggggatacatctctaccagagtgggcatgggggaggccgctgccattttcatgacagccacccctcccggaacggctgacgcctttcctcagagcaatgcgcccatccaggacgaggaacgcgatatcccggagcggtcctggaactctggcaatgaatggattaccgacttcgctgggaaaacagtctggtttgtgcctagcatcaaggccggcaacgatattgccaactgtcttcgcaaaaatggaaagaaggtgatccaactgtccagaaaaaccttcgacacagagtaccagaagaccaaactcaacgattgggactttgtcgttacaaccgatatttctgaaatgggcgctaatttcaaggccgaccgggtgatcgatcccagacggtgcctgaaacccgtgattctgacggacgggcctgagcgcgtcatcctcgcgggacccatgcctgtgacagccgctagcgccgctcagagacggggccgcgttgggagaaacccgcagaaggagaatgatcaatatatctttaccggacagccccttaacaatgacgaagaccatgcccactggaccgaggctaagatgctgctggataacattaatacacctgaaggcatcattcccgccctcttcgagcctgaacgggagaaatccgcggccatcgacggggagtacagactgaagggcgaaagccgcaaaaccttcgtggagcttatgcggagaggagatctgcccgtctggctcgctcacaaggtggcctctgaaggcattaaatatacagaccgcaagtggtgctttgatgggcagcggaacaatcagatcctggaggaaaacatggacgttgagatctggacgaaagagggagaaaagaagaaactgagaccgcgctggctcgatgctcggacctactccgaccctcttgccctgaaggagttcaaagattttgccgctggcagaaagagcattgcgctggacctcgtgacagaaatcgggcgcgtcccctctcatctggcccacagaacccggaatgctcttgataacctggtgatgctccatacatccgagcacggaggccgcgcctatagacacgccgtcgaagaactccctgagaccatggaaacgctgctccttctgggcctgatgattctcctgaccgggggagctatgcttttcctgatcagcggcaaagggattggaaagacatccatcggcctcatctgtgtgattgcctctagcgggatgctgtggatggcggagatccccctgcaatggattgcctccgctatcgttctcgaatttttcatgatggtgcttctgattcctgagcccgagaagcagcggaccccgcaggacaatcaactggcctacgtggtcatcggcattctcacaatggctgccatcatcgcggccaacgaaatgggcctgcttgagaccacgaaacgcgatctgggcatgagcaaggaacctggggttgtgtctcccacatcctatctcgacgtggacctgcatcccgctagcgcctggaccctgtacgctgtcgccacaaccgtgattacccctatgctcagacacacaatcgaaaattctacggctaacgttagccttgccgcgattgccaaccaggctgtggtcctgatgggactggataaaggctggccgatctccaagatggacctcggggtgcccctgcttgccctgggatgctactctcaggtcaatcctctcaccctgacagctgccgtgctgctccttgttacccattatgccattatcggccccgggctgcaggcgaaagctacacgggaagcccaaaagagaaccgctgccggaatcatgaagaaccctacggtggatggcattatcacaattgacctggatcccgtcatctacgacagcaaatttgagaagcagctcggccaggtgatgctgcttgttctgtgtgccgtgcagctcctgctgatgcgcacctcctgggctctctgcgaggcccttaccctggcgacagggcctattaccacactgtgggaaggatctccgggcaaattctggaatacgaccatcgccgtcagcatggctaacatctttcgggggtcctatctcgccggagctggcctggccttcagcattatgaagtctgtggggacaggaaaaagaggcaccggctcccaaggggagacacttggagaaaagtggaagaaaaagctgaatcagctcagccgcaaagagtttgatctgtacaagaaatccggcatcaccgaagtggaccggacggaggcgaaggaggggctgaaaagaggagaaaccacacaccatgccgtttctcggggcagcgctaagctccagtggttcgtcgagcgcaacatggtgattcccgaagggagagtgatcgatcttggatgtggccggggcgggtggtcctattactgcgccggactgaagaaagtcaccgaggttcgcggctatacaaaagggggacctggccacgaggagcccgtgcctatgtctacctacgggtggaatattgtgaaactgatgagcggaaaggacgtcttttacctgcccccggagaaatgtgatacactgctttgcgacatcggcgaatccagcccttctcccaccgtggaggaatccagaacgattcgggttctgaagatggtggagccctggctcaagaacaatcagttctgtatcaaagtcctgaacccttatatgcccgctgtgatcgagcacctggaacgcctccaaagaaagcatggcgggatgcttgttcggaatcctctgagccgcaactctacacacgagatgtactggatttccaatggaaccggcaacatcgtgagctctgtcaatatggtgagcagactgctcctgaaccggttcaccatgacacatagacgcccgacgattgaaaaagatgtggaccttggggccggaacccggcacgtcaacgctgagcccgaaacacctaatatggacgttatcggcgagagaattaagcgcatcaaagaggaacacaactccacctggcattatgatgacgagaatccctacaagacatgggcctatcacgggtcttacgaagtgaaggcgaccggaagcgcctccagcatgatcaacggcgtggtcaaactgctcacaaagccttgggatgtggttcccatggtgacccagatggctatgacggacaccacaccgtttggccagcaacgggtcttcaaagagaaggtggataccagaacacctcgccccatgcctgggacccggaaagttatggaaattacggccgagtggctgtggagaacactgggacgcaataagcggcccagactctgcacccgcgaggaatttacaaagaaagtgcggaccaacgctgccatgggcgccgtcttcacggaggaaaatcagtgggactccgcgaaggctgccgtggaggatgaagagttttggaaactggttgacagagagcgcgaacttcataagctggggaaatgtggatcttgcgtgtataacatgatgggcaagagagagaaaaagctcggggagttcggcaaggccaaaggaagccgggctatctggtacatgtggctgggcgcccgctaccttgagtttgaggctctggggttcctcaatgaagatcactggttttccagagagaactcttatagcggagtcgaaggcgaggggctgcataagctgggatacattctccgggacatctccaaaattcctggcggggccatgtatgcggatgacaccgccggctgggacacaagaatcaccgaagatgacctgcacaatgaggagaagatcacacagcggatggatcccgaacaccgccttctggctaacgccattttcaaactcacctaccagaataaggtggtcaaggtgcaaagaccgacacctaccggaacggttatggacatcatttctcggaaagatcagcgcggcagcggacaggtgggaacatatggcctgaacacctttaccaatatggaggctcagcttgtcagacaaatggaaggggagggagtgctgtccaagacagacctcgaaaacccccatctgcccgagaaaaagatcacccagtggctggagacaaaaggcgtggaacggctcaagcgcatggccattagcggggatgactgcgttgtgaagcctatcgatgacagattcgcgaacgccctgcttgctctgaatgatatgggcaaagtccggaaggacatcccgcagtggcagccctctaaaggatggcacgattggcaacaggtgcctttttgttcccatcacttccacgagctcattatgaaggacggccgcaaactggttgtgccctgcagacctcaggacgaacttatcgggcgggcccgcattagccagggagctggctggtctctgagagagacggcctgtctcgggaaggcttacgcccaaatgtggtccctgatgtatttccatcggcgcgatctgagactcgcgagcaacgccatctgctctgctattcccgtccactgggtgcctacctcccggacaacctggagcatccatgcccaccatcagtggatgacaaccgaagacatgctgacggtctggaatagagtgtggattgaggataacccctggatggaggacaagaccccgatcacaacctgggaaaatgttccttaccttggaaaacgcgaggatcagtggtgtggctccctgatcgggctcacaagccgggccacctgggctcaaaacattcccacggccatccaacaggtgagatctctgattggcaatgaagagtttcttgactacatgcctagcatgaagcgcttccggaaagaggaagagtccgaaggagcgatctggtga

SEQ ID NO: 20360 - RNA, 9873 nt, synthetic construct
  misc_feature 1..9873: note = derived and/or modified CDS sequence (opt5) from DENV-3__KF954945__SS-prME
  source 1..9873: mol_type = other RNA
acaagcctgtgcctcatgatgatcctgcccgccgctcttgccttccacctgacgtcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccatccttcgcaaactgtgtattgagggaaagatcaccaacattacaaccgattccagatgccctacgcagggcgaagcggtgctcccggaggaacaggaccagaattatgtgtgtaaacacacatacgtcgatcggggctgggggaacggatgcggcctgttcgggaagggaagccttgtgacctgcgccaagtttcagtgtctggagcccatcgagggcaaagttgtgcagtatgaaaatctcaagtacaccgtcatcattacagtgcataccggggaccagcaccaggttggaaacgagacacaaggcatcacggctgaaattacccctcaggcctctacaaccgaggctatcctgcccgaatatggcacactggggctcgagtgctcccctcgcaccggactggacttcaatgagatgattcttctgacgatgaaaaacaaggcctggatggtgcatagacagtggtttttcgatctccccctgccgtggaccagcggcgccacaaccgaaacacctacctggaatcggaaagagcttctggtcacgtttaagaacgctcacgcgaaaaagcaagaagtggtcgtgctcgggtctcaggagggagccatgcacacagctctgaccggcgccacagaaatccaaaattccgggggcaccagcatcttcgccggacatctgaagtgtcgcctcaaaatggacaagctggagcttaaaggcatgtcttacgctatgtgcaccaacacatttgttctgaagaaagaggtgtccgaaacgcagcacgggaccattctcatcaaggtcgagtacaagggagaagatgccccctgtaaaattcctttcagcacagaggacggccaagggaaggcgcataacggaagactgatcaccgctaatcccgtggttaccaagaaggaggaacccgtgaacattgaggccgaacctccgttcggcgagtccaatatcgtcatcgggattggcgataacgccctgaaaatcaattggtataagaagggatctagcattggcaaaatgtttgaagctaccgccagaggggctagacgcatggccatccttggagacacggcgtgggatttcggctccgtcggcggggtgctcaacagcctggggaagatggttcaccagatttttgggtctgcctacacagctctgttctccggcgtcagctgggtgatgaaaatcggaattggcgtgctcctgacctggatcgggcttaattctaagaacaccagcatgtccttttcttgcatcgccattggaatcattacactgtatctcggcgctgtcgtgcaggccgacatggggtgtgttatcaattggaaaggaaaggagctgaagtgcggcagcgggattttcgtgaccaacgaggtccatacatggacggaacagtacaaatttcaagcggattcccccaagcggctggccaccgctatcgtgggcgcctgggagaatggagtttgtggcatcagaagcacaacccgcatggaaaaccttctctggaaacagattgctaatgagctgaactatatcctgtgggaaaataacattaagctcacagtggtcgtgggggacaccatcggagttctggagcagggcaaacggacgcttacccctcagcccatggagctgaagtactcttggaaaacatgggggaaggccaagattgtgaccgccgaaacacaaaactccagcttcatcatcgatggacctaatacccccgagtgcccgtctgcttccagagcgtggaacgtctgggaagtggaggactatggctttggcgtgttcacaaccaatatttggctcaaactgcgcgaagtctacacgcagatgtgtgaccaccggctgatgagcgccgctgttaaggatgagagagccgtgcacgccgacatggggtactggatcgagtcccagaaaaacggatcttggaaacttgaaaaagctagcctcattgaggtgaagacatgcacctggcctaagtcccataccctgtggtctaatggcgtcctggaaagcgatatgatcattcccaaatccctcgccgggcctatcagccagcacaactatcgccccggataccatacacaaaccgcgggcccttggcacctggggaaacttgagctggactttaattattgcgagggaacgacagtggttatcaccgaaaactgtggcacacggggcccctctctcagaaccacaaccgtgtccgggaaactgattcacgagtggtgctgtcgcagctgcacgctgccgcctcttcggtacatgggagaagatggctgttggtatgggatggagatcagacccatttctgaaaaggaggagaatatggtcaaatccctcgtgagcgctggatctggcaaggttgacaacttcaccatgggggtgctgtgcctggccatcctctttgaagaggtcatgcggggaaagttcggcaaaaagcatatgattgccggcgtgttctttacattcgttctgcttctgagcgggcagatcacctggcgcgatatggctcacacactcattatgatcggatccaatgccagcgacagaatgggcatgggggtgacctacctggcgctgatcgctacgtttaaaattcagcccttccttgccctgggatttttcctccggaagctgacatctagagaaaacctcctgcttggcgtcgggctggccatggctaccacactccaactgcctgaggatatcgaacagatggccaatggaattgctctgggccttatggccctgaaactcatcacccagtttgagacctatcagctgtggacagcgctcatttccctgacgtgtagcaacaccatcttcacacttaccgtggcctggcgcacagctaccctgatcctcgccggcgtgtccctgctgccggtctgccaatctagctccatgcggaagacggactggcttcccatgacagttgctgccatgggggtgcctcccctgcctctctttattttctctctgaaggataccctcaaaagacgcagctggcccctgaatgagggagtgatggccgtcggccttgtgtccatgctggcttctagcctgctcagaaacgacgttcctatggcggggcccctggtggccggaggccttctgatcgcttgttacgtcattaccgggacatccgccgatctcaccgtggaaaaggccgctgacgttacatgggaggaagaggccgaacagacgggagtgagccataacctgatgatcaccgtcgacgatgacggcacaatgcggattaaagatgacgagaccgagaatatcctcacagtgctgcttaagaccgcgctgctgatcgtctctggcatttttccgtactccatccctgctacgctcctggtgtggcacacctggcagaaacagacacaacgcagcggggttctttgggatgtgccctctcctcccgaaacccagaaggccgagctggaagagggagtctatagaattaaacagcagggcatcctcgggaagacacaagtgggagttggcgtgcagaaggacggggtcttccataccatgtggcacgtgacacggggagccgtgctgacgcacaacggcaaacgcctcgagccgaattgggcttccgttaagaaagatctgattagctacggcgggggatggagactttctgcccagtggcaaaagggcgaagaggtccaggtgatcgcggtggaacctgggaaaaaccccaagaattttcagaccatgcctggaacattccagaccaccacaggcgagattggggctatcgccctggacttcaagcccggaacgtccggcagccccatcattaaccgggaaggcaaagtcgtggggctgtatggaaatggcgttgtgaccaagaacgggggatacgtctccggcatcgcccaaacaaatgctgagcctgatgggccgacccccgagctcgaagaggaaatgtttaaaaagcgcaacctgacaattatggaccttcatcctggcagcggaaaaaccagaaagtatctgcccgccatcgtgcgggaggctattaagcgcagactccggacgctgatcctcgcccctacaagagttgtggcggccgaaatggaggaggctctgaaaggccttcccatccgctaccagaccaccgccacaaagtctgaacacaccgggcgggagattgtcgatctgatgtgccatgctacattcaccatgagactgctcagccctgtgcgcgttccgaattataacctgatcattatggacgaagcccactttacggatcccgcctccatcgctgcgcggggatacatttctacaagagtgggcatgggggaggccgctgccatcttcatgaccgccacacctcccggaaccgctgacgcctttcctcagagcaatgcgcccatccaggacgaggaacgcgatattccggagcggtcctggaactctggcaatgaatggatcacggacttcgctgggaaaaccgtctggtttgtgcctagcattaaggccggcaacgatatcgccaactgtcttcgcaaaaatggaaagaaggtgattcaactgtccagaaaaacattcgacaccgagtaccagaagacaaaactcaacgattgggactttgtcgttaccacagatatctctgaaatgggcgctaatttcaaggccgaccgggtgattgatcccagacggtgcctgaaacccgtgatcctgaccgacgggcctgagcgcgtcatcctcgcgggacccatgcctgtgacggccgctagcgccgctcagagacggggccgcgttgggagaaacccgcagaaggagaatgatcaatatatttttacaggacagccccttaacaatgacgaagaccatgcccactggaccgaggctaagatgctgctggataacatcaatacccctgaaggcattatccccgccctcttcgagcctgaacgggagaaatccgcggccattgacggggagtacagactgaagggcgaaagccgcaaaacattcgtggagcttatgcggagaggagatctgcccgtctggctcgctcacaaggtggcctctgaaggcatcaaatataccgaccgcaagtggtgctttgatgggcagcggaacaatcagatcctggaggaaaacatggacgttgagatttggacaaaagagggagaaaagaagaaactgagaccgcgctggctcgatgctcggacgtactccgaccctcttgccctgaaggagttcaaagattttgccgctggcagaaagagcatcgcgctggacctcgtgaccgaaattgggcgcgtcccctctcatctggcccacagaacacggaatgctcttgataacctggtgatgctccatacctccgagcacggaggccgcgcctatagacacgccgtcgaagaactccctgagacaatggaaaccctgctccttctgggcctgatgatcctcctgacagggggagctatgcttttcctgattagcggcaaagggatcggaaagacctccatcggcctcatttgtgtgatcgcctctagcgggatgctgtggatggcggagattcccctgcaatggatcgcctccgctattgttctcgaatttttcatgatggtgcttctgatccctgagcccgagaagcagcggacaccgcaggacaatcaactggcctacgtggtcattggaatcctcaccatggctgccatcattgcggccaacgaaatgggcctgcttgagacaaccaaacgcgatctgggcatgagcaaggaacctggggttgtgtctcccacgtcctatctcgacgtggacctgcatcccgctagcgcctggacactgtacgctgtcgccaccacagtgatcacccctatgctcagacacaccattgaaaattctacagctaacgttagccttgccgcgatcgccaaccaggctgtggtcctgatgggactggataaaggctggccgatttccaagatggacctcggggtgcccctgcttgccctgggatgctactctcaggtcaatcctctcacgctgaccgctgccgtgctgctccttgttacacattatgccatcatcggccccgggctgcaggcgaaagctacccgggaagcccaaaagagaacagctgccggaattatgaagaaccctaccgtggatggcatcattacgatcgacctggatcccgtcatttacgacagcaaatttgagaagcagctcggccaggtgatgctgcttgttctgtgtgccgtgcagctcctgctgatgcgcacatcctgggctctctgcgaggcccttaccctggcgaccgggcctatcacaaccctgtgggaaggatctccgggcaaattctggaatacaacgatcgccgtcagcatggctaacatttttcgggggtcctatctcgccggagctggcctggccttcagcatcatgaagtctgtggggaccggaaaaagaggcacaggctcccaaggggagacccttggagaaaagtggaagaaaaagctgaatcagctcagccgcaaagagtttgatctgtacaagaaatccggcattacagaagtggaccggaccgaggcgaaggaggggctgaaaagaggagaaacgacccaccatgccgtttctcggggcagcgctaagctccagtggttcgtcgagcgcaacatggtgatccccgaagggagagtgattgatcttggatgtggccggggcgggtggtcctattactgcgccggactgaagaaagtcacagaggttcgcggctataccaaagggggacctggccacgaggagcccgtgcctatgtctacatacgggtggaatatcgtgaaactgatgagcggaaaggacgtcttttacctgcccccggagaaatgtgataccctgctttgcgacattggcgaatccagcccttctcccacagtggaggaatccagaaccatccgggttctgaagatggtggagccctggctcaagaacaatcagttctgtatcaaagtcctgaacccttatatgcccgctgtgattgagcacctggaacgcctccaaagaaagcatggcgggatgcttgttcggaatcctctgagccgcaactctacgcacgagatgtactggatctccaatggaacaggcaacattgtgagctctgtcaatatggtgagcagactgctcctgaaccggttcaccatgacccatagacgcccgacaatcgaaaaagatgtggaccttggggccggaacgcggcacgtcaacgctgagcccgaaacccctaatatggacgttattggcgagagaatcaagcgcatcaaagaggaacacaactccacatggcattatgatgacgagaatccctacaagacctgggcctatcacgggtcttacgaagtgaaggcgacaggaagcgcctccagcatgattaacggcgtggtcaaactgctcaccaagccttgggatgtggttcccatggtgacacagatggctatgaccgacacgaccccgtttggccagcaacgggtcttcaaagagaaggtggatacaagaacccctcgccccatgcctgggacacggaaagttatggaaatcaccgccgagtggctgtggagaacgctgggacgcaataagcggcccagactctgcacacgcgaggaatttaccaagaaagtgcggacaaacgctgccatgggcgccgtcttcaccgaggaaaatcagtgggactccgcgaaggctgccgtggaggatgaagagttttggaaactggttgacagagagcgcgaacttcataagctggggaaatgtggatcttgcgtgtataacatgatgggcaagagagagaaaaagctcggggagttcggcaaggccaaaggaagccgggctatttggtacatgtggctgggcgcccgctaccttgagtttgaggctctggggttcctcaatgaagatcactggttttccagagagaactcttatagcggagtcgaaggcgaggggctgcataagctgggatacatcctccgggacatttccaaaatccctggcggggccatgtatgcggatgacacggccggctgggacaccagaatcacagaagatgacctgcacaatgaggagaagattacccagcagatggatcccgaacaccggcttctggctaacgccatcttcaaactcacataccaaaataaggtggtcaaggtgcagcgcccgacccctacaggaaccgttatggacattatctctagaaaagatcagcggggcagcggacaggtgggaacgtatggcctgaacacatttaccaatatggaggctcaacttgtccgccagatggaaggggagggagtgctgtccaagaccgacctcgaaaacccccatctgcccgagaaaaagattacacagtggctggagaccaaaggcgtggaaagactcaagcggatggccatcagcggggatgactgcgttgtgaagcctatcgatgaccgcttcgcgaacgccctgcttgctctgaatgatatgggcaaagtcagaaaggacattccgcagtggcaaccctctaaaggatggcacgattggcaacaggtgcctttttgttcccatcacttccacgagctcatcatgaaggacggccggaaactggttgtgccctgccgccctcaggacgaacttattgggagagcccggatcagccaaggagctggctggtctctgcgcgagacagcctgtctcgggaaggcttacgcccagatgtggtccctgatgtatttccatagacgggatctgcgcctcgcgagcaacgccatttgctctgctatccccgtccactgggtgcctacgtccagaaccacatggagcattcatgcccaccatcagtggatgaccacagaagacatgctgaccgtctggaatcgggtgtggatcgaggataacccctggatggaggacaagacgccgatcaccacatgggaaaatgttccttaccttggaaaaagagaggatcaatggtgtggctccctgattgggctcaccagccgcgccacatgggctcagaacatccccaccgccattcaacaggtgcggtctctgatcggcaatgaagagtttcttgactacatgcctagcatgaagagattccgcaaagaggaagagtccgaaggagcgatttggtga

SEQ ID NO: 20361 - RNA, 9873 nt, synthetic construct
  misc_feature 1..9873: note = derived and/or modified CDS sequence (opt5) from DENV-3__JX669495__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtacaagggagaagatgccccctgtaaaattcctttcagcaccgaggacggccaagggaaggcgcacaacggacggctgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctcgccggatggccatccttggagacacagcgtgggatttcggctccgtggggggagttctcaacagcctgggcaagatggtccatcagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcacacgtggaccgaacagtacaaatttcaagcggattcccccaagagactggccacagctatcgccggcgcttgggagaatggagtttgtggcattcgcagcaccacacggatggaaaaccttctctggaaacagatcgccaatgagctgaactatatcctgtgggaaaataacattaagctcaccgtggtcgtgggggacatcattggagttctggagcagggcaaaagaacgcttacccctcagcccatggagctgaagtactcttggaaaacatgggggaaggccaagatcgtgaccgctgaaacacaaaactccagcttcattatcgatggacctaatacccccgagtgcccgtctgcgtcccgcgcctggaacgtctgggaagtggaggactatggctttggcgtgttcacaaccaatatctggctcaaactgcgggaagtctacacgcagctgtgtgaccatagacttatgagcgctgccgttaaggatgagcgcgccgtgcacgctgacatggggtactggattgagtcccagaaaaacggatcttggaagctcgaaaaagccagcctgatcgaggtgaagacatgcacctggcctaagtcccacaccctgtggtctaatggcgtcctcgaaagcgatatgattatccccaaatccctggcggggcctattagccagcataaccaccggcccggatatcatacacaaaccgctggcccttggcaccttgggaagctggagctcgactttaattactgcgagggaacgacagtggttatcaccgaaaactgtggcacaagaggcccctctctgcgcaccacaaccgtgtccgggaaactgatccacgagtggtgctgtcggagctgcacgcttccgcctctcagatatatgggagaagatggctgttggtacgggatggagattcggcccatctctgaaaaggaggagaatatggtcaaatccctggtgagcgccggatctggcaaggttgacaacttcaccatgggggtgctgtgcctcgccattctgtttgaagaggtcatgcgcggaaagttcggcaaaaagcatatgatcgctggcgtgttctttacattcgttcttctgctcagcgggcagattacctggagagatatggcccacacactgatcatgattggatccaatgcgagcgaccggatgggcatgggggtgacctatctggctcttatcgccacgtttaaaatccagcccttcctggccctcggatttttcctgagaaagctcacatctcgcgaaaacctgcttctgggcgtcgggctcgctatggccaccacactgcaactgcctgaggatattgaacagatggctaatggaatcgcccttggcctgatggcgctcaaactgattacccagtttgagacctaccagctctggacagccctgatctcccttacgtgtagcaacaccatgttcacactgaccgtggcttggcggacagccaccctcattctggctggcgtgtccctgcttccggtctgccaatctagctccatgagaaagacggactggctgcccatggccgttgccgctatgggggtgcctcccctccctctgtttatcttctctctcaaggatacactgaaacgcagaagctggccccttaatgagggagtgatggcggtcggcctggtgtccatcctggcctctagcctcctgcggaacgacgttcctatggctgggccccttgtggccggaggcctgctcattgcctgttatgtcatcaccgggacctccgctgatctgacagtggaaaaggccgcggacattacctgggaggaagaggctgaacagacaggagttagccataacctcatgatcacggtggacgatgacggcaccatgcgcattaaagatgacgagacagagaatatcctgaccgtccttctgaagacagccctgctcatcgtgtctggcgtctttccgtactccattcctgccaccctgcttgtgtggcacacgtggcagaaacagacccaaagaagcggggttctgtgggatgtgccctctcctcccgaaacacagaaggctgagctcgaagagggagtctaccggatcaaacagcagggcattttcgggaagacccaagtgggagttggcgtgcagaaggagggggtctttcatacaatgtggcacgtgacccgcggagccgtgctgacatataacggcaaaagactcgaaccgaattgggcgtccgttaagaaagacctgatcagctacggcgggggatggcggctttctgctcagtggcaaaagggcgaggaagtccaggtgattgccgtggagcctgggaaaaaccccaagaatttccagacgatgcctggaaccttccagacaaccaccggcgaaatcggggccattgctctggattttaagcccggaacatccggcagccccatcatcaaccgcgagggcaaagtcgtggggctgtatggaaatggcgttgtgacgaagaacgggggatacgtctccggcattgcccaaaccaatgctgagcctgacgggccgacacccgaactcgaggaagagatgttcaaaaagagaaacctgaccatcatggatcttcaccctggcagcggaaaaacacggaagtatctgcccgccattgtgcgcgaagcgatcaagagacggctcagaaccctgattctcgcccctacgcgcgttgtggctgccgagatggaggaagctctgaaaggccttcccatccggtaccagacaaccgccaccaagtctgagcatacagggagagaaatcgtcgacctgatgtgccacgccacctttacaatgcgcctgctcagccctgtgcgggttccgaattataacctgattatcatggatgaggctcatttcaccgaccccgcgtccattgccgctagaggatacatctctacgcgcgtgggcatgggggaagccgccgctatttttatgacagccacccctcccggaacagcggatgctttccctcagagcaatgcccccatccaggacgaggagcgggacatcccggaaagatcctggaactctggcaatgagtggattaccgattttgccgggaaaacggtctggttcgtgcctagcatcaaggctggcaacgacattgccaactgtcttcgcaaaaatggaaagaaggtgatccaactgtcccggaaaacctttgatacagaataccagaagaccaaactcaacgactgggatttcgtcgttacaaccgacatttctgagatgggcgcgaattttaaggccgatagagtgatcgacccccggcgctgcctgaaacccgtgattctgacagatgggcctgagagagtcatcctcgctggacccatgcctgtgaccgccgctagcgccgctcagcggcgcggcagagttgggcggaacccgcagaaggaaaatgaccaatatatcttcacgggacagccccttaacaatgatgaggaccacgcccattggacagaagcgaagatgctgctggacaacattaatacccctgagggcatcattcccgccctcttcgaacctgagagagagaaatccgctgccatcgatggggaataccgcctgaagggcgagagccggaaaacctttgtggaacttatgagacgcggagacctgcccgtctggctcgctcacaaggtggcctctgagggcattaaatatacagatcggaagtggtgcttcgacgggcagagaaacaatcagatcctggaagagaacatggatgttgagatctggaccaaagaaggagagaagaagaaactgcgcccgcggtggctcgacgccagaacatactccgatcctcttgctctgaaggaatttaaagacttcgcggccggccgcaagagcattgctctggatctcgtgacggagatcgggagagtcccctctcacctggcccatcggacccgcaatgcccttgacaacctggtgatgctccacacatccgaacatggaggcagagcttatcggcacgccgtcgaggagctgcctgaaaccatggagacactgctccttctgggcctgatgattctcctgaccgggggagcgatgctttttctgatcagcggcaaagggattggaaagacgtccatcggcctcatctgtgtgattgcctctagcgggatgctgtggatggctgaaatccccctgcaatggattgcctccgctatcgttctcgagttctttatgatggtgcttctgattcctgagcccgaaaagcagcgcaccccgcaggataatcaactggcctacgtggtcatcggaattctcacactggcggccatcatcgctgccaacgagatgggccttctggaaaccacaaaaagagacctcggcatgagcaaggagcctggggttgtgtctcccacctcctatctggatgtggacctgcaccccgctagcgcctggacgctctacgctgtcgccacaaccgtgattacacctatgcttcggcataccatcgaaaattctaccgcgaacgttagcctggccgctattgccaaccaggctgtggtcctgatgggactcgacaaaggctggccgatctccaagatggatctgggggtgccccttctggccctcggatgctactctcaggtcaatcctctgacactgacggccgcggtgctccttctgattacccactatgctatcatcggccccgggctgcaggccaaagctacaagagaggcccaaaagcgcaccgccgctggaattatgaagaaccctacagttgacggcatcatgaccattgatctcgaccccgtgatctacgatagcaaattcgagaagcagctgggccaggtcatgcttctggtgctctgtgccgttcagctgctgctcatgcggacgtcctgggcgctttgcgaagccctgacactggctaccgggcctattaccacactctgggagggatctccgggcaaattttggaataccacaatcgccgtgagcatggctaacatcttcagagggtcctatctggccggagcgggccttgcctttagcattatgaagtctgtcgggacgggaaaacgcggcaccggctcccaaggggaaacactgggagagaagtggaagaaaaagctcaatcagctgagccggaaagaattcgacctgtacaagaaatccggcatcaccgaggtggatagaacagaggctaaggaagggctcaaacggggagagattacccatcacgccgtgtctcgcggcagcgctaagcttcagtggtttgttgaaagaaacatggtcatccccgaggggcgggtgattgacctgggatgtggccgcggcgggtggtcctattactgcgccggactgaagaaagtgacggaagtcagaggctataccaaggggggacctggccatgaggagcccgttcctatgtctacatacgggtggaatatcgtgaaactcatgagcggaaaggatgtgttctacctgcccccggaaaaatgtgacacccttctgtgcgatattggcgagtccagcccttctcccacagtcgaagagtcccggaccatccgcgtgctcaagatggttgagccctggctgaagaacaatcagttctgtatcaaagtgctgaacccttatatgcccacagtcattgaacacctcgagagacttcaacggaagcacggcgggatgctggtgcgcaatcctctgagcagaaactctacccatgaaatgtactggatctccaatggaacgggcaacattgttgctagcgtgaatatggtctctcggctcctgcttaacagatttacaatgacccaccgccggccgaccatcgagaaagacgtggatctgggggccggaacaagacatgtgaacgcggaacccgagacgcctaatatggacgtcattggcgagcgcatcaagcggatcaaagaagagcacaacagcacctggcactatgacgatgaaaatccctacaagacatgggcctatcatgggtcctacgaggttaaggctaccggatctgccagctccatgattaacggcgtggtgaaactcctgacaaagccttgggacgtcgtgcccatggttacccagatggctatgacagataccacgccgttcggccagcaaagagtgtttaaagaaaaggtcgacacccgcacacctcggagcatgcccgggaccagacgcgtgatgggaatcacagccgagtggctgtggcggaccctcggcagaaataaaaagcctcgcctgtgcacgcgggaggaattcacaaagaaagttagaaccaacgccgcgatgggggctgtgtttacagaggaaaatcagtgggattccgccaaggccgctgtcgaggacgaagatttctggaaacttgtggaccgcgagagagagctgcacaagctcggaaaatgtggctcttgcgtttataacatgatggggaagcgggaaaaaaagctgggcgagtttggaaaggccaaaggcagccgcgctatttggtacatgtggcttggggccagatacctggaattcgaggcgctcggatttctgaatgaggatcattggttctcccgggaaaactcttatagcggcgtggagggggaaggactgcacaagctcggctacatcctgagagacatttccaaaatccccgggggcgccatgtatgctgatgacaccgccggatgggacacgcggatcaccgaggatgaccttcataatgaagagaagattacacagcagatggatcctgagcaccgccaactggctaacgccatctttaaactcacctaccagaataaggtcgtgaaggtccagagacccacaccgaccggcacagtgatggacattatctctcggaaagatcagcgcgggagcggacaagttggcacctatgggctgaacacgttcacaaatatggaagcgcagcttattagacagatggagggagaaggcgtgctgtccaaggccgacctcgagaaccctcacctgcccgaaaaaaaggtcacccagtggctggagaccaaaggggtggagcggctcaagcgcatggctatcagcggcgatgactgcgtggttaagcccatcgatgacagatttgccaacgctctgcttgccctgaatgatatgggaaaagtgcggaaggacattcctcaatggcagccgtctaaaggctggcatgattggcagcaggtccccttctgttcccaccatttccacgaactcatcatgaaggacgggcgcaaactggtggttccttgcagaccccaagacgagcttattggacgggctcgcatcagccagggcgccgggtggtctctgagagaaacagcgtgtctcggaaaggcctacgctcagatgtggtccctgatgtattttcaccggcgcgatctgagactcgccagcaacgccatttgctctgctgtgcctgtccattgggtgcccacctcccggacaacgtggagcatccacgcccatcaccaatggatgaccacagaggacatgctgaccgtctggaatagagtgtggattgaagataacccttggatggaggacaagacacccgttaccacgtgggagaatgtgccgtaccttggcaaacgcgaagatcagtggtgtgggtccctgatcggcctcaccagccgggcgacatgggctcagaacatccctaccgccattcagcaagtcagatctctgatcggaaatgaggaattccttgactacatgcccagcatgaagcgctttcggaaagaggaggaatccgagggcgccatttggtga

SEQ ID NO: 20362 - RNA, 9873 nt, synthetic construct
  misc_feature 1..9873: note = derived and/or modified CDS sequence (opt5) from DENV-3__JX669499__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtacaagggagaagatgccccctgtaaaattcctttcagcaccgaggacggccaagggaaggcgcacaacggacggctgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctcgccggatggccatccttggagacacagcgtgggatttcggctccgtggggggagttctcaacagcctgggcaagatggtccatcagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcacacgtggaccgaacagtacaaatttcaagcggattcccccaagagactggccacagctatcgccggcgcttgggagaatggagtttgtggcattcgcagcaccacacggatggaaaaccttctctggaaacagatcgccaatgagctgaactatatcctgtgggaaaataacattaagctcaccgtggtcgtgggggacatcattggagttctggagcagggcaaaagaacgcttacccctcagcccatggagctgaagtactcttggaaaacatgggggaaggccaagatcgtgaccgctgaaacacaaaactccagcttcattatcgatggacctaatacccccgagtgcccgtctgcgtcccgcgcctggaacgtctgggaagtggaggactatggctttggcgtgttcacaaccaatatctggctcaaactgcgggaagtctacacgcagctgtgtgaccatagacttatgagcgctgccgttaaggatgagcgcgccgtgcacgctgacatggggtactggattgagtcccagaaaaacggatcttggaagctcgaaaaagccagcctgatcgaggtgaagacatgcacctggcctaagtcccacaccctgtggtctaatggcgtcctcgaaagcgatatgattatccccaaatccctggcggggcctattagccagcataaccaccggcccggatatcatacacaaaccgctggcccttggcaccttgggaagctggagctcgactttaattactgcgagggaacgacagtggttatcaccgaaaactgtggcacaagaggcccctctctgcgcaccacaaccgtgtccgggaaactgatccacgagtggtgctgtcggagctgcacgcttccgcctctcagatatatgggagaagatggctgttggtacgggatggagattcggcccatctctgaaaaggaggagaatatggtcaaatccctggtgagcgccggatctggcaaggttgacaacttcaccatgggggtgctgtgcctcgccattctgtttgaagaggtcatgcgcggaaagttcggcaaaaagcatatgatcgctggcgtgttctttacattcgttcttctgctcagcgggcagattacctggagagatatggcccacacactgatcatgattggatccaatgcgagcgaccggatgggcatggggatcacctatctggctcttatcgccacgtttaaaattcagcccttcctggccctcggatttttcctgagaaagctcacatctcgcgaaaacctgcttctgggcgtggggctcgctatggccaccacactgcaactgcctgaggatatcgaacagatggctaatggaattgcccttggcctgatggcgctcaaactgatcacccagtttgagacctaccagctctggacagccctgatttcccttacgtgtagcaacaccatgttcacactgaccgtcgcttggcggacagccaccctcatcctggctggcgtgtccctgcttccggtgtgccaatctagctccatgagaaagacggactggctgcccatggccgtcgccgctatgggggttcctcccctccctctgtttatcttctctctcaaggatacactgaaacgcagaagctggccccttaatgagggagtgatggcggtgggcctggtctccattctggcctctagcctcctgcggaacgacgtgcctatggctgggccccttgttgccggaggcctgctcatcgcctgttatgtgattaccgggacctccgctgatctgacagtcgaaaaggccgcggacatcacctgggaggaagaggctgaacagacaggagtgagccataacctcatgattacggttgacgatgacggcaccatgcgcatcaaagatgacgagacagagaatatcctgaccgtgcttctgaagacagccctgctcattgtctctggcgtgtttccgtactccatccctgccaccctgcttgtctggcacacgtggcagaaacagacccaaagaagcggggtgctgtgggatgttccctctcctcccgaaacacagaaggctgagctcgaagagggagtgtaccggattaaacagcagggcatcttcgggaagacccaagtcggagtgggcgttcagaaggagggggtgtttcatacaatgtggcacgtcacccgcggagccgtgctgacatataacggcaaaagactcgaaccgaattgggcgtccgtgaagaaagacctgattagctacggcgggggatggcggctttctgctcagtggcaaaagggcgaggaagttcaggtcatcgccgtggagcctgggaaaaaccccaagaatttccagacgatgcctggaaccttccagacaaccaccggcgaaattggggccatcgctctggattttaagcccggaacatccggcagccccatcattaaccgcgagggcaaagtggtcgggctgtatggaaatggcgtggttacgaagaacgggggatacgtgtccggcatcgcccaaaccaatgctgagcctgacgggccgacacccgaactcgaggaagagatgttcaaaaagagaaacctgaccattatggatcttcaccctggcagcggaaaaacacggaagtatctgcccgccatcgtccgcgaagcgattaagagacggctcagaaccctgatcctcgcccctacgcgcgtggttgctgccgagatggaggaagctctgaaaggccttcccatccggtaccagacaaccgccaccaagtctgagcatacagggagagaaattgtggacctgatgtgccacgccacctttacaatgcgcctgctcagccctgtccgggtgccgaattataacctgatcattatggatgaggctcatttcaccgaccccgcgtccatcgccgctagaggatacatttctacgcgcgttggcatgggggaagccgccgctatctttatgacagccacccctcccggaacagcggatgctttccctcagagcaatgcccccatccaggacgaggagcgggacattccggaaagatcctggaactctggcaatgagtggatcaccgattttgccgggaaaacggtgtggttcgtccctagcattaaggctggcaacgacatcgccaactgtcttcgcaaaaatggaaagaaggtgattcaactgtcccggaaaacctttgatacagaataccagaagaccaaactcaacgactgggatttcgtggtcacaaccgacatctctgagatgggcgcgaattttaaggccgatagagttattgacccccggcgctgcctgaaacccgtgatcctgacagatgggcctgagagagtgatcctcgctggacccatgcctgtcaccgccgctagcgccgctcagcggcgcggcagagtggggcggaacccgcagaaggaaaatgaccaatatattttcacgggacagccccttaacaatgatgaggaccacgcccattggacagaagcgaagatgctgctggacaacatcaatacccctgagggcattatccccgccctcttcgaacctgagagagagaaatccgctgccattgatggggaataccgcctgaagggcgagagccggaaaacctttgttgaacttatgagacgcggagacctgcccgtgtggctcgctcacaaggtcgcctctgagggcatcaaatatacagatcggaagtggtgcttcgacgggcagagaaacaatcagatcctggaagagaacatggatgtggagatttggaccaaagaaggagagaagaagaaactgcgcccgcggtggctcgacgccagaacatactccgatcctcttgctctgaaggaatttaaagacttcgcggccggccgcaagagcatcgctctggatctcgttacggagattgggagagtgccctctcacctggcccatcggacccgcaatgcccttgacaacctggtcatgctccacacatccgaacatggaggcagagcttatcggcacgccgtggaggagctgcctgaaaccatggagacactgctccttctgggcctgatgatcctcctgaccgggggagcgatgctttttctgattagcggcaaagggatcggaaagacgtccatcggcctcatttgtgtcatcgcctctagcgggatgctgtggatggctgaaattcccctgcaatggatcgcctccgctattgtgctcgagttctttatgatggttcttctgatccctgagcccgaaaagcagcgcaccccgcaggataatcaactggcctacgtggtgattggaatcctcacactggcggccatcattgctgccaacgagatgggccttctggaaaccacaaaaagagacctcggcatgagcaaggagcctggggtcgtttctcccacctcctatctggatgtggacctgcaccccgctagcgcctggacgctctacgctgtggccacaaccgtcatcacacctatgcttcggcataccattgaaaattctaccgcgaacgtgagcctggccgctatcgccaaccaggctgttgtgctgatgggactcgacaaaggctggccgatttccaagatggatctgggggtcccccttctggccctcggatgctactctcaggtgaatcctctgacactgacggccgcggtcctccttctgatcacccactatgctatcattggccccgggctgcaggccaaagctacaagagaggcccaaaagcgcaccgccgctggaatcatgaagaaccctacagtggacggcattatgaccatcgatctcgaccccgttatttacgatagcaaattcgagaagcagctgggccaggtgatgcttctggtcctctgtgccgtgcagctgctgctcatgcggacgtcctgggcgctttgcgaagccctgacactggctaccgggcctatcaccacactctgggagggatctccgggcaaattttggaataccacaatcgccgttagcatggctaacattttcagagggtcctatctggccggagcgggccttgcctttagcatcatgaagtctgtggggacgggaaaacgcggcaccggctcccaaggggaaacactgggagagaagtggaagaaaaagctcaatcagctgagccggaaagaattcgacctgtacaagaaatccggcattaccgaggtcgatagaacagaggctaaggaagggctcaaacggggagagatcacccatcacgccgtgtctcgcggcagcgctaagcttcagtggtttgtggaaagaaacatggttattcccgaggggcgggtcatcgacctgggatgtggccgcggcgggtggtcctattactgcgccggactgaagaaagtgacggaagtgagaggctataccaaggggggacctggccatgaggagcccgtccctatgtctacatacgggtggaatattgttaaactcatgagcggaaaggatgtgttctacctgcccccggaaaaatgtgacacccttctgtgcgatatcggcgagtccagcccttctcccacagtggaagagtcccggaccatccgcgtcctcaagatggtggagccctggctgaagaacaatcagttctgtattaaagttctgaacccttatatgcccacagtgatcgaacacctcgagagacttcaacggaagcacggcgggatgctggtccgcaatcctctgagcagaaactctacccatgaaatgtactggatttccaatggaacgggcaacatcgtggctagcgttaatatggtgtctcggctcctgcttaacagatttacaatgacccaccgccggccgaccattgagaaagacgtcgatctgggggccggaacaagacatgtgaacgcggaacccgagacgcctaatatggacgtgatcggcgagcgcatcaagcggattaaagaagagcacaacagcacctggcactatgacgatgaaaatccctacaagacatgggcctatcatgggtcctacgaggtcaaggctaccggatctgccagctccatgatcaacggcgttgtgaaactcctgacaaagccttgggacgtggtccccatggtgacccagatggctatgacagataccacgccgttcggccagcaaagagtttttaaagaaaaggtggacacccgcacacctcggagcatgcccgggaccagacgcgtcatgggaattacagccgagtggctgtggcggaccctcggcagaaataaaaagcctcgcctgtgcacgcgggaggaattcacaaagaaagtgagaaccaacgccgcgatgggggctgtttttacagaggaaaatcagtgggattccgccaaggccgctgtggaggacgaagatttctggaaacttgtcgaccgcgagagagagctgcacaagctcggaaaatgtggctcttgcgtgtataacatgatggggaagcgggaaaaaaagctgggcgagtttggaaaggccaaaggcagccgcgctatctggtacatgtggcttggggccagatacctggaattcgaggcgctcggatttctgaatgaggatcattggttctcccgggaaaactcttatagcggcgttgagggggaaggactgcacaagctcggctacattctgagagacatctccaaaatccccgggggcgccatgtatgctgatgacaccgccggatgggacacgcggattaccgaggatgaccttcataatgaagagaagatcacacagcagatggatcctgagcaccgccaactggctaacgccatttttaaactcacctaccagaataaggtggtcaaggtgcagagacccacaccgaccggcacagtcatggacatcatttctcggaaagatcagcgcgggagcggacaagtgggcacctatgggctgaacacgttcacaaatatggaagcgcagcttatcagacagatggagggagaaggcgttctgtccaaggccgacctcgagaaccctcacctgcccgaaaaaaagatcacccagtggctggagaccaaaggggtggagcggctcaagcgcatggctattagcggcgatgactgcgtcgtgaagcccatcgatgacagatttgccaacgctctgcttgccctgaatgatatgggaaaagtgcggaaggacattcctcaatggcagccgtctaaaggctggcatgattggcagcaggttcccttctgttcccaccatttccacgaactcatcatgaaggacgggcgcaaactggtggtcccttgcagaccccaagacgagcttattggacgggctcgcatcagccagggcgccgggtggtctctgagagaaacagcgtgtctcggaaaggcctacgctcagatgtggtccctgatgtattttcaccggcgcgatctgagactcgccagcaacgccatttgctctgctgtgcctgttcattgggtgcccacctcccggacaacgtggagcatccacgcccatcaccaatggatgaccacagaggacatgctgaccgtctggaatagagtgtggatcgaagataacccttggatggaggacaagacacccgtcaccacgtgggagaatgtgccgtaccttggcaaacgcgaagatcagtggtgtgggtccctgattggcctcaccagccgggcgacatgggctcagaacatccctaccgccattcagcaagttagatctctgatcggaaatgaggaattccttgactacatgcccagcatgaagcgctttcggaaagaggaggaatccgagggcgccatttggtga

SEQ ID NO: 20363 - RNA, 9873 nt, synthetic construct
  misc_feature 1..9873: note = derived and/or modified CDS sequence (opt5) from DENV-3__JX669492__SS-prME
  source 1..9873: mol_type = other RNA
accagcttctgcctgatgatgatcctccccgccgctctggcctttcaccttacatccagagacggcgagcctcggatgattgtggggaagaacgaacgcggaaaatctctgctcttcaagacggcgagcggcatcaatatgtgtaccctgattgctatggatcttggggagatgtgcgacgatacagtcacctacaaatgtccgcatatcacagaagttgagcccgaagacattgattgctggtgtaacctgacctccacatgggtgacctatggaacgtgcaatcaggccggcgagagacggcgcgacaagagatctgtggccctcgctcctcacgtcgggatgggactggatacccggacacaaacctggatgagcgccgagggcgcttggcgccaggtggaaaaagttgagacatgggccctgagacatcccggctttaccatcctcgcgctgttccttgcccactacatcgggacgtccctgacacagaaggtggtcatttttatcctcctgatgcttgtgaccccttctatgacaatgcggtgtgttggagtgggcaaccgcgacttcgtcgaagggctgagcggagctacctgggtggatgtggtcctcgagcatggcgggtgcgttaccacaatggccaagaataaacccacgctggacattgagctgcagaagaccgaagctacacaactcgccaccctgagaaaactttgtatcgagggaaagattacaaacatcaccacggattcccggtgccctacacagggcgaagcggtgctgccggaggaacaggaccagaattatgtgtgtaaacacacctacgtcgatcgcggctgggggaacggatgcggcctctttgggaagggaagcctggtgacctgcgccaagttccaatgtcttgagcccattgagggcaaagttgtgcagtatgaaaatctgaagtacacagtcatcatcaccgtgcacacaggggaccagcatcaggttggaaacgagacgcaaggcgtgaccgctgaaattacacctcaggcctctaccacagaggctatcctccccgaatatggcaccctggggctggagtgctcccctagaacgggactcgactttaatgagatgattctgcttaccatgaaaaacaaggcctggatggtccaccggcagtggttctttgatctgcccctcccgtggacaagcggcgccaccacagaaacccctacgtggaatcgcaaagagctgcttgtgacattcaagaacgctcatgcgaaaaagcaagaagtcgtggttctggggtctcaggagggagccatgcacaccgctctcacaggcgccaccgaaatccagaattccgggggcaccagcatttttgccggacacctgaagtgtagactgaaaatggacaagctcgagctgaaaggcatgtcttacgctatgtgcacaaacacgttcgtgcttaagaaagaggtctccgaaacccagcatgggacaatcctgatcaaggtggagtacaagggagaagatgccccctgtaaaattcctttcagcaccgaggacggccaagggaaggcgcacaacggacggctcatcacagctaatcccgttgtgaccaaaaaggaggaacccgtcaacattgaggccgaacctccgtttggcgagtccaatatcgtgattgggatcggcgataacgccctgaaaatcaattggtataagaagggatctagcattggcaaaatgttcgaagctacggccagaggggctcgccggatggccatcctgggagacacagcgtgggattttggctccgtggggggagttcttaacagcctcggcaagatggtccatcagattttcgggtctgcctacaccgctctgttttccggcgtgagctgggtgatgaaaatcggaattggcgtcctgctcacctggatcgggctgaattctaagaacacaagcatgtccttctcttgcattgccatcggaatcattaccctttatctgggcgctgtggttcaggccgacatggggtgtgtgatcaattggaaaggaaaggagctcaagtgcggcagcgggatttttgtcacaaacgaggtgcacacgtggaccgaacagtacaaattccaagcggattcccccaagagactggccacagctatcgccggcgcttgggagaatggagtttgtggcattcgcagcaccacacggatggaaaacctgctttggaaacagatcgccaatgagctcaactatatcctgtgggaaaataacattaagctgaccgtggtcgtgggggacatcattggagttctcgagcagggcaaaagaacgctgacccctcagcccatggagcttaagtactcttggaaaacatgggggaaggccaagatcgtgaccgctgaaacacaaaactccagctttattatcgatggacctaatacccccgagtgcccgtctgcgtcccgcgcctggaacgtctgggaagtggaggactatggcttcggcgtgtttacaaccaatatctggctgaaactccgggaagtctacacgcagctgtgtgaccatagactgatgagcgctgccgttaaggatgagcgcgccgtgcacgctgacatggggtactggattgagtcccagaaaaacggatcttggaagcttgaaaaagccagcctcatcgaggtgaagacatgcacctggcctaagtcccacaccctgtggtctaatggcgtcctggaaagcgatatgattatccccaaatccctcgcggggcctattagccagcataaccaccggcccggatatcatacacaaaccgctggcccttggcacctggggaagcttgagctggacttcaattactgcgagggaacgacagtggttatcaccgaaaactgtggcacaagaggcccctctctccgcaccacaaccgtgtccgggaaactgatccacgagtggtgctgtcggagctgcacgctgccgcctcttagatatatgggagaagatggctgttggtacgggatggagattcggcccatctctgaaaaggaggagaatatggtcaaatccctcgtgagcgccggatctggcaaggttgacaactttaccatgggggtgctgtgcctggccattctcttcgaagaggtcatgcgcggaaagttcggcaaaaagcatatgatcgctggcgtgtttttcacatttgttctgcttctgagcgggcagattacctggagagatatggcccacacactcatcatgattggatccaatgcgagcgaccggatgggcatgggggtgacctatctggctctgatcgccacgttcaaaatccagccctttcttgccctgggattctttctcagaaagctgacatctcgcgaaaacctcctgcttggcgtcgggctggctatggccaccacactccaactgcctgaggatattgaacagatggctaatggaatcgccctgggccttatggcgctgaaactcattacccagttcgagacctaccagctgtggacagccctcatctccctgacgtgtagcaacaccatgtttacacttaccgtggcttggcggacagccaccctgattctcgctggcgtgtccctgctgccggtctgccaatctagctccatgagaaagacggactggcttcccatggccgttgccgctatgggggtgcctcccctgcctctcttcatcttttctctgaaggatacactcaaacgcagaagctggcccctgaatgagggagtgatggcggtcggccttgtgtccatcctggcctctagcctgctccggaacgacgttcctatggctgggcccctggtggccggaggccttctgattgcctgttatgtcatcaccgggacctccgctgatctcacagtggaaaaggccgcggacattacctgggaggaagaggctgaacagacaggagttagccataacctgatgatcacggtggacgatgacggcaccatgcgcattaaagatgacgagacagagaatatcctcaccgtcctgcttaagacagccctgctgatcgtgtctggcgtcttcccgtactccattcctgccaccctcctggtgtggcacacgtggcagaaacagacccaaagaagcggggttctttgggatgtgccctctcctcccgaaacacagaaggctgagctggaagagggagtctaccggatcaaacagcagggcatttttgggaagacccaagtgggagttggcgtgcagaaggagggggtcttccatacaatgtggcacgtgacccgcggagccgtgctcacatataacggcaaaagactggaaccgaattgggcgtccgttaagaaagacctcatcagctacggcgggggatggcggctgtctgctcagtggcaaaagggcgaggaagtccaggtgattgccgtggagcctgggaaaaaccccaagaatttccagacgatgcctggaacctttcagacaaccaccggcgaaatcggggccattgctcttgatttcaagcccggaacatccggcagccccatcatcaaccgcgagggcaaagtcgtggggctgtatggaaatggcgttgtgacgaagaacgggggatacgtctccggcattgcccaaaccaatgctgagcctgacgggccgacacccgaactggaggaagagatgtttaaaaagagaaacctcaccatcatggatctgcaccctggcagcggaaaaacacggaagtatcttcccgccattgtgcgcgaagcgatcaagagacggctgagaaccctcattctggcccctacgcgcgttgtggctgccgagatggaggaagctctcaaaggcctgcccatccggtaccagacaaccgccaccaagtctgagcatacagggagagaaatcgtcgaccttatgtgccacgccaccttcacaatgcgcctgctgagccctgtgcgggttccgaattataacctcattatcatggatgaggctcattttaccgaccccgcgtccattgccgctagaggatacatctctacgcgcgtgggcatgggggaagccgccgctattttcatgacagccacccctcccggaacagcggatgcttttcctcagagcaatgcccccatccaggacgaggagcgggacatcccggaaagatcctggaactctggcaatgagtggattaccgatttcgccgggaaaacggtctggtttgtgcctagcatcaaggctggcaacgacattgccaactgtctgcgcaaaaatggaaagaaggtgatccaactttcccggaaaaccttcgatacagaataccagaagaccaaactgaacgactgggattttgtcgttacaaccgacatttctgagatgggcgcgaatttcaaggccgatagagtgatcgacccccggcgctgcctcaaacccgtgattctgacagatgggcctgagagagtcatcctggctggacccatgcctgtgaccgccgctagcgccgctcagcggcgcggcagagttgggcggaacccgcagaaggaaaatgaccaatatatcttcacgggacagcccctcaacaatgatgaggaccacgcccattggacagaagcgaagatgcttctggacaacattaatacccctgagggcatcattcccgccctgtttgaacctgagagagagaaatccgctgccatcgatggggaataccgcctcaagggcgagagccggaaaaccttcgtggaactgatgagacgcggagaccttcccgtctggctggctcacaaggtggcctctgagggcattaaatatacagatcggaagtggtgctttgacgggcagagaaacaatcagatcctcgaagagaacatggatgttgagatctggaccaaagaaggagagaagaagaaactgcgcccgcggtggctggacgccagaacatactccgatcctctcgctcttaaggaattcaaagactttgcggccggccgcaagagcattgctctggatctggtgacggagatcgggagagtcccctctcacctcgcccatcggacccgcaatgccctggacaaccttgtgatgctgcacacatccgaacatggaggcagagcttatcggcacgccgtcgaggagctccctgaaaccatggagacactgctgctccttggcctgatgattctgctcaccgggggagcgatgctgttccttatcagcggcaaagggattggaaagacgtccatcggcctgatctgtgtgattgcctctagcgggatgctctggatggctgaaatccccctgcaatggattgcctccgctatcgttctggagtttttcatgatggtgctccttattcctgagcccgaaaagcagcgcaccccgcaggataatcaactggcctacgtggtcatcggaattctgacactcgcggccatcatcgctgccaacgagatgggcctgcttgaaaccacaaaaagagacctgggcatgagcaaggagcctggggttgtgtctcccacctcctatctcgatgtggacctgcaccccgctagcgcctggacgctgtacgctgtcgccacaaccgtgattacacctatgctccggcataccatcgaaaattctaccgcgaacgttagccttgccgctattgccaaccaggctgtggtcctgatgggactggacaaaggctggccgatctccaagatggatctcggggtgcccctgcttgccctgggatgctactctcaggtcaatcctctcacactgacggccgcggtgctgctccttattacccactatgctatcatcggccccgggctgcaggccaaagctacaagagaggcccaaaagcgcaccgccgctggaattatgaagaaccctacagttgacggcatcatgaccattgatctggaccccgtgatctacgatagcaaatttgagaagcagctcggccaggtcatgctgcttgtgctgtgtgccgttcagctcctgctgatgcggacgtcctgggcgctctgcgaagcccttacactggctaccgggcctattaccacactgtgggagggatctccgggcaaattctggaataccacaatcgccgtgagcatggctaacatctttagagggtcctatctcgccggagcgggcctggccttcagcattatgaagtctgtcgggacgggaaaacgcggcaccggctcccaaggggaaacacttggagagaagtggaagaaaaagctgaatcagctcagccggaaagaatttgacctgtacaagaaatccggcatcaccgaggtggatagaacagaggctaaggaagggctgaaacggggagagattacccatcacgccgtgtctcgcggcagcgctaagctccagtggttcgttgaaagaaacatggtcatccccgaggggcgggtgattgaccttggatgtggccgcggcgggtggtcctattactgcgccggactgaagaaagtgacggaagtcagaggctataccaaggggggacctggccatgaggagcccgttcctatgtctacatacgggtggaatatcgtgaaactgatgagcggaaaggatgtgttctacctccccccggaaaaatgtgacaccctgctttgcgatattggcgagtccagcccttctcccacagtcgaagagtcccggaccatccgcgtgctgaagatggttgagccctggctcaagaacaatcagttttgtatcaaagtgctgaacccttatatgcccacagtcattgaacacctggagagactccaacggaagcacggcgggatgcttgtgcgcaatcctctgagcagaaactctacccatgaaatgtactggatctccaatggaacgggcaacattgttgctagcgtgaatatggtctctcggctgctcctgaacagattcacaatgacccaccgccggccgaccatcgagaaagacgtggatcttggggccggaacaagacatgtgaacgcggaacccgagacgcctaatatggacgtcattggcgagcgcatcaagcggatcaaagaagagcacaacagcacctggcactatgacgatgaaaatccctacaagacatgggcctatcatgggtcctacgaggttaaggctaccggatctgccagctccatgattaacggcgtggtgaaactgctcacaaagccttgggacgtcgtgcccatggttacccagatggctatgacagataccacgccgtttggccagcaaagagtgttcaaagaaaaggtcgacacccgcacacctcggagcatgcccgggaccagacgcgtgatgggaatcacagccgagtggctgtggcggaccctgggcagaaataaaaagcctcgcctctgcacgcgggaggaatttacaaagaaagttagaaccaacgccgcgatgggggctgtgttcacagaggaaaatcagtgggattccgccaaggccgctgtcgaggacgaagatttttggaaactggtggaccgcgagagagagcttcacaagctgggaaaatgtggctcttgcgtttataacatgatggggaagcgggaaaaaaagctcggcgagttcggaaaggccaaaggcagccgcgctatttggtacatgtggctgggggccagataccttgaatttgaggcgctgggattcctcaatgaggatcattggttttcccgggaaaactcttatagcggcgtggagggggaaggactgcacaagctgggctacatcctcagagacatttccaaaatccccgggggcgccatgtatgctgatgacaccgccggatgggacacgcggatcaccgaggatgacctgcataatgaagagaagattacacagcagatggatcctgagcaccgccaacttgctaacgccatcttcaaactgacctaccagaataaggtcgtgaaggtccagagacccacaccgaccggcacagtgatggacattatctctcggaaagatcagcgcgggagcggacaagttggcacctatgggctcaacacgtttacaaatatggaagcgcagctgattagacagatggagggagaaggcgtgctttccaaggccgacctggagaaccctcacctccccgaaaaaaagatcacccagtggctggagaccaaaggggtcgagcggctgaagcgcatggctatcagcggcgatgactgcgtggtgaagcccattgatgacagattcgccaacgctctcctggcccttaatgatatgggaaaagttcggaaggacatccctcaatggcagccgtctaaaggctggcatgattggcagcaggtgcccttctgttcccaccattttcacgaactgattatgaaggacgggcgcaaactcgtcgtgccttgcagaccccaagacgagctgatcggacgggctcgcattagccagggcgccgggtggtctcttagagaaacagcgtgtctgggaaaggcctacgctcagatgtggtccctcatgtatttccaccggcgcgatctgagactggccagcaacgccatctgctctgctgttcctgtgcattgggtccccacctcccggacaacgtggagcattcacgcccatcaccaatggatgaccacagaggacatgctcaccgtgtggaatagagtctggatcgaagataacccttggatggaggacaagacacccgtgaccacgtgggagaatgttccgtacctgggcaaacgcgaagatcagtggtgtgggtcccttatcggcctgaccagccgggcgacatgggctcagaacattcctaccgccatccagcaagtgagatctctcattggaaatgaggaatttctggactacatgcccagcatgaagcgcttccggaaagaggaggaatccgagggcgccatctggtga

SEQ ID NO: 20364 - RNA, 9873 nt, synthetic construct
  misc_feature 1..9873: note = derived and/or modified CDS sequence (opt5) from DENV-3__JX669500__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtacaagggagaagatgccccctgtaaaattcctttcagcaccgaggacggccaagggaaggcgcacaacggacggctgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctcgccggatggccatccttggagacacagcgtgggatttcggctccgtggggggagttctcaacagcctgggcaagatggtccatcagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcacacgtggaccgaacagtacaaatttcaagcggattcccccaagagactggccacagctatcgccggcgcttgggagaatggagtttgtggcattcgcagcaccacacggatggaaaaccttctctggaaacagatcgccaatgagctgaactatatcctgtgggaaaataacattaagctcaccgtggtcgtgggggacatcattggagttctggagcagggcaaaagaacgcttacccctcagcccatggagctgaagtactcttggaaaacatgggggaaggccaagatcgtgaccgctgaaacacaaaactccagcttcattatcgatggacctaatacccccgagtgcccgtctgcgtcccgcgcctggaacgtctgggaagtggaggactatggctttggcgtgttcacaaccaatatctggctcaaactgcgggaagtctacacgcagctgtgtgaccatagacttatgagcgctgccgttaaggatgagcgcgccgtgcacgctgacatggggtactggattgagtcccagaaaaacggatcttggaagctcgaaaaagccagcctgatcgaggtgaagacatgcacctggcctaagtcccacaccctgtggtctaatggcgtcctcgaaagcgatatgattatccccaaatccctggcggggcctattagccagcataaccaccggcccggatatcatacacaaaccgctggcccttggcaccttgggaagctggagctcgactttaattactgcgagggaacgacagtggttatcaccgaaaactgtggcacaagaggcccctctctgcgcaccacaaccgtgtccgggaaactgatccacgagtggtgctgtcggagctgcacgcttccgcctctcagatatatgggagaagatggctgttggtacgggatggagattcggcccatctctgaaaaggaggagaatatggtcaaatccctggtgagcgccggatctggcaaggttgacaacttcaccatgggggtgctgtgcctcgccattctgtttgaagaggtcatgcgcggaaagttcggcaaaaagcatatgatcgctggcgtgttctttacattcgttcttctgctcagcgggcagattacctggagagatatggcccacacactgatcatgattggatccaatgcgagcgaccggatgggcatgggggtgacctatctggctcttatcgccacgtttaaaatccagcccttcctggccctcggatttttcctgagaaagctcacatctcgcgaaaacctgcttctgggcgtcgggctcgctatggccaccacactgcaactgcctgaggatattgaacagatggctaatggaatcgcccttggcctgatggcgctcaaactgattacccagtttgagacctaccagctctggacagccctgatctcccttacgtgtagcaacaccatgttcacactgaccgtggcttggcggacagccaccctcattctggctggcgtgtccctgcttccggtctgccaatctagctccatgagaaagacggactggctgcccatggccgttgccgctatgggggtgcctcccctccctctgtttatcttctctctcaaggatacactgaaacgcagaagctggccccttaatgagggagtgatggcggtcggcctggtgtccatcctggcctctagcctcctgcggaacgacgttcctatggctgggccccttgtggccggaggcctgctcattgcctgttatgtcatcaccgggacctccgctgatctgacagtggaaaaggccgcggacattacctgggaggaagaggctgaacagacaggagttagccataacctcatgatcacggtggacgatgacggcaccatgcgcattaaagatgacgagacagagaatatcctgaccgtccttctgaagacagccctgctcatcgtgtctggcgtctttccgtactccattcctgccaccctgcttgtgtggcacacgtggcagaaacagacccaaagaagcggggttctgtgggatgtgccctctcctcccgaaacacagaaggctgagctcgaagagggagtctaccggatcaaacagcagggcattttcgggaagacccaagtgggagttggcgtgcagaaggagggggtctttcatacaatgtggcacgtgacccgcggagccgtgctgacatataacggcaaaagactcgaaccgaattgggcgtccgttaagaaagacctgatcagctacggcgggggatggcggctttctgctcagtggcaaaagggcgaggaagtccaggtgattgccgtggagcctgggaaaaaccccaagaatttccagacgatgcctggaaccttccagacaaccaccggcgaaatcggggccattgctctggattttaagcccggaacatccggcagccccatcatcaaccgcgagggcaaagtcgtggggctgtatggaaatggcgttgtgacgaagaacgggggatacgtctccggcattgcccaaaccaatgctgagcctgacgggccgacacccgaactcgaggaagagatgttcaaaaagagaaacctgaccatcatggatcttcaccctggcagcggaaaaacacggaagtatctgcccgccattgtgcgcgaagcgatcaagagacggctcagaaccctgattctcgcccctacgcgcgttgtggctgccgagatggaggaagctctgaaaggccttcccatccggtaccagacaaccgccaccaagtctgagcatacagggagagaaatcgtcgacctgatgtgccacgccacctttacaatgcgcctgctcagccctgtgcgggttccgaattataacctgattatcatggatgaggctcatttcaccgaccccgcgtccattgccgctagaggatacatctctacgcgcgtgggcatgggggaagccgccgctatttttatgacagccacccctcccggaacagcggatgctttccctcagagcaatgcccccatccaggacgaggagcgggacatcccggaaagatcctggaactctggcaatgagtggattaccgattttgccgggaaaacggtctggttcgtgcctagcatcaaggctggcaacgacattgccaactgtcttcgcaaaaatggaaagaaggtgatccaactgtcccggaaaacctttgatacagaataccagaagaccaaactcaacgactgggatttcgtcgttacaaccgacatttctgagatgggcgcgaattttaaggccgatagagtgatcgacccccggcgctgcctgaaacccgtgattctgacagatgggcctgagagagtcatcctcgctggacccatgcctgtgaccgccgctagcgccgctcagcggcgcggcagagttgggcggaacccgcagaaggaaaatgaccaatatatcttcacgggacagccccttaacaatgatgaggaccacgcccattggacagaagcgaagatgctgctggacaacattaatacccctgagggcatcattcccgccctcttcgaacctgagagagagaaatccgctgccatcgatggggaataccgcctgaagggcgagagccggaaaacctttgtggaacttatgagacgcggagacctgcccgtctggctcgctcacaaggtggcctctgagggcattaaatatacagatcggaagtggtgcttcgacgggcagagaaacaatcagatcctggaagagaacatggatgttgagatctggaccaaagaaggagagaagaagaaactgcgcccgcggtggctcgacgccagaacatactccgatcctcttgctctgaaggaatttaaagacttcgcggccggccgcaagagcattgctctggatctcgtgacggagatcgggagagtcccctctcacctggcccatcggacccgcaatgcccttgacaacctggtgatgctccacacatccgaacatggaggcagagcttatcggcacgccgtcgaggagctgcctgaaaccatggagacactgctccttctgggcctgatgattctcctgaccgggggagcgatgctttttctgatcagcggcaaagggattggaaagacgtccatcggcctcatctgtgtgattgcctctagcgggatgctgtggatggctgaaatccccctgcaatggattgcctccgctatcgttctcgagttctttatgatggtgcttctgattcctgagcccgaaaagcagcgcaccccgcaggataatcaactggcctacgtggtcatcggaattctcacactggcggccatcatcgctgccaacgagatgggccttctggaaaccacaaaaagagacctcggcatgagcaaggagcctggggttgtgtctcccacctcctatctggatgtggacctgcaccccgctagcgcctggacgctctacgctgtcgccacaaccgtgattacacctatgcttcggcataccatcgaaaattctaccgcgaacgttagcctggccgctattgccaaccaggctgtggtcctgatgggactcgacaaaggctggccgatctccaagatggatctgggggtgccccttctggccctcggatgctactctcaggtcaatcctctgacactgacggccgcggtgctccttctgattacccactatgctatcatcggccccgggctgcaggccaaagctacaagagaggcccaaaagcgcaccgccgctggaattatgaagaaccctacagttgacggcatcatgaccattgatctcgaccccgtgatctacgatagcaaattcgagaagcagctgggccaggtcatgcttctggtgctctgtgccgttcagctgctgctcatgcggacgtcctgggcgctttgcgaagccctgacactggctaccgggcctattaccacactctgggagggatctccgggcaaattttggaataccacaatcgccgtgagcatggctaacatcttcagagggtcctatctggccggagcgggccttgcctttagcattatgaagtctgtcgggacgggaaaacgcggcaccggctcccaaggggaaacactgggagagaagtggaagaaaaagctcaatcagctgagccggaaagaattcgacctgtacaagaaatccggcatcaccgaggtggatagaacagaggctaaggaagggctcaaacggggagagattacccatcacgccgtgtctcgcggcagcgctaagcttcagtggtttgttgaaagaaacatggtcatccccgaggggcgggtgattgacctgggatgtggccgcggcgggtggtcctattactgcgccggactgaagaaagtgacggaagtcagaggctataccaaggggggacctggccatgaggagcccgttcctatgtctacatacgggtggaatatcgtgaaactcatgagcggaaaggatgtgttctacctgcccccggaaaaatgtgacacccttctgtgcgatattggcgagtccagcccttctcccacagtcgaagagtcccggaccatccgcgtgctcaagatggttgagccctggctgaagaacaatcagttctgtatcaaagtgctgaacccttatatgcccacagtcattgaacacctcgagagacttcaacggaagcacggcgggatgctggtgcgcaatcctctgagcagaaactctacccatgaaatgtactggatctccaatggaacgggcaacattgttgctagcgtgaatatggtctctcggctcctgcttaacagatttacaatgacccaccgccggccgaccatcgagaaagacgtggatctgggggccggaacaagacatgtgaacgcggaacccgagacgcctaatatggacgtcattggcgagcgcatcaagcggatcaaagaagagcacaacagcacctggcactatgacgatgaaaatccctacaagacatgggcctatcatgggtcctacgaggttaaggctaccggatctgccagctccatgattaacggcgtggtgaaactcctgacaaagccttgggacgtcgtgcccatggttacccagatggctatgacagataccacgccgttcggccagcaaagagtgtttaaagaaaaggtcgacacccgcacacctcggcccatgcctgggaccagacgcgtgatgggaatcacagccgagtggctgtggcggaccctcggcagaaataaaaagccccgcctgtgcacgcgggaggaattcacaaagaaagttagaaccaacgccgcgatgggggctgtgtttacagaggaaaatcagtgggatagcgccaaggccgctgtcgaggacgaagatttctggaaacttgtggaccgcgagagagagctgcacaagctcggaaaatgtggctcctgcgtttataacatgatggggaagcgggaaaaaaagctgggcgagtttggaaaggccaaaggctctcgcgctatttggtacatgtggcttggggccagatacctggaattcgaggcgctcggatttctgaatgaggatcattggttcagccgggaaaactcctattctggcgtggagggggaaggactgcacaagctcggctacatcctgagagacattagcaaaatccctgggggcgccatgtatgctgatgacaccgccggatgggacacgcggatcaccgaggatgaccttcataatgaagagaagattacacagcagatggatcccgagcaccgccaactggctaacgccatctttaaactcacctaccagaataaggtcgtgaaggtccagagaccgacacctaccggcacagtgatggacattatctcccggaaagatcagcgcgggtctggacaagttggcacctatgggctgaacacgttcacaaatatggaagcgcagcttattagacagatggagggagaaggcgtgctgagcaaggccgacctcgagaacccccacctgcccgaaaaaaagatcacccagtggctggagaccaaaggggtcgagcggctcaagcgcatggctatctccggcgatgactgcgtggtgaagcctattgatgacagatttgccaacgctctgcttgccctgaatgatatgggaaaagttcggaaggacatcccgcaatggcagcccagcaaaggctggcatgattggcagcaggtgcctttctgttctcaccatttccacgaactcattatgaaggacgggcgcaaactggtcgtgccctgcagacctcaagacgagcttatcggacgggctcgcatttcccagggcgccgggtggagcctgagagaaacagcgtgtctcggaaaggcctacgctcagatgtggtctctgatgtattttcaccggcgcgatctgagactcgcctccaacgccatctgcagcgctgttcccgtgcattgggtccctacctctcggacaacgtggtccattcacgcccatcaccaatggatgaccacagaggacatgctgaccgtgtggaatagagtctggatcgaagataacccctggatggaggacaagacaccggtgaccacgtgggagaatgttccttaccttggcaaacgcgaagatcagtggtgtgggagcctgatcggcctcacctcccgggcgacatgggctcagaacattcccaccgccatccagcaagtgagaagcctgattggaaatgaggaattccttgactacatgccttctatgaagcgctttcggaaagaggaggaaagcgagggcgccatctggtga

SEQ ID NO: 20365 - RNA, 9873 nt, synthetic construct
  misc_feature 1..9873: note = derived and/or modified CDS sequence (opt5) from DENV-3__JX669497__SS-prME
  source 1..9873: mol_type = other RNA
accagcctgtgcctcatgatgatcctgcccgccgctcttgccttccacctgacatccagagacggcgaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaaagacggcgcgacaagagatctgtggccctggctcctcacgtcgggatgggactggatacccggacacagacctggatgagcgccgaaggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacagctggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccaaaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtacaagggagaagatgccccctgtaaaattcctttcagcaccgaggacggccaagggaaggcgcacaacggacggctgatcacagctaatcccgttgtgaccaaaaaggaggaacccgtcaacattgaggccgaacctccgttcggcgagtccaatatcgtgattgggatcggcgataacgcctctaaaatcaattggtataagaagggaagctccattggcaaaatgtttgaagctacggccagaggggctcgccggatggccatcctgggagacacagcgtgggatttcggcagcgtcgggggagttcttaactctctcggcaagatggtccatcagatttttgggtccgcctacaccgctctgttcagcggcgtgtcttgggtgatgaaaatcggaattggcgtcctgctcacctggatcgggctgaatagcaagaacacatccatgtcttttagctgcattgccatcggaatcattaccctttatctgggcgctgtggttcaggccgacatggggtgtgtgatcaattggaaaggaaaggagctcaagtgcggctccgggattttcgtcacaaacgaggtgcacacgtggaccgaacagtacaaatttcaagcggatagccccaagagactggccacagctatcgccggcgcttgggagaatggagtttgtggcattcgctctaccacacggatggaaaacctgctttggaaacagatcgccaatgagctcaactatatcctgtgggaaaataacattaagctgaccgtggtcgtgggggacatcattggagttctcgagcagggcaaaagaacgctgacccctcagcccatggagcttaagtactcctggaaaacatgggggaaggccaagatcgtgaccgctgaaacacaaaacagctctttcattatcgatggacctaatacccccgagtgcccgtccgcgagccgcgcctggaacgtctgggaagtggaggactatggctttggcgtgttcacaaccaatatctggctgaaactccgggaagtctacacgcagctgtgtgaccatagactgatgtccgctgccgttaaggatgagcgcgccgtgcacgctgacatggggtactggattgagtctcagaaaaacggaagctggaaacttgaaaaagcctccctcatcgaggtgaagacatgcacctggcctaagtctcacaccctgtggagcaatggcgtcctggaatccgatatgattatccccaaaagcctcgcggggcctatttctcagcataaccaccggcccggatatcatacacaaaccgctggcccttggcacctggggaaacttgagctggactttaattactgcgagggaacgacagtggttatcaccgaaaactgtggcacaagaggcccctccctccgcaccacaaccgtgagcgggaaactgatccacgagtggtgctgtcggtcttgcacgctgccgcctcttagatatatgggagaagatggctgttggtacgggatggagattcggcccatctccgaaaaggaggagaatatggtcaaaagcctcgtgtctgccggaagcggcaaggttgacaacttcaccatgggggtgctgtgcctggccattctctttgaagaggtcatgcgcggaaagttcggcaaaaagcatatgatcgctggcgtgttctttacattcgttctgcttctgtccgggcagattacctggagagatatggcccacacactcatcatgattggaagcaatgcgtctgaccggatgggcatgggggtgacctatctggctctgatcgccacgtttaaaatccagcccttccttgccctgggatttttcctcagaaagctgacatcccgcgaaaacctcctgcttggcgtcgggctggctatggccaccacactccaactgcctgaggatattgaacagatggctaatggaatcgccctgggccttatggcgctgaaactcattacccagtttgagacctaccagctgtggacagccctcatcagcctgacgtgttccaacaccatgttcacacttaccgtggcttggcggacagccaccctgattctcgctggcgtgtctctgctgccggtctgccaaagctcctctatgagaaagacggactggcttcccatggccgttgccgctatgggggtgcctcccctgcctctctttatcttcagcctgaaggatacactcaaacgcagatcctggcccctgaatgagggagtgatggcggtcggccttgtgtctatcctggccagctccctgctccggaacgacgttcctatggctgggcccctggtggccggaggccttctgattgcctgttatgtcatcaccgggaccagcgctgatctcacagtggaaaaggccgcggacattacctgggaggaagaggctgaacagacaggagtttctcataacctgatgatcacggtggacgatgacggcaccatgcgcattaaagatgacgagacagagaatatcctcaccgtcctgcttaagacagccctgctgatcgtgtccggcgtctttccgtacagcattcctgccaccctcctggtgtggcacacgtggcagaaacagacccaaagatctggggttctttgggatgtgccctcccctcccgaaacacagaaggctgagctggaagagggagtctaccggatcaaacagcagggcattttcgggaagacccaagtgggagttggcgtgcagaaggagggggtctttcatacaatgtggcacgtgacccgcggagccgtgctcacatataacggcaaaagactggaaccgaattgggcgagcgttaagaaagacctcatctcttacggcgggggatggcggctgtccgctcagtggcaaaagggcgaggaagtccaggtgattgccgtggagcctgggaaaaaccccaagaatttccagacgatgcctggaaccttccagacaaccaccggcgaaatcggggccattgctcttgattttaagcccggaacaagcggctcccccatcatcaaccgcgagggcaaagtcgtggggctgtatggaaatggcgttgtgacgaagaacgggggatacgtcagcggcattgcccaaaccaatgctgagcctgacgggccgacacccgaactggaggaagagatgttcaaaaagagaaacctcaccatcatggatctgcaccctggctctggaaaaacacggaagtatcttcccgccattgtgcgcgaagcgatcaagagacggctgagaaccctcattctggcccctacgcgcgttgtggctgccgagatggaggaagctctcaaaggcctgcccatccggtaccagacaaccgccaccaagagcgagcatacagggagagaaatcgtcgaccttatgtgccacgccacctttacaatgcgcctgctgtcccctgtgcgggttccgaattataacctcattatcatggatgaggctcatttcaccgaccccgcgtctattgccgctagaggatacatcagcacgcgcgtgggcatgggggaagccgccgctatttttatgacagccacccctcccggaacagcggatgctttccctcagtccaatgcccccatccaggacgaggagcgggacatcccggaaagatcttggaacagcggcaatgagtggattaccgattttgccgggaaaacggtctggttcgtgccttccatcaaggctggcaacgacattgccaactgtctgcgcaaaaatggaaagaaggtgatccaactttctcggaaaacctttgatacagaataccagaagaccaaactgaacgactgggatttcgtcgttacaaccgacattagcgagatgggcgcgaattttaaggccgatagagtgatcgacccccggcgctgcctcaaacccgtgattctgacagatgggcctgagagagtcatcctggctggacccatgcctgtgaccgccgcttccgccgctcagcggcgcggcagagttgggcggaacccgcagaaggaaaatgaccaatatatcttcacgggacagcccctcaacaatgatgaggaccacgcccattggacagaagcgaagatgcttctggacaacattaatacccctgagggcatcattcccgccctgttcgaacctgagagagagaaaagcgctgccatcgatggggaataccgcctcaagggcgagtctcggaaaacctttgtggaactgatgagacgcggagaccttcccgtctggctggctcacaaggtggcctccgagggcattaaatatacagatcggaagtggtgcttcgacgggcagagaaacaatcagatcctcgaagagaacatggatgttgagatctggaccaaagaaggagagaagaagaaactgcgcccgcggtggctggacgccagaacatacagcgatcctctcgctcttaaggaatttaaagacttcgcggccggccgcaagtctattgctctggatctggtgacggagatcgggagagtcccctcccacctcgcccatcggacccgcaatgccctggacaaccttgtgatgctgcacacaagcgaacatggaggcagagcttatcggcacgccgtcgaggagctccctgaaaccatggagacactgctgctccttggcctgatgattctgctcaccgggggagcgatgctgtttcttatctccggcaaagggattggaaagacgtctatcggcctgatctgtgtgattgccagctccgggatgctctggatggctgaaatccccctgcaatggattgccagcgctatcgttctggagttctttatgatggtgctccttattcctgagcccgaaaagcagcgcaccccgcaggataatcaactggcctacgtggtcatcggcattctcacactcgcggccatcatcgctgccaacgagatgggactgcttgaaaccacaaaaagagacctgggcatgtctaaggagcctggggttgtgtcccccaccagctatctcgatgtggacctgcaccccgcttctgcctggacgctgtacgctgtcgccacaaccgtgattacacctatgctccggcataccatcgaaaatagcaccgcgaacgtttcccttgccgctattgccaaccaggctgtggtcctgatgggactggacaaaggctggccgatctctaagatggatctcggggtgcccctgcttgccctgggatgctacagccaggtcaatcctctcacactgacggccgcggtgctgctccttattacccactatgctatcatcggccccgggctgcaggccaaagctacaagagaggcccaaaagcgcaccgccgctggaattatgaagaaccctacagttgacggcatcatgaccattgatctggaccccgtgatctacgattccaaattcgagaagcagctcggccaggtcatgctgcttgtgctgtgtgccgttcagctcctgctgatgcggacgtcttgggcgctctgcgaagcccttacactggctaccgggcctattaccacactgtgggagggaagcccgggcaaattttggaataccacaatcgccgtgtccatggctaacatcttcagagggagctatctcgccggagcgggcctggccttttctattatgaagtccgtcgggacgggaaaacgcggcaccggcagccaaggggaaacacttggagagaagtggaagaaaaagctgaatcagctctcccggaaagagttcgacctgtacaagaaatctggcatcaccgaggtggatagaacagaggctaaggaagggctgaaacggggagagattacccatcacgccgtgagccgcggctccgctaagctccagtggtttgttgaaagaaacatggtcatccccgaggggcgggtgattgaccttggatgtggccgcggcgggtggtcttattactgcgccggactgaagaaagtgacggaagtcagaggctataccaaagggggacctggccatgaggagcccgttcctatgagcacatacgggtggaatatcgtgaaactgatgtccggaaaggatgtgttctacctgcccccggaaaaatgtgacaccctgctttgcgatattggcgagagctctccttcccccacagtcgaagagagccggaccatccgcgtgctgaagatggttgagccctggctcaagaacaatcagttctgtatcaaagtgctgaacccttatatgcccacagtcattgaacacctggagagactccaacggaagcacggcgggatgcttgtgcgcaatcctctgtctagaaactccacccatgaaatgtactggatcagcaatggaacgggcaacattgttgcttctgtgaatatggtcagccggctgctcctgaacagatttacaatgacccaccgccggccgaccatcgagaaagacgtggatcttggggccggaacaagacatgtgaacgcggaacccgagacgcctaatatggacgtcattggcgagcgcatcaagcggatcaaagaagaacacaactccacctggcactatgacgatgaaaatccctacaagacatgggcctatcatgggtcttacgaggttaaggctaccggaagcgcctccagcatgattaacggcgtggtgaaactgctcacaaagccttgggacgtcgtgcccatggttacccagatggctatgacagataccacgccgttcggccagcaaagagtgtttaaagaaaaggtcgacacccgcacacctcggtccatgcccgggaccagacgcgtgatgggaatcacagccgagtggctgtggcggaccctgggcagaaataaaaagcctcgcctctgcacgcgggaggagttcacaaagaaagttagaaccaacgccgcgatgggggctgtgtttacagaggaaaatcagtgggattctgccaaggccgctgtcgaggacgaagatttctggaaactggtggaccgcgagagagagcttcacaagctgggaaaatgtggcagctgcgtttataacatgatggggaagcgggagaagaagctcggcgagtttggaaaggccaaaggctcccgcgctatttggtacatgtggctgggggccagataccttgagttcgaggcgctgggatttctcaatgaggatcattggttctctcgggaaaacagctattccggcgtggagggggaaggactgcacaagctgggctacatcctcagagacatttctaaaatccccgggggcgccatgtatgctgatgacaccgccggatgggacacgcggatcaccgaggatgacctgcataatgaagagaagattacacagcagatggatcctgagcaccgccaacttgctaacgccatctttaaactgacctaccagaataaggtcgtgaaggtccagagacccacaccgaccggcacagtgatggacattatcagccggaaagatcagcgcgggtccggacaagttggcacctatgggctcaacacgttcacaaatatggaagcgcagctgattagacagatggagggagaaggcgtgcttagcaaggccgacctggagaaccctcacctccccgagaagaagatcacccagtggctggagaccaaaggggtcgagcggctgaagcgcatggctatctctggcgatgactgcgtggtgaagcccattgatgacagatttgccaacgctctcctggcccttaatgatatgggaaaagttcggaaggacatccctcaatggcagccgtccaaaggctggcatgattggcaacaggtgcccttctgtagccaccatttccacgaactgattatgaaggacgggcgcaaactcgtcgtgccttgcagaccccaagacgagctgatcggacgggctcgcatttctcagggcgccgggtggtcccttagagaaacagcgtgtctgggaaaggcctacgctcagatgtggagcctcatgtattttcaccggcgcgatctgagactggcctctaacgccatctgctccgctgttcctgtgcattgggtccccaccagccggacaacgtggtccattcacgcccatcaccaatggatgaccacagaggacatgctcaccgtgtggaatagagtctggatcgaagataacccttggatggaggacaagacacccgtgaccacgtgggagaatgttccgtacctgggcaaacgcgaagatcagtggtgtgggagccttatcggcctgacctctcgggcgacatgggctcagaacattcctaccgccatccagcaagtgagaagcctcattggaaatgaggagttcctggactacatgccctccatgaagcgctttcggaaagaggaggaatctgagggcgccatctggtga

SEQ ID NO: 20366 - RNA, 9873 nt, synthetic construct
  misc_feature 1..9873: note = derived and/or modified CDS sequence (opt5) from DENV-3__JX669501__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtaccggggagaagatgccccctgtaagattcctttcagcaccgaggacggccaagggaaagcgcacaacggaagactgatcacagctaatcccgttgtgaccaagaaagaggaacccgtcaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgtggggggagttctcaacagcctgggcaaaatggtccatcagatttttgggtctgcctacaccgctctgttctccggcgtgagctgggtgatgaagatcggaattggcgtcctcctgacctggatcgggcttaattctaaaaacacaagcatgtccttttcttgcattgccatcggaatcattaccctgtatctcggcgctgtggttcaggccgacatggggtgtgtggtcaattggaagggaaaagagctgaagtgcggcagcgggatcttcgtgacaaacgaggttcacacgtggaccgaacagtacaagtttcaagcggattcccccaaacgcctggccacagctattgccggcgcttgggagaatggagtgtgtggcatccggagcaccacaagaatggaaaaccttctctggaagcagattgccaatgagctgaactatatcctgtgggaaaataacatcaaactcaccgtcgtggttggggacattatcggagtgctggagcagggcaagcgcacgcttacccctcagcccatggagctgaaatactcttggaagacatgggggaaagccaagattgtcaccgctgaaacacaaaactccagcttcatcattgatggacctaatacccccgagtgcccgtctgcgtcccgggcctggaacgtgtgggaagtggaggactatggctttggcgtcttcacaaccaatatctggctcaagctgagagaagtttacacgcagctgtgtgaccatcgccttatgagcgctgccgtgaaagatgagcgggccgtgcacgctgacatggggtactggatcgagtcccagaagaacggatcttggaaactcgaaaaggccagcctgattgaggtcaaaacatgcacctggcctaagtcccacaccctgtggtctaatggcgtgctcgaaagcgatatgatcattcccaagtccctggcggggcctatcagccagcataaccacagacccggatatcatacacaaaccgctggcccttggcaccttgggaaactggagctcgactttaattactgcgagggaacgacagttgtgattaccgaaaactgtggcacacgcggcccctctctgcggaccacaaccgtctccgggaagctgatccacgagtggtgctgtagaagctgcacgcttccgcctctccggtatatgggagaagatggctgttggtacgggatggagatccgccccatttctgaaaaagaggagaatatggtgaagtccctggttagcgccggatctggcaaagtggacaacttcaccatgggggtcctgtgcctcgccatcctgtttgaagaggtgatgagaggaaagttcggcaagaaacatatgattgctggcgttttctttacattcgtgcttctgctcagcgggcagatcacctggcgggatatggcccacacactgaccatgattggatccaatgcgagcgacagaatgggcatgggggtcacgtatctggctcttatcgccacatttaagattcagcccttcctggccctcggatttttcctgcgcaaactcacctctcgggaaaacctgcttctgggcgtggggctcgctatggccacaaccctgcaactgcctgaggatatcgaacagatggctaatggaatcgcccttggcctgatggcgctcaagctgattacccagtttgagacataccagctctggacggccctgatctcccttacctgtagcaacacaatgttcaccctgacagtggcttggagaaccgccacgctcattctggctggcgtctccctgcttccggtttgccaatctagctccatgcgcaaaacagactggctgcccatggccgtggccgctatgggggtgcctcccctccctctgtttatcttctctctcaaggataccctgaagagacggagctggccccttaatgagggagtcatggcggtgggcctggtttccattctggcctctagcctcctgcgcaacgacgtgcctatggctgggccccttgtcgccggaggcctgctcatcgcctgttatgtgatcaccgggacatccgctgatctgaccgttgaaaaagccgcggacattacatgggaggaagaggctgaacagacgggagtgagccataacctcatgatcaccgtcgacgatgacggcacaatgagaattaaggatgacgagaccgagaatatcctgacagtgcttctgaaaaccgccctgctcattgtctctggcgtgtttccgtactccatccctgccacgctgcttgtttggcacacctggcagaagcagacacaacggagcggggtgctgtgggatgtcccctctcctcccgaaacccagaaagctgagctcgaagagggagtgtaccgcatcaagcagcagggcattttcgggaaaacacaagttggagtgggcgtccagaaggagggggtgtttcataccatgtggcacgtgacaagaggagccgttctgacgtataacggcaagcggctcgaaccgaattgggcgtccgtcaaaaaggacctgatcagctacggcgggggatggcgcctttctgctcagtggcaaaaaggcgaggaagtgcaggtgattgccgtcgagcctgggaagaaccccaaaaatttccagaccatgcctggaacattccagaccaccacaggcgaaatcggggccattgctctggattttaagcccggaacgtccggcagccccatcattaacagagagggcaaggtggttgggctgtatggaaatggcgtggtcaccaaaaacgggggatacgtgtccggcatcgcccaaacaaatgctgagcctgacgggccgacccccgaactcgaggaagagatgttcaagaaacggaacctgacaatcatggatcttcaccctggcagcggaaagacccgcaaatatctgcccgccattgttagagaagcgatcaagcggagactccgcacgctgattctcgcccctacacgggtggtcgctgccgagatggaggaagctctgaagggccttcccatcagataccagaccaccgccacaaaatctgagcataccgggcgcgaaattgtggacctgatgtgccacgccacatttaccatgcggctgctcagccctgttagagtgccgaattataacctgatcatcatggatgaggctcatttcacggaccccgcgtccattgccgctcgcggatacatctctacacgggtcggcatgggggaagccgccgctatttttatgaccgccacacctcccggaaccgcggatgctttccctcagagcaatgcccccatccaggacgaggagagagacattccggaacgctcctggaactctggcaatgagtggatcacggattttgccgggaagaccgtgtggttcgtgcctagcatcaaagctggcaacgacattgccaactgtcttcggaagaatggaaaaaaggtcatccaactgtccagaaagacatttgataccgaataccagaaaacaaagctcaacgactgggatttcgttgtgaccacagacatttctgagatgggcgcgaattttaaagccgatcgggtgatcgacccccgcagatgcctgaagcccgtcattctgaccgatgggcctgagcgggtgatcctcgctggacccatgcctgttacggccgctagcgccgctcagcgcagaggccgggtggggagaaacccgcagaaagaaaatgaccaatatattttcacaggacagccccttaacaatgatgaggaccacgcccattggaccgaagcgaagatgctgctggacaacatcaatacccctgagggcatcattcccgccctcttcgaacctgagcgcgagaagtccgctgccatcgatggggaataccggctgaaaggcgagagcagaaagacatttgtcgaacttatgcgccggggagacctgcccgtgtggctcgctcacaaagttgcctctgagggcattaagtataccgatagaaaatggtgcttcgacgggcagcgcaacaatcagatcctggaagagaacatggatgtggagatttggacaaaggaaggagagaaaaagaagctgcggccgagatggctcgacgcccgcacgtactccgatcctcttgctctgaaagaatttaaggacttcgcggccggcagaaaaagcatcgctctggatctcgtcaccgagatcgggcgggtgccctctcacctggcccatcgcacaagaaatgcccttgacaacctggtcatgctccacacctccgaacatggaggccgggcttatcgccacgccatggaggagctgcctgaaacaatggagaccctgctccttctgggcctgatgattctcctgacggggggagcgatgctttttctgatcagcggcaaggggattggaaaaacctccatcggcctcatttgtgtgatcgcctctagcgggatgctgtggatggctgaaatccccctgcaatggattgcctccgctatcgttctcgagttctttatgatggtgcttctgattcctgagcccgaaaagcagagaacaccgcaggataatcaactggcctacgtggtcatcggaattctcaccctggcggccatcattgctgccaacgagatgggccttctggaaacaaccaagcgggacctcggcatgagcaaagagcctggggttgtgtctcccacgtcctatctggatgtggacctgcaccccgctagcgcctggacactctacgctgtcgccaccacagtgatcacccctatgcttagacataccatcgaaaattctacagcgaacgttagcctggccgctattgccaaccaggctgtggtcctgatgggactcgacaagggctggccgatctccaaaatggatctgggggtgccccttctggccctcggatgctactctcaggtcaatcctctgacgctgaccgccgcggtgctccttctgattacacactatgctatcattggccccgggctgcaggccaaggctacccgcgaggcccaaaaacggacagccgctggaatcatgaagaaccctaccgttgacggcatcatgacgattgatctcgaccccgtgatgtacgatagcaagttcgagaaacagctgggccaggtcatgcttctggtgctctgtgccgttcagctgctgctcatgagaacatcctgggcgctttgcgaagccctgaccctggctaccgggcctatcacaaccctctgggagggatctccgggcaagttttggaatacaacgattgccgtgagcatggctaacatcttccgcgggtcctatctggccggagcgggccttgcctttagcattatgaaatctgtcgggaccggaaagcggggcacaggctcccaaggggaaaccctgggagagaaatggaagaagaaactcaatcagctgagcagaaaggaattcgacctgtacaaaaagtccggcatcacagaggtggatcggaccgaggctaaagaagggctcaagcgcggagagatcacgcatcacgccgtgtctagaggcagcgctaaacttcagtggtttgttgaacggaacatggtcattcccgaggggcgcgtgatcgacctgggatgtggcagaggcgggtggtcctattactgcgccggactgaagaaggtgaccgaagtccggggctatacaaaagggggacctggccatgaggagcccgttcctatgtctacctacgggtggaatattgtgaagctcatgagcggaaaagatgtgttctacctgcccccggaaaagtgtgacacacttctgtgcgatatcggcgagtccagcccttctcccaccgtcgaagagtcccgcacaattagagtgctcaaaatggttgagccctggctgaagaacaatcagttctgtatcaaggtgctgaacccttatatgcccaccgtcattgaacacctcgagcggcttcaacgcaaacacggcgggatgctggtgagaaatcctctgagccggaactctacgcatgaaatgtactggatctccaatggaacaggcaacatcgttgctagcgtgaatatggtctctagactcctgcttaaccgctttaccatgacccaccggagaccgacaattgagaaggacgtggatctgggggccggaacgcgccatgtgaacgcggaacccgagacccctaatatggacgtcatcggcgagcggattaaaagaatcaaggaagagcacaacagcacatggcactatgacgatgaaaatccctacaaaacctgggcctatcatgggtcctacgaggttaaggctacaggatctgccagctccatgattaacggcgtggtgaagctcctgaccaaaccttgggacgtcgtgcccatggttacacagatggctatgaccgatacgaccccgttcggccagcaacgcgtgtttaaggaaaaagtcgacacacggacccctagaagcatgcccgggacacgccgggtgatgggaatcaccgccgagtggctgtggagaacgctcggccgcaataagaaacctcggctgtgcacaagagaggaattcaccaagaaggttcgcacaaacgccgcgatgggggctgtgtttaccgaggaaaatcagtgggattccgccaaagccgctgtcgaggacgaagatttctggaagcttgtggacagagagcgggagctgcacaaactcggaaagtgtggctcttgcgtttataacatgatggggaaacgcgaaaagaaactgggcgagtttggaaaggccaagggcagcagagctatctggtacatgtggcttggggcccggtacctggaattcgaggcgctcggatttctgaatgaggatcattggttctccagagaaaactcttatagcggcgtggagggggaaggactgcacaaactcggctacattctgcgggacatctccaagattcccgggggcgccatgtatgctgatgacacggccggatgggacacccgcatcacagaggatgaccttcataatgaagagaaaattacccagcagatggatcctgagcacagacaactggctaacgccatctttaagctcacataccagaataaagtcgtgaaggtccagcggcccaccccgacaggcaccgtgatggacatcatttctcgcaaggatcagagagggagcggacaagttggcacgtatgggctgaacacattcaccaatatggaagcgcagcttatccggcagatggagggagaaggcgtgctgtccaaagccgacctcgagaaccctcacctgcccgaaaagaaaattacccagtggctggagacaaagggggtcgagcgcctcaaaagaatggctatcagcggcgatgactgcgtggtgaagcccattgatgaccggtttgccaacgctctgcttgccctgaatgatatgggaaaggttcgcaaagacatccctcaatggcagccgtctaagggctggcatgattggcagcaggtgcccttctgttcccaccatttccacgaactcatcatgaaagacgggagaaagctggtcgtgccttgccggccccaagacgagcttattggacgcgctagaatcagccagggcgccgggtggtctctgcgggaaaccgcgtgtctcggaaaagcctacgctcagatgtggtccctgatgtattttcaccgcagagatctgcggctcgccagcaacgccatttgctctgctgttcctgtgcattgggtccccacatccagaacgacctggagcatccacgcccatcaccaatggatgacaaccgaggacatgctgacagtgtggaatcgcgtctggattgaagataacccttggatggaggacaagacccccgtgacgacctgggagaatgttccgtaccttggcaagcgggaagatcagtggtgtgggtccctgatcggcctcacaagcagagcgacctgggctcagaacattcctacagccatccagcaagtgcgctctctgatcggaaatgaggaattccttgactacatgcccagcatgaaacggtttagaaaggaggaggaatccgagggcgccatttggtga

SEQ ID NO: 20367 - RNA, 9873 nt, synthetic construct
  misc_feature 1..9873: note = derived and/or modified CDS sequence (opt5) from DENV-3__JX669494__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcaccaatatgtgtacacttatcgctatggatctgggggagatgtgcgacgataccgtcacatacaaatgtccgcatattaccgaagttgagcccgaagacatcgattgctggtgtaacctcacatccacctgggtgacgtatggaacctgcaatcaggccggcgagagacggcgcgacaagagatctgtggccctggctcctcacgtcgggatgggactggatacacggacccaaacatggatgagcgccgagggcgcttggcgccaggtggaaaaagttgagacctgggccctcagacatcccggcttcacgattctggcgctttttctggcccactacatcgggacatccctcacccagaaggtggtcatcttcattctgcttatgctggtgacaccttctatgaccatgcggtgtgttggagtgggcaaccgcgactttgtcgaagggctcagcggagctacctgggtggatgtggtcctggagcatggcgggtgcgttacaacgatggccaagaataaacccaccctggacatcgagctccagaagacagaagctacccaactggccacacttagaaaactgtgtattgagggaaagatcaccaacattacgacagattcccggtgccctacccagggcgaagcggtgctcccggaggaacaggaccagaattatgtgtgtaaacacacctacgtcgatcgcggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcacacgggggaccagcatcaggttggaaacgagacccaaggcgtgacagctgaaatcacccctcaggcctctacaaccgaggctattctgcccgaatatggcacgctggggctcgagtgctcccctagaaccggactggacttcaatgagatgatccttctgacaatgaaaaacaaggcctggatggtccaccggcagtggtttttcgatctccccctgccgtggaccagcggcgccacaaccgaaacgcctacatggaatcgcaaagagcttctggtgacctttaagaacgctcatgcgaaaaagcaagaagtcgtggttctcgggtctcaggagggagccatgcacacagctctgaccggcgccaccgaaattcagaattccgggggcacaagcatcttcgccggacacctgaagtgtagactcaaaatggacaagctggagcttaaaggcatgtcttacgctatgtgcacgaacacctttgtgctgaagaaagaggtctccgaaacacagcatgggaccattctcatcaaggtggagtaccggggagaagatgccccctgtaagatccctttcagcacagaggacggccaagggaaagcgcacaacggaagactgattaccgctaatcccgttgtgacgaagaaagaggaacccgtcaacatcgaggccgaacctccgttcggcgagtccaatattgtgatcgggattggcgataacgccctgaagatcaattggtataaaaagggatctagcatcggcaagatgtttgaagctacagcccgcggggctcggagaatggccattcttggagacaccgcgtgggatttcggctccgtggggggagttctcaacagcctgggcaaaatggtccatcagatctttgggtctgcctacaccgctctgttctccggcgtgagctgggtgatgaagattggaatcggcgtcctcctgacatggattgggcttaattctaaaaacaccagcatgtccttttcttgcatcgccattggaatcatcacactgtatctcggcgctgtggttcaggccgacatggggtgtgtgattaattggaagggaaaagagctgaagtgcggcagcgggatcttcgtcacgaacgaggtgcacacctggacagaacagtacaagtttcaagcggattcccccaaacgcctggccaccgctattgccggcgcttgggagaatggagtttgtggcatccggagcacaaccagaatggaaaaccttctctggaagcagattgccaatgagctgaactatatcctgtgggaaaataacatcaaactcacggtggtcgtgggggacattatcggagttctggagcagggcaagcgcacccttacacctcagcccatggagctgaaatactcttggaagacctgggggaaagccaagattgtgacagctgaaacccaaaactccagcttcatcattgatggacctaatacacccgagtgcccgtctgcgtcccgggcctggaacgtctgggaagtggaggactatggctttggcgtgttcaccacgaatatctggctcaagctgagagaagtctacacacagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccacagacccggatatcatacccaaacggctggcccttggcaccttgggaaactggagctcgactttaattactgcgagggaacaaccgtggttattacagaaaactgtggcacccgcggcccctctctgcggacaaccacggtgtccgggaagctgatccacgagtggtgctgtagaagctgcacccttccgcctctccggtatatgggagaagatggctgttggtacgggatggagatccgccccatttctgaaaaagaggagaatatggtcaagtccctggtgagcgccggatctggcaaagttgacaacttcacaatgggggtgctgtgcctcgccatcctgtttgaagaggtcatgagaggaaagttcggcaagaaacatatgattgctggcgtgcttttcacctttgttctgctcctgagcgggcagatcacatggcgggatatggcccacaccctgattatgatcggatccaatgcgagcgacagaatgggcatgggggtgacgtatcttgctctgattgccacattcaagatccagccctttctcgccctgggattctttctccgcaaactgacctctcgggaaaaccttctgctcggcgtcgggctggctatggccacaaccctgcaacttcctgaggatatcgaacagatggctaatggaattgccctgggcctcatggcgctgaagctcatcacccagttcgagacataccagctgtggacggcccttatttccctgacctgtagcaacacaatgtttaccctcacagtggcttggagaaccgccacgctgatcctggctggcgtgtcccttctgccggtctgccaatctagctccatgcgcaaaacagactggctccccatggccgttgccgctatgggggtgcctcccctgcctctcttcattttttctctgaaggatacccttaagagacggagctggcccctgaatgagggagtgatggcggtcggcctggtgtccatcctcgcctctagcctgcttcgcaacgacgttcctatggctgggcccctggtggccggaggcctcctgatcgcctgttatgtcattaccgggacatccgctgatctcaccgtggaaaaagccgcggacatcacatgggaggaagaggctgaacagacgggagttagccataacctgatgattaccgtggacgatgacggcacaatgagaatcaaggatgacgagaccgagaatattcttacagtcctgctgaaaaccgccctcctgatcgtgtctggcgtcttcccgtactccatccctgccacgcttctggtgtggcacacctggcagaagcagacacaacggagcggggttctctgggatgtgccctctcctcccgaaacccagaaagctgagctggaagagggagtctaccgcattaagcagcagggcatctttgggaaaacacaagtgggagttggcgtgcagaaggagggggtcttccataccatgtggcacgtgacaagaggagccgtgctcacgtataacggcaagcggctggaaccgaattgggcgtccgttaaaaaggaccttattagctacggcgggggatggcgcctgtctgctcagtggcaaaaaggcgaggaagtccaggtgatcgccgtggagcctgggaagaaccccaaaaattttcagaccatgcctggaacattccagaccaccacaggcgaaattggggccatcgctctggatttcaagcccggaacgtccggcagccccattatcaacagagagggcaaggtcgtggggctctatggaaatggcgttgtgaccaaaaacgggggatacgtctccggcatcgcccaaacaaatgctgagcctgacgggccgacccccgaactggaggaagagatgtttaagaaacggaaccttacaattatggatctgcaccctggcagcggaaagacccgcaaatatctccccgccatcgtgagagaagcgattaagcggagactgcgcacgctcatcctggcccctacacgggttgtggctgccgagatggaggaagctcttaagggcctgcccattagataccagaccaccgccacaaaatctgagcataccgggcgcgaaatcgtcgacctgatgtgccacgccacattcaccatgcggctcctgagccctgtgagagttccgaattataaccttatcattatggatgaggctcattttacggaccccgcgtccatcgccgctcgcggatacatttctacacgggtgggcatgggggaagccgccgctatcttcatgaccgccacacctcccggaaccgcggatgcttttcctcagagcaatgcccccattcaggacgaggagagagacatcccggaacgctcctggaactctggcaatgagtggatcacggatttcgccgggaagaccgtctggtttgtgcctagcattaaagctggcaacgacatcgccaactgtctgcggaagaatggaaaaaaggtgattcaactctccagaaagacattcgataccgaataccagaaaacaaagctgaacgactgggattttgtcgttaccacagacatctctgagatgggcgcgaatttcaaagccgatcgggtgattgacccccgcagatgcctgaagcccgtgatcctcaccgatgggcctgagcgggtcattcttgctggacccatgcctgtgacggccgctagcgccgctcagcgcagaggccgggttgggagaaacccgcagaaagaaaatgaccaatatatctttacaggacagcccctgaacaatgatgaggaccacgcccattggaccgaagcgaagatgctgctcgacaacatcaatacccctgagggcattatccccgccctgttcgaacctgagcgcgagaagtccgctgccattgatggggaataccggcttaaaggcgagagcagaaagacattcgtggaactgatgcgccggggagacctccccgtctggctggctcacaaagtggcctctgagggcatcaagtataccgatagaaaatggtgctttgacgggcagcgcaacaatcagattctggaagagaacatggatgttgagatctggacaaaggaaggagagaaaaagaagctccggccgagatggcttgacgcccgcacgtactccgatcctctggctctgaaagaattcaaggactttgcggccggcagaaaaagcatcgctctcgatctggtgaccgagattgggcgggtcccctctcaccttgcccatcgcacaagaaatgccctggacaacctcgtgatgctgcacacctccgaacatggaggccgggcttatcgccacgccgtcgaggagctgcctgaaacaatggagaccctccttctgctgggcctcatgatcctgcttacggggggagcgatgctgttcctcattagcggcaaggggatcggaaaaacctccattggcctgatctgtgtgatcgcctctagcgggatgctgtggatggctgaaattcccctccaatggatcgcctccgctattgttcttgagtttttcatgatggtgctgctgatccctgagcccgaaaagcagagaacaccgcaggataatcaactcgcctacgtggtcattggaatcctgacccttgcggccattatcgctgccaacgagatgggcctgctcgaaacaaccaagcgggacctgggcatgagcaaagagcctggggttgtgtctcccacgtcctatctggatgtggacctccaccccgctagcgcctggacactttacgctgtcgccaccacagtgatcacccctatgctgagacataccattgaaaattctacagcgaacgttagcctggccgctatcgccaaccaggctgtggtcctcatgggactggacaagggctggccgatttccaaaatggatcttggggtgcccctgctcgccctgggatgctactctcaggtcaatcctctgacgctcaccgccgcggtgcttctgctgatcacacactatgctattatcggccccgggctccaggccaaggctacccgcgaggcccaaaaacggacagccgctggaatcatgaagaaccctaccgttgacggcattatgacgatcgatctggaccccgtgatttacgatagcaagtttgagaaacagcttggccaggtcatgctgctcgtgctgtgtgccgttcagctgctccttatgagaacatcctgggcgctgtgcgaagccctgaccctcgctaccgggcctatcacaaccctgtgggagggatctccgggcaagttctggaatacaacgattgccgtgagcatggctaacatctttcgcgggtcctatcttgccggagcgggcctggccttcagcatcatgaaatctgtcgggaccggaaagcggggcacaggctcccaaggggaaaccctcggagagaaatggaagaagaaactgaatcagctgagcagaaaggaatttgacctctacaaaaagtccggcattacagaggtggatcggaccgaggctaaagaagggcttaagcgcggagagatcacgcatcacgccgtgtctagaggcagcgctaaactgcagtggttcgttgaacggaacatggtcattcccgaggggcgcgtgatcgacctgggatgtggcagaggcgggtggtcctattactgcgccggactcaagaaggtgaccgaagtccggggctatacaaaagggggacctggccatgaggagcccgttcctatgtctacctacgggtggaatattgtgaagctgatgagcggaaaagatgtgttttaccttcccccggaaaagtgtgacacactgctctgcgatatcggcgagtccagcccttctcccaccgtcgaagagtcccgcacaattagagtgctgaaaatggttgagccctggctgaagaacaatcagttctgtatcaaggtgctcaacccttatatgcccaccgtcatcgaacaccttgagcggctgcaacgcaaacacggcgggatgctggtgagaaatcctctcagccggaactctacgcatgaaatgtactggatttccaatggaacaggcaacatcgttgctagcgtgaataccgtctctagactgcttctgaaccgcttcaccatgacacaccggagaccgacgaccgagaaggacgtggatctcggggccggaacacgccatgtgaacgcggaacccgagacccctaatatggacgtcattggcgagcggatcaaaagaattaaggaagagcacaacagcacatggcactatgacgatgaaaatccctacaaaacctgggcctatcatgggtcctacgaggttaaggctacaggatctgccagctccatgatcaacggcgtggtgaagctgctgaccaaaccttgggacgtcgtgcccatggttacgcagatggctatgaccgatacaaccccgtttggccagcaacgcgtgttcaaggaaaaagtcgacacacggacccctagaagcatgcccgggacgcgccgggtgatgggaatcacagccgagtggctctggagaaccctgggccgcaataagaaacctcggctttgcacaagagaggaatttaccaagaaggttcgcacgaacgccgcgatgggggctgtgttcaccgaggaaaatcagtgggattccgccaaagccgctgtcgaggacgaagatttttggaagctggtggacagagagcgggagctccacaaactgggaaagtgtggctcttgcgtttataacatgatggggaaacgcgaaaagaaacttggcgagttcggaaaggccaagggcagcagagctatttggtacatgtggctgggggcccggtacctcgaatttgaggcgctgggattcctgaatgaggatcattggttttccagagaaaactcttatagcggcgtggagggggaaggactccacaaactgggctacatccttcgggacatttccaagatccccgggggcgccatgtatgctgatgacacagccggatgggacacccgcattacagaggatgacctgcataatgaagagaaaatcacccagcagatggatcctgagcacagacaactcgctaacgccatcttcaagctgacataccagaataaagtcgtgaaggtccagcggcccaccccgacgggcacagtgatggacattatctctcgcaaggatcagagagggagcggacaagttggcacctatgggcttaacacctttacaaatatggaagcgcagctgattcggcagatggagggagaaggcgtgctctccaaagccgacctggagaaccctcacctgcccgaaaagaaaatcacccagtggctcgagacaaagggggtcgagcgcctgaaaagaatggctattagcggcgatgactgcgtggtgaagcccatcgatgaccggttcgccaacgctcttctggccctcaatgatatgggaaaggttcgcaaagacatccctcaatggcagccgtctaagggctggcatgattggcagcaggtgcccttttgttcccaccatttccacgaactgattatgaaagacgggagaaagcttgtcgtgccttgccggccccaagacgagctgatcggacgcgctagaattagccagggcgccgggtggtctctccgggaaacggcgtgtctgggaaaagcctacgctcagatgtggtccctgatgtatttccaccgcagagatctccggctggccagcaacgccatctgctctgctgttcctgtgcattgggtccccacctccagaacaacctggagcattcacgcccatcaccaatggatgacaaccgaggacatgcttacggtgtggaatcgcgtctggatcgaagataacccttggatggaggacaagacccccgtgacaacctgggagaatgttccgtacctgggcaagcgggaagatcagtggtgtgggtccctcattggcctgacaagcagagcgacctgggctcagaacatccctacggccatccagcaagtgcgctctcttattggaaatgaggaatttctggactacatgcccagcatgaaacggttcagaaaggaggaggaatccgagggcgccatctggtga

SEQ ID NO: 20368 - RNA, 9873 nt, synthetic construct
  misc_feature 1..9873: note = derived and/or modified CDS sequence (opt5) from DENV-3__JX669503__SS-prME
  source 1..9873: mol_type = other RNA
accagcttctgcctgatgatgatcctccccgccgctctggcctttcaccttacatccagagacggcgagcctcggatgattgtggggaagaacgaacgcggaaaatctctgctcttcaagacggcgagcggcatcaatatgtgtaccctgattgctatggatcttggggagatgtgcgacgatacagtcacctacaaatgtccgcatatcacagaagttgagcccgaagacattgattgctggtgtaacctgacctccacatgggtgacctatggaacgtgcaatcaggccggcgagagacggcgcgacaagagatctgtggccctcgctcctcacgtcgggatgggactggatacccggacacaaacctggatgagcgccgagggcgcttggcgccaggtggaaaaagttgagacatgggccctgagacatcccggctttaccatcctcgcgctgttccttgcccactacatcgggacgtccctgacacagaaggtggtcatttttatcctcctgatgcttgtgaccccttctatgacaatgcggtgtgttggagtgggcaaccgcgacttcgtcgaagggctgagcggagctacctgggtggatgtggtcctcgagcatggcgggtgcgttaccacaatggccaagaataaacccacgctggacattgagctgcagaagaccgaagctacacaactcgccaccctgagaaaactttgtatcgagggaaagattacaaacatcaccacggattcccggtgccctacacagggcgaagcggtgctgccggaggaacaggaccagaattatgtgtgtaaacacacctacgtcgatcgcggctgggggaacggatgcggcctctttgggaagggaagcctggtgacctgcgccaagttccaatgtcttgagcccattgagggcaaagttgtgcagtatgaaaatctgaagtacacagtcatcatcaccgtgcacacaggggaccagcatcaggttggaaacgagacgcaaggcgtgaccgctgaaattacacctcaggcctctaccacagaggctatcctccccgaatatggcaccctggggctggagtgctcccctagaacgggactcgactttaatgagatgattctgcttaccatgaaaaacaaggcctggatggtccaccggcagtggttctttgatctgcccctcccgtggacaagcggcgccaccacagaaacccctacgtggaatcgcaaagagctgcttgtgacattcaagaacgctcatgcgaaaaagcaagaagtcgtggttctggggtctcaggagggagccatgcacaccgctctcacaggcgccaccgaaatccagaattccgggggcaccagcatttttgccggacacctgaagtgtagactgaaaatggacaagctcgagctgaaaggcatgtcttacgctatgtgcacaaacacgttcgtgcttaagaaagaggtctccgaaacccagcatgggacaatcctgatcaaggtggagtacaagggagaagatgccccctgtaaaattcctttcagcaccgaggacggccaagggaaggcgcacaacggacggctcatcacagctaatcccgttgtgaccaaaaaggaggaacccgtcaacattgaggccgaacctccgtttggcgagtccaatatcgtgattgggatcggcgataacgccctgaaaatcaattggtataagaagggatctagcattggcaaaatgttcgaagctacggccagaggggctcgccggatggccatcctgggagacacagcgtgggattttggctccgtggggggagttcttaacagcctcggcaagatggtccatcagattttcgggtctgcctacaccgctctgttttccggcgtgagctgggtgatgaaaatcggaattggcgtcctgctcacctggatcgggctgaattctaagaacacaagcatgtccttctcttgcattgccatcggaatcattaccctttatctgggcgctgtggttcaggccgacatggggtgtgtgatcaattggaaaggaaaggagctcaagtgcggcagcgggatttttgtcacaaacgaggtgcacacgtggaccgaacagtacaaattccaagcggattcccccaagagactggccacagctatcgccggcgcttgggagaatggagtttgtggcattcgcagcaccacacggatggaaaacctgctttggaaacagatcgccaatgagctcaactatatcctgtgggaaaataacattaagctgaccgtggtcgtgggggacatcattggagttctcgagcagggcaaaagaacgctgacccctcagcccatggagcttaagtactcttggaaaacatgggggaaggccaagatcgtgaccgctgaaacacaaaactccagctttattatcgatggacctaatacccccgagtgcccgtctgcgtcccgcgcctggaacgtctgggaagtggaggactatggcttcggcgtgtttacaaccaatatctggctgaaactccgggaagtctacacgcagctgtgtgaccatagactgatgagcgctgccgttaaggatgagcgcgccgtgcacgctgacatggggtactggattgagtcccagaaaaacggatcttggaagcttgaaaaagccagcctcatcgaggtgaagacatgcacctggcctaagtcccacaccctgtggtctaatggcgtcctggaaagcgatatgattatccccaaatccctcgcggggcctattagccagcataaccaccggcccggatatcatacacaaaccgctggcccttggcacctggggaagcttgagctggacttcaattactgcgagggaacgacagtggttatcaccgaaaactgtggcacaagaggcccctctctccgcaccacaaccgtgtccgggaaactgatccacgagtggtgctgtcggagctgcacgctgccgcctcttagatatatgggagaagatggctgttggtacgggatggagattcggcccatctctgaaaaggaggagaatatggtcaaatccctcgtgagcgccggatctggcaaggttgacaactttaccatgggggtgctgtgcctggccattctcttcgaagaggtcatgcgcggaaagttcggcaaaaagcatatgatcgctggcgtgtttttcacatttgttctgcttctgagcgggcagattacctggagagatatggcccacacactcatcatgattggatccaatgcgagcgaccggatgggcatgggggtgacctatctggctctgatcgccacgttcaaaatccagccctttcttgccctgggattctttctcagaaagctgacatctcgcgaaaacctcctgcttggcgtcgggctggctatggccaccacactccaactgcctgaggatattgaacagatggctaatggaatcgccctgggccttatggcgctgaaactcattacccagttcgagacctaccagctgtggacagccctcatctccctgacgtgtagcaacaccatgtttacacttaccgtggcttggcggacagccaccctgattctcgctggcgtgtccctgctgccggtctgccaatctagctccatgagaaagacggactggcttcccatggccgttgccgctatgggggtgcctcccctgcctctcttcatcttttctctgaaggatacactcaaacgcagaagctggcccctgaatgagggagtgatggcggtcggccttgtgtccatcctggcctctagcctgctccggaacgacgttcctatggctgggcccctggtggccggaggccttctgattgcctgttatgtcatcaccgggacctccgctgatctcacagtggaaaaggccgcggacattacctgggaggaagaggctgaacagacaggagttagccataacctgatgatcacggtggacgatgacggcaccatgcgcattaaagatgacgagacagagaatatcctcaccgtcctgcttaagacagccctgctgatcgtgtctggcgtcttcccgtactccattcctgccaccctcctggtgtggcacacgtggcagaaacagacccaaagaagcggggttctttgggatgtgccctctcctcccgaaacacagaaggctgagctggaagagggagtctaccggatcaaacagcagggcatttttgggaagacccaagtgggagttggcgtgcagaaggagggggtcttccatacaatgtggcacgtgacccgcggagccgtgctcacatataacggcaaaagactggaaccgaattgggcgtccgttaagaaagacctcatcagctacggcgggggatggcggctgtctgctcagtggcaaaagggcgaggaagtccaggtgattgccgtggagcctgggaaaaaccccaagaatttccagacgatgcctggaacctttcagacaaccaccggcgaaatcggggccattgctcttgatttcaagcccggaacatccggcagccccatcatcaaccgcgagggcaaagtcgtggggctgtatggaaatggcgttgtgacgaagaacgggggatacgtctccggcattgcccaaaccaatgctgagcctgacgggccgacacccgaactggaggaagagatgtttaaaaagagaaacctcaccatcatggatctgcaccctggcagcggaaaaacacggaagtatcttcccgccattgtgcgcgaagcgatcaagagacggctgagaaccctcattctggcccctacgcgcgttgtggctgccgagatggaggaagctctcaaaggcctgcccatccggtaccagacaaccgccaccaagtctgagcatacagggagagaaatcgtcgaccttatgtgccacgccaccttcacaatgcgcctgctgagccctgtgcgggttccgaattataacctcattatcatggatgaggctcattttaccgaccccgcgtccattgccgctagaggatacatctctacgcgcgtgggcatgggggaagccgccgctattttcatgacagccacccctcccggaacagcggatgcttttcctcagagcaatgcccccatccaggacgaggagcgggacatcccggaaagatcctggaactctggcaatgagtggattaccgatttcgccgggaaaacggtctggtttgtgcctagcatcaaggctggcaacgacattgccaactgtctgcgcaaaaatggaaagaaggtgatccaactttcccggaaaaccttcgatacagaataccagaagaccaaactgaacgactgggattttgtcgttacaaccgacatttctgagatgggcgcgaatttcaaggccgatagagtgatcgacccccggcgctgcctcaaacccgtgattctgacagatgggcctgagagagtcgtgctggctggacccatgcctgttaccgccgctagcgccgctcagcggcgcggcagagtggggcggaacccgcagaaggaaaatgaccaatatatcttcacgggacagcccctcaacaatgatgaggaccacgcccattggacagaagcgaagatgcttctggacaacatcaatacccctgagggcattatccccgccctgtttgaacctgagagagagaaatccgctgccattgatggggaataccgcctcaagggcgagagccggaaaaccttcgtcgaactgatgagacgcggagaccttcccgtgtggctggctcacaaggttgcctctgagggcatcaaatatacagatcggaagtggtgctttgacgggcagagaaacaatcagattctcgaagagaacatggatgtggagatctggaccaaagaaggagagaagaagaaactgcgcccgcggtggctggacgccagaacatactccgatcctctcgctcttaaggaattcaaagactttgcggccggccgcaagagcatcgctctggatctggtcacggagattgggagagtgccctctcacctcgcccatcggacccgcaatgccctggacaaccttgtcatgctgcacacatccgaacatggaggcagagcttatcggcacgccgtggaggagctccctgaaaccatggagacactgctgctccttggcctgatgatcctgctcaccgggggagcgatgctgttccttattagcggcaaagggatcggaaagacgtccattggcctgatctgtgttatcgcctctagcgggatgctctggatggctgaaattcccctgcaatggatcgcctccgctattgtgctggagtttttcatgatggtgctccttatccctgagcccgaaaagcagcgcaccccgcaggataatcaactggcctacgtcgttattggaatcctgacactcgcggccattatcgctgccaacgagatgggcctgcttgaaaccacaaaaagagacctgggcatgagcaaggagcctggggtggtgtctcccacctcctatctcgatgtcgacctgcaccccgctagcgcctggacgctgtacgctgtggccacaaccgttatcacacctatgctccggcataccattgaaaattctaccgcgaacgtgagccttgccgctatcgccaaccaggctgtcgtgctgatgggactggacaaaggctggccgatttccaagatggatctcggggtccccctgcttgccctgggatgctactctcaggtgaatcctctcacactgacggccgcggttctgctccttatcacccactatgctattatcggccccgggctgcaggccaaagctacaagagaggcccaaaagcgcaccgccgctggaatcatgaagaaccctacagtggacggcattatgaccatcgatctggaccccgtcatttacgatagcaaatttgagaagcagctcggccaggtgatgctgcttgttctgtgtgccgtgcagctcctgctgatgcggacgtcctgggcgctctgcgaagcccttacactggctaccgggcctatcaccacactgtgggagggatctccgggcaaattctggaataccacaattgccgtcagcatggctaacatctttagagggtcctatctcgccggagcgggcctggccttcagcatcatgaagtctgtggggacgggaaaacgcggcaccggctcccaaggggaaacacttggagagaagtggaagaaaaagctgaatcagctcagccggaaagaatttgacctgtacaagaaatccggcattaccgaggtggatagaacagaggctaaggaagggctgaaacggggagagatcacccatcacgccgtttctcgcggcagcgctaagctccagtggttcgtcgaaagaaacatggtgattcccgaggggcgggtgatcgaccttggatgtggccgcggcgggtggtcctattactgcgccggactgaagaaagtcacggaagttagaggctataccaaggggggacctggccatgaggagcccgtgcctatgtctacatacgggtggaatattgtgaaactgatgagcggaaaggatgtcttctacctccccccggaaaaatgtgacaccctgctttgcgatatcggcgagtccagcccttctcccacagtggaagagtcccggaccattcgcgttctgaagatggtggagccctggctcaagaacaatcagttttgtatcaaagtcctgaacccttatatgcccacagtgatcgaacacctggagagactccaacggaagcacggcgggatgcttgttcgcaatcctctgagcagaaactctacccatgaaatgtactggatttccaatggaacgggcaacatcgtggctagcgtcaatatggtgtctcggctgctcctgaacagattcacaatgacccaccgccggccgaccattgagaaagacgtggatcttggggccggaacaagacatgtcaacgcggaacccgagacgcctaatatggacgttatcggcgagcgcattaagcggatcaaagaagagcacaacagcacctggcactatgacgatgaaaatccctacaagacatgggcctatcatgggtcctacgaggtgaaggctaccggatctgccagctccatgatcaacggcgtggtcaaactgctcacaaagccttgggacgtggttcccatggtgacccagatggctatgacagataccacgccgtttggccagcaaagagtcttcaaagaaaaggtggacacccgcacacctcggagcatgcccgggaccagacgcgttatgggaattacagccgagtggctgtggcggaccctgggcagaaataaaaagcctcgcctctgcacgcgggaggaatttacaaagaaagtgagaaccaacgccgcgatgggggctgtcttcacagaggaaaatcagtgggattccgccaaggccgctgtggaggacgaagatttttggaaactggttgaccgcgagagagagcttcacaagctgggaaaatgtggctcttgcgtgtataacatgatggggaagcgggaaaaaaagctcggcgagttcggaaaggccaaaggcagccgcgctatctggtacatgtggctgggggccagataccttgaatttgaggcgctgggattcctcaatgaggatcattggttttcccgggaaaactcttatagcggcgtcgagggggaaggactgcacaagctgggctacattctcagagacatctccaaaattcccgggggcgccatgtatgctgatgacaccgccggatgggacacgcggatcaccgaggatgacctgcataatgaagagaagatcacacagcagatggatcctgagcaccgccaacttgctaacgccattttcaaactgacctaccagaataaggtggtcaaggtgcagagacccacaccgaccggcacagttatggacatcatttctcggaaagatcagcgcgggagcggacaagtgggcacctatgggctcaacacgtttacaaatatggaagcgcagctgatcagacagatggagggagaaggcgtcctttccaaggccgacctggagaaccctcacctccccgaaaaaaagattacccagtggctggagaccaaaggggtggagcggctgaagcgcatggctatcagcggcgatgactgcgtggttaagcccatcgatgacagattcgccaacgctctcctggcccttaatgatatgggaaaagtgcggaaggacattcctcaatggcagccgtctaaaggctggcatgattggcagcaggtccccttctgttcccaccattttcacgaactgatcatgaaggacgggcgcaaactcgtggttccttgcagaccccaagacgagctgattggacgggctcgcatcagccagggcgccgggtggtctcttagagaaacagcgtgtctgggaaaggcctacgctcagatgtggtccctcatgtatttccaccggcgcgatctgagactggccagcaacgccatttgctctgctgtgcctgtccattgggtgcccacctcccggacaacgtggagcatccacgcccatcaccaatggatgaccacagaggacatgctcaccgtctggaatagagtgtggattgaagataacccttggatggaggacaagacacccgttaccacgtgggagaatgtgccgtacctgggcaaacgcgaagatcagtggtgtgggtcccttatcggcctgaccagccgggcgacatgggctcagaacatccctaccgccattcagcaagtcagatctctcatcggaaatgaggaatttctggactacatgcccagcatgaagcgcttccggaaagaggaggaatccgagggcgccatttggtga

SEQ ID NO: 20369 - RNA, 9873 nt, synthetic construct
  misc_feature 1..9873: note = derived and/or modified CDS sequence (opt5) from DENV-3__JX669493__SS-prME
  source 1..9873: mol_type = other RNA
accagcttctgcctgatgatgatcctccccgccgctctggcctttcaccttacatccagagacggcgagcctcggatgattgtggggaagaacgaacgcggaaaatctctgctcttcaagacggcgagcggcatcaatatgtgtaccctgattgctatggatcttggggagatgtgcgacgatacagtcacctacaaatgtccgcatatcacagaagttgagcccgaagacattgattgctggtgtaacctgacctccacatgggtgacctatggaacgtgcaatcaggccggcgagagacggcgcgacaagagatctgtggccctcgctcctcacgtcgggatgggactggatacccggacacaaacctggatgagcgccgagggcgcttggcgccaggtggaaaaagttgagacatgggccctgagacatcccggctttaccatcctcgcgctgttccttgcccactacatcgggacgtccctgacacagaaggtggtcatttttatcctcctgatgcttgtgaccccttctatgacaatgcggtgtgttggagtgggcaaccgcgacttcgtcgaagggctgagcggagctacctgggtggatgtggtcctcgagcatggcgggtgcgttaccacaatggccaagaataaacccacgctggacattgagctgcagaagaccgaagctacacaactcgccaccctgagaaaactttgtatcgagggaaagattacaaacatcaccacggattcccggtgccctacacagggcgaagcggtgctgccggaggaacaggaccagaattatgtgtgtaaacacacctacgtcgatcgcggctgggggaacggatgcggcctctttgggaagggaagcctggtgacctgcgccaagttccaatgtcttgagcccattgagggcaaagttgtgcagtatgaaaatctgaagtacacagtcatcatcaccgtgcacacaggggaccagcatcaggttggaaacgagacgcaaggcgtgaccgctgaaattacacctcaggcctctaccacagaggctatcctccccgaatatggcaccctggggctggagtgctcccctagaacgggactcgactttaatgagatgattctgcttaccatgaaaaacaaggcctggatggtccaccggcagtggttctttgatctgcccctcccgtggacaagcggcgccaccacagaaacccctacgtggaatcgcaaagagctgcttgtgacattcaagaacgctcatgcgaaaaagcaagaagtcgtggttctggggtctcaggagggagccatgcacaccgctctcacaggcgccaccgaaatccagaattccgggggcaccagcatttttgccggacacctgaagtgtagactgaaaatggacaagctcgagctgaaaggcatgtcttacgctatgtgcacaaacacgttcgtgcttaagaaagaggtctccgaaacccagcatgggacaatcctgatcaaggtggagtacaagggagaagatgccccctgtaaaattcctttcagcaccgaggacggccaagggaaggcgcacaacggacggctcatcacagctaatcccgttgtgaccaaaaaggaggaacccgtcaacattgaggccgaacctccgtttggcgagtccaatatcgtgattgggatcggcgataacgccctgaaaatcaattggtataagaagggatctagcattggcaaaatgttcgaagctacggccagaggggctcgccggatggccatcctgggagacacagcgtgggattttggctccgtggggggagttcttaacagcctcggcaagatggtccatcagattttcgggtctgcctacaccgctctgttttccggcgtgagctgggtgatgaaaatcggaattggcgtcctgctcacctggatcgggctgaattctaagaacacaagcatgtccttctcttgcattgccatcggaatcattaccctttatctgggcgctgtggttcaggccgacatggggtgtgtgatcaattggaaaggaaaggagctcaagtgcggcagcgggatttttgtcacaaacgaggtgcacacgtggaccgaacagtacaaattccaagcggattcccccaagagactggccacagctatcgccggcgcttgggagaatggagtttgtggcattcgcagcaccacacggatggaaaacctgctttggaaacagatcgccaatgagctcaactatatcctgtgggaaaataacattaagctgaccgtggtcgtgggggacatcattggagttctcgagcagggcaaaagaacgctgacccctcagcccatggagcttaagtactcttggaaaacatgggggaaggccaagatcgtgaccgctgaaacacaaaactccagctttattatcgatggacctaatacccccgagtgcccgtctgcgtcccgcgcctggaacgtctgggaagtggaggactatggcttcggcgtgtttacaaccaatatctggctgaaactccgggaagtctacacgcagctgtgtgaccatagactgatgagcgctgccgttaaggatgagcgcgccgtgcacgctgacatggggtactggattgagtcccagaaaaacggatcttggaagcttgaaaaagccagcctcatcgaggtgaagacatgcacctggcctaagtcccacaccctgtggtctaatggcgtcctggaaagcgatatgattatccccaaatccctcgcggggcctattagccagcataaccaccggcccggatatcatacacaaaccgctggcccttggcacctggggaagcttgagctggacttcaattactgcgagggaacgacagtggttatcaccgaaaactgtggcacaagaggcccctctctccgcaccacaaccgtgtccgggaaactgatccacgagtggtgctgtcggagctgcacgctgccgcctcttagatatattggagaagatggctgttggtacgggatggagatccggcccatttctgaaaaggaggagaatatggtcaaatccctcgtgagcgccggatctggcaaggttgacaactttaccatgggggtgctgtgcctggccatcctcttcgaagaggtcatgcgcggaaagttcggcaaaaagcatatgattgctggcgtgtttttcacatttgttctgcttctgagcgggcagatcacctggagagatatggcccacacactcattatgatcggatccaatgcgagcgaccggatgggcatgggggtgacctatctggctctgatcgccacgttcaaaattcagccctttcttgccctgggattctttctcagaaagctgacatctcgcgaaaacctcctgcttggcgtcgggctggctatggccaccacactccaactgcctgaggatatcgaacagatggctaatggaattgccctgggccttatggcgctgaaactcatcacccagttcgagacctaccagctgtggacagccctcatttccctgacgtgtagcaacaccatgtttacacttaccgtggcttggcggacagccaccctgatcctcgctggcgtgtccctgctgccggtctgccaatctagctccatgagaaagacggactggcttcccatggccgttgccgctatgggggtgcctcccctgcctctcttcatcttttctctgaaggatacactcaaacgcagaagctggcccctgaatgagggagtgatggcggtcggccttgtgtccattctggcctctagcctgctccggaacgacgttcctatggctgggcccctggtggccggaggccttctgatcgcctgttatgtcattaccgggacctccgctgatctcacagtggaaaaggccgcggacatcacctgggaggaagaggctgaacagacaggagttagccataacctgatgattacggtggacgatgacggcaccatgcgcatcaaagatgacgagacagagaatatcctcaccgtcctgcttaagacagccctgctgattgtgtctggcgtcttcccgtactccatccctgccaccctcctggtgtggcacacgtggcagaaacagacccaaagaagcggggttctttgggatgtgccctctcctcccgaaacacagaaggctgagctggaagagggagtctaccggattaaacagcagggcatctttgggaagacccaagtgggagttggcgtgcagaaggagggggtcttccatacaatgtggcacgtgacccgcggagccgtgctcacatataacggcaaaagactggaaccgaattgggcgtccgttaagaaagacctcattagctacggcgggggatggcggctgtctgctcagtggcaaaagggcgaggaagtccaggtgatcgccgtggagcctgggaaaaaccccaagaatttccagacgatgcctggaacctttcagacaaccaccggcgaaattggggccatcgctcttgatttcaagcccggaacatccggcagccccatcattaaccgcgagggcaaagtcgtggggctgtatggaaatggcgttgtgacgaagaacgggggatacgtctccggcatcgcccaaaccaatgctgagcctgacgggccgacacccgaactggaggaagagatgtttaaaaagagaaacctcaccattatggatctgcaccctggcagcggaaaaacacggaagtatcttcccgccatcgtgcgcgaagcgattaagagacggctgagaaccctcatcctggcccctacgcgcgttgtggctgccgagatggaggaagctctcaaaggcctgcccatccggtaccagacaaccgccaccaagtctgagcatacagggagagaaattgtcgaccttatgtgccacgccaccttcacaatgcgcctgctgagccctgtgcgggttccgaattataacctcatcattatggatgaggctcattttaccgaccccgcgtccatcgccgctagaggatacatttctacgcgcgtgggcatgggggaagccgccgctatcttcatgacagccacccctcccggaacagcggatgcttttcctcagagcaatgcccccatccaggacgaggagcgggacattccggaaagatcctggaactctggcaatgagtggatcaccgatttcgccgggaaaacggtctggtttgtgcctagcattaaggctggcaacgacatcgccaactgtctgcgcaaaaatggaaagaaggtgattcaactttcccggaaaaccttcgatacagaataccagaagaccaaactgaacgactgggattttgtcgttacaaccgacatctctgagatgggcgcgaatttcaaggccgatagagtgattgacccccggcgctgcctcaaacccgtgatcctgacagatgggcctgagagagtcatcctggctggacccatgcctgtgaccgccgctagcgccgctcagcggcgcggcagagttgggcggaacccgcagaaggaaaatgaccaatatattttcacgggacagcccctcaacaatgatgaggaccacgcccattggacagaagcgaagatgcttctggacaacatcaatacccctgagggcattatccccgccctgtttgaacctgagagagagaaatccgctgccattgatggggaataccgcctcaagggcgagagccggaaaaccttcgtggaactgatgagacgcggagaccttcccgtctggctggctcacaaggtggcctctgagggcatcaaatatacagatcggaagtggtgctttgacgggcagagaaacaatcagatcctcgaagagaacatggatgttgagatttggaccaaagaaggagagaagaagaaactgcgcccgcggtggctggacgccagaacatactccgatcctctcgctcttaaggaattcaaagactttgcggccggccgcaagagcatcgctctggatctggtgacggagattgggagagtcccctctcacctcgcccatcggacccgcaatgccctggacaaccttgtgatgctgcacacatccgaacatggaggcagagcttatcggcacgccgtcgaggagctccctgaaaccatggagacactgctgctccttggcctgatgatcctgctcaccgggggagcgatgctgttccttattagcggcaaagggatcggaaagacgtccatcggcctgatttgtgtgatcgcctctagcgggatgctctggatggctgaaattcccctgcaatggatcgcctccgctattgttctggagtttttcatgatggtgctccttatccctgagcccgaaaagcagcgcaccccgcaggataatcaactggcctacgtggtcattggaatcctgacactcgcggccatcattgctgccaacgagatgggcctgcttgaaaccacaaaaagagacctgggcatgagcaaggagcctggggttgtgtctcccacctcctatctcgatgtggacctgcaccccgctagcgcctggacgctgtacgctgtcgccacaaccgtgatcacacctatgctccggcataccattgaaaattctaccgcgaacgttagccttgccgctatcgccaaccaggctgtggtcctgatgggactggacaaaggctggccgatttccaagatggatctcggggtgcccctgcttgccctgggatgctactctcaggtcaatcctctcacactgacggccgcggtgctgctccttatcacccactatgctatcattggccccgggctgcaggccaaagctacaagagaggcccaaaagcgcaccgccgctggaatcatgaagaaccctacagttgacggcattatgaccatcgatctggaccccgtgatttacgatagcaaatttgagaagcagctcggccaggtcatgctgcttgtgctgtgtgccgttcagctcctgctgatgcggacgtcctgggcgctctgcgaagcccttacactggctaccgggcctatcaccacactgtgggagggatctccgggcaaattctggaataccacaatcgccgtgagcatggctaacatttttagagggtcctatctcgccggagcgggcctggccttcagcatcatgaagtctgtcgggacgggaaaacgcggcaccggctcccaaggggaaacacttggagagaagtggaagaaaaagctgaatcagctcagccggaaagaatttgacctgtacaagaaatccggcattaccgaggtggatagaacagaggctaaggaagggctgaaacggggagagatcacccatcacgccgtgtctcgcggcagcgctaagctccagtggttcgttgaaagaaacatggtcattcccgaggggcgggtgatcgaccttggatgtggccgcggcgggtggtcctattactgcgccggactgaagaaagtgacggaagtcagaggctataccaaggggggacctggccatgaggagcccgttcctatgtctacatacgggtggaatattgtgaaactgatgagcggaaaggatgtgttctacctccccccggaaaaatgtgacaccctgctttgcgatatcggcgagtccagcccttctcccacagtcgaagagtcccggaccatccgcgtgctgaagatggttgagccctggctcaagaacaatcagttttgtattaaagtgctgaacccttatatgcccacagtcatcgaacacctggagagactccaacggaagcacggcgggatgcttgtgcgcaatcctctgagcagaaactctacccatgaaatgtactggatttccaatggaacgggcaacatcgttgctagcgtgaatatggtctctcggctgctcctgaacagattcacaatgacccaccgccggccgaccattgagaaagacgtggatcttggggccggaacaagacatgtgaacgcggaacccgagacgcctaatatggacgtcatcggcgagcgcatcaagcggattaaagaagagcacaacagcacctggcactatgacgatgaaaatccctacaagacatgggcctatcatgggtcctacgaggttaaggctaccggatctgccagctccatgatcaacggcgtggtgaaactgctcacaaagccttgggacgtcgtgcccatggttacccagatggctatgacagataccacgccgtttggccagcaaagagtgttcaaagaaaaggtcgacacccgcacacctcggagcatgcccgggaccagacgcgtgatgggaattacagccgagtggctgtggcggaccctgggcagaaataaaaagcctcgcctctgcacgcgggaggaatttacaaagaaagttagaaccaacgccgcgatgggggctgtgttcacagaggaaaatcagtgggattccgccaaggccgctgtcgaggacgaagatttttggaaactggtggaccgcgagagagagcttcacaagctgggaaaatgtggctcttgcgtttataacatgatggggaagcgggaaaaaaagctcggcgagttcggaaaggccaaaggcagccgcgctatctggtacatgtggctgggggccagataccttgaatttgaggcgctgggattcctcaatgaggatcattggttttcccgggaaaactcttatagcggcgtggagggggaaggactgcacaagctgggctacattctcagagacatctccaaaatccccgggggcgccatgtatgctgatgacaccgccggatgggacacgcggattaccgaggatgacctgcataatgaagagaagatcacacagcagatggatcctgagcaccgccaacttgctaacgccattttcaaactgacctaccagaataaggtcgtgaaggtccagagacccacaccgaccggcacagtgatggacatcatttctcggaaagatcagcgcgggagcggacaagttggcacctatgggctcaacacgtttacaaatatggaagcgcagctgatcagacagatggagggagaaggcgtgctttccaaggccgacctggagaaccctcacctccccgaaaaaaagatcacccagtggctggagaccaaaggggtcgagcggctgaagcgcatggctattagcggcgatgactgcgtggtgaagcccatcgatgacagattcgccaacgctctcctggcccttaatgatatgggaaaagttcggaaggacattcctcaatggcagccgtctaaaggctggcatgattggcagcaggtgcccttctgttcccaccattttcacgaactgatcatgaaggacgggcgcaaactcgtcgtgccttgcagaccccaagacgagctgattggacgggctcgcatcagccagggcgccgggtggtctcttagagaaacagcgtgtctgggaaaggcctacgctcagatgtggtccctcatgtatttccaccggcgcgatctgagactggccagcaacgccatttgctctgctgttcctgtgcattgggtccccacctcccggacaacgtggagcatccacgcccatcaccaatggatgaccacagaggacatgctcaccgtgtggaatagagtctggatcgaagataacccttggatggaggacaagacacccgtgaccacgtgggagaatgttccgtacctgggcaaacgcgaagatcagtggtgtgggtcccttattggcctgaccagccgggcgacatgggctcagaacatccctaccgccattcagcaagtgagatctctcatcggaaatgaggaatttctggactacatgcccagcatgaagcgcttccggaaagaggaggaatccgagggcgccatttggtga

SEQ ID NO: 20370 - RNA, 9873 nt, synthetic construct
  misc_feature 1..9873: note = derived and/or modified CDS sequence (opt5) from DENV-3__JX669504__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcaccaatatgtgtacacttatcgctatggatctgggggagatgtgcgacgataccgtcacatacaaatgtccgcatattaccgaagttgagcccgaagacatcgattgctggtgtaacctcacatccacctgggtgacgtatggaacctgcaatcaggccggcgagagacggcgcgacaagagatctgtggccctggctcctcacgtcgggatgggactggatacacggacccaaacatggatgagcgccgagggcgcttggcgccaggtggaaaaagttgagacctgggccctcagacatcccggcttcacgattctggcgctttttctggcccactacatcgggacatccctcacccagaaggtggtcatcttcattctgcttatgctggtgacaccttctatgaccatgcggtgtgttggagtgggcaaccgcgactttgtcgaagggctcagcggagctacctgggtggatgtggtcctggagcatggcgggtgcgttacaacgatggccaagaataaacccaccctggacatcgagctccagaagacagaagctacccaactggccacacttagaaaactgtgtattgagggaaagatcaccaacattacgacagattcccggtgccctacccagggcgaagcggtgctcccggaggaacaggaccagaattatgtgtgtaaacacacctacgtcgatcgcggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcacacgggggaccagcatcaggttggaaacgagacccaaggcgtgacagctgaaatcacccctcaggcctctacaaccgaggctattctgcccgaatatggcacgctggggctcgagtgctcccctagaaccggactggacttcaatgagatgatccttctgacaatgaaaaacaaggcctggatggtccaccggcagtggtttttcgatctccccctgccgtggaccagcggcgccacaaccgaaacgcctacatggaatcgcaaagagcttctggtgacctttaagaacgctcatgcgaaaaagcaagaagtcgtggttctcgggtctcaggagggagccatgcacacagctctgaccggcgccaccgaaattcagaattccgggggcacaagcatcttcgccggacacctgaagtgtagactcaaaatggacaagctggagcttaaaggcatgtcttacgctatgtgcacgaacacctttgtgctgaagaaagaggtctccgaaacacagcatgggaccattctcatcaaggtggagtaccggggagaagatgccccctgtaagatccctttcagcacagaggacggccaagggaaagcgcacaacggaagactgattaccgctaatcccgttgtgacgaagaaagaggaacccgtcaacatcgaggccgaacctccgttcggcgagtccaatattgtgatcgggattggcgataacgccctgaagatcaattggtataaaaagggatctagcatcggcaagatgtttgaagctacagcccgcggggctcggagaatggccattcttggagacaccgcgtgggatttcggctccgtggggggagttctcaacagcctgggcaaaatggtccatcagatctttgggtctgcctacaccgctctgttctccggcgtgagctgggtgatgaagattggaatcggcgtcctcctgacatggattgggcttaattctaaaaacaccagcatgtccttttcttgcatcgccattggaatcatcacactgtatctcggcgctgtggttcaggccgacatggggtgtgtgattaattggaagggaaaagagctgaagtgcggcagcgggatcttcgtcacgaacgaggtgcacacctggacagaacagtacaagtttcaagcggattcccccaaacgcctggccaccgctattgccggcgcttgggagaatggagtttgtggcatccggagcacaaccagaatggaaaaccttctctggaagcagattgccaatgagctgaactatatcctgtgggaaaataacatcaaactcacggtggtcgtgggggacattatcggagttctggagcagggcaagcgcacccttacacctcagcccatggagctgaaatactcttggaagacctgggggaaagccaagattgtgacagctgaaacccaaaactccagcttcatcattgatggacctaatacacccgagtgcccgtctgcgtcccgggcctggaacgtctgggaagtggaggactatggctttggcgtgttcaccacgaatatctggctcaagctgagagaagtctacacacagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccacagacccggatatcatacccaaacggctggcccttggcaccttgggaaactggagctcgactttaattactgcgagggaacaaccgtggttattacagaaaactgtggcacccgcggcccctctctgcggacaaccacggtgtccgggaagctgatccacgagtggtgctgtagaagctgcacccttccgcctctccggtatatgggagaagatggctgttggtacgggatggagatccgccccatttctgaaaaagaggagaatatggtcaagtccctggtgagcgccggatctggcaaagttgacaacttcacaatgggggtgctgtgcctcgccatcctgtttgaagaggtcatgagaggaaagttcggcaagaaacatatgattgctggcgtgttctttacccttgttctgctcctgagcgggcagatcacatggcgggatatggcccacaccctgattatgatcggatccaatgcgagcgacagaatgggcatgggggtgacgtatcttgctctgattgccacattcaagatccagccctttctcgccctgggattctttctccgcaaactgacctctcgggaaaaccttctgctcggcgtcgggctggctatggccacaaccctgcaacttcctgaggatatcgaacagatggctaatggaattgccctgggcctcatggcgctgaagctcatcacccagttcgagacataccagctgtggacggcccttatttccctgacctgtagcaacacaatgtttaccctcacagtggcttggagaaccgccacgctgatcctggctggcgtgtcccttctgccggtctgccaatctagctccatgcgcaaaacagactggctccccatggccgttgccgctatgggggtgcctcccctgcctctcttcattttttctctgaaggatacccttaagagacggagctggcccctgaatgagggagtgatggcggtcggcctggtgtccatcctcgcctctagcctgcttcgcaacgacgttcctatggctgggcccctggtggccggaggcctcctgatcgcctgttatgtcattaccgggacatccgctgatctcaccgtggaaaaagccgcggacatcacatgggaggaagaggctgaacagacgggagttagccataacctgatgattaccgtggacgatgacggcacaatgagaatcaaggatgacgagaccgagaatattcttacagtcctgctgaaaaccgccctcctgatcgtgtctggcgtcttcccgtactccatccctgccacgcttctggtgtggcacacctggcagaagcagacacaacggagcggggttctctgggatgtgccctctcctcccgaaacccagaaagctgagctggaagagggagtctaccgcattaagcagcagggcatctttgggaaaacacaagtgggagttggcgtgcagaaggagggggtcttccataccatgtggcacgtgacaagaggagccgtgctcacgtataacggcaagcggctggaaccgaattgggcgtccgttaaaaaggaccttattagctacggcgggggatggcgcctgtctgctcagtggcaaaaaggcgaggaagtccaggtgatcgccgtggagcctgggaagaaccccaaaaattttcagaccatgcctggaacattccagaccaccacaggcgaaattggggccatcgctctggatttcaagcccggaacgtccggcagccccattatcaacagagagggcaaggtcgtggggctctatggaaatggcgttgtgaccaaaaacgggggatacgtctccggcatcgcccaaacaaatgctgagcctgacgggccgacccccgaactggaggaagagatgtttaagaaacggaaccttacaattatggatctgcaccctggcagcggaaagacccgcaaatatctccccgccatcgtgagagaagcgattaagcggagactgcgcacgctcatcctggcccctacacgggttgtggctgccgagatggaggaagctcttaagggcctgcccattagataccagaccaccgccacaaaatctgagcataccgggcgcgaaatcgtcgacctgatgtgccacgccacattcaccatgcggctcctgagccctgtgagagttccgaattataaccttatcattatggatgaggctcattttacggaccccgcgtccatcgccgctcgcggatacatttctacacgggtgggcatgggggaagccgccgctatcttcatgaccgccacacctcccggaaccgcggatgcttttcctcagagcaatgcccccattcaggacgaggagagagacatcccggaacgctcctggaactctggcaatgagtggatcacggatttcgccgggaagaccgtctggtttgtgcctagcattaaagctggcaacgacatcgccaactgtctgcggaagaatggaaaaaaggtgattcaactctccagaaagacattcgataccgaataccagaaaacaaagctgaacgactgggattttgtcgttaccacagacatctctgagatgggcgcgaatttcaaagccgatcgggtgattgacccccgcagatgcctgaagcccgtgatcctcaccgatgggcctgagcgggtcattcttgctggacccatgcctgtgacggccgctagcgccgctcagcgcagaggccgggttgggagaaacccgcagaaagaaaatgaccaatatatctttacaggacagcccctgaacaatgatgaggaccacgcccattggaccgaagcgaagatgctgctcgacaacatcaatacccctgagggcattatccccgccctgttcgaacctgagcgcgagaagtccgctgccattgatggggaataccggcttaaaggcgagagcagaaagacattcgtggaactgatgcgccggggagacctccccgtctggctggctcacaaagtggcctctgagggcatcaagtataccgatagaaaatggtgctttgacgggcagcgcaacaatcagattctggaagagaacatggatgttgagatctggacaaaggaaggagagaaaaagaagctccggccgagatggcttgacgcccgcacgtactccgatcctctggctctgaaagaattcaaggactttgcggccggcagaaaaagcatcgctctcgatctggtgaccgagattgggcgggtcccctctcaccttgcccatcgcacaagaaatgccctggacaacctcgtgatgctgcacacctccgaacatggaggccgggcttatcgccacgccgtcgaggagctgcctgaaacaatggagaccctccttctgctgggcctcatgatcctgcttacggggggagcgatgctgttcctcattagcggcaaggggatcggaaaaacctccattggcctgatctgtgtgatcgcctctagcgggatgctgtggatggctgaaattcccctccaatggatcgcctccgctattgttcttgagtttttcatgatggtgctgctgatccctgagcccgaaaagcagagaacaccgcaggataatcaactcgcctacgtggtcattggaatcctgacccttgcggccattatcgctgccaacgagatgggcctgctcgaaacaaccaagcgggacctgggcatgagcaaagagcctggggttgtgtctcccacgtcctatctggatgtggacctccaccccgctagcgcctggacactttacgctgtcgccaccacagtgatcacccctatgctgagacataccattgaaaattctacagcgaacgttagcctggccgctatcgccaaccaggctgtggtcctcatgggactggacaagggctggccgatttccaaaatggatcttggggtgcccctgctcgccctgggatgctactctcaggtcaatcctctgacgctcaccgccgcggtgcttctgctgatcacacactatgctattatcggccccgggctccaggccaaggctacccgcgaggcccaaaaacggacagccgctggaatcatgaagaaccctaccgttgacggcattatgacgatcgatctggaccccgtgatttacgatagcaagtttgagaaacagcttggccaggtcatgctgctcgtgctgtgtgccgttcagctgctccttatgagaacatcctgggcgctgtgcgaagccctgaccctcgctaccgggcctatcacaaccctgtgggagggatctccgggcaagttctggaatacaacgattgccgtgagcatggctaacatctttcgcgggtcctatcttgccggagcgggcctggccttcagcatcatgaaatctgtcgggaccggaaagcggggcacaggctcccaaggggaaaccctcggagagaaatggaagaagaaactgaatcagctgagcagaaaggaatttgacctctacaaaaagtccggcattacagaggtggatcggaccgaggctaaagaagggcttaagcgcggagagatcacgcatcacgccgtgtctagaggcagcgctaaactgcagtggttcgttgaacggaacatggtcattcccgaggggcgcgtgatcgacctgggatgtggcagaggcgggtggtcctattactgcgccggactcaagaaggtgaccgaagtccggggctatacaaaagggggacctggccatgaggagcccgttcctatgtctacctacgggtggaatattgtgaagctgatgagcggaaaagatgtgttttaccttcccccggaaaagtgtgacacactgctctgcgatatcggcgagtccagcccttctcccaccgtcgaagagtcccgcacaattagagtgctgaaaatggttgagccctggctgaagaacaatcagttctgtatcaaggtgctcaacccttatatgcccaccgtcatcgaacaccttgagcggctgcaacgcaaacacggcgggatgctggtgagaaatcctctcagccggaactctacgcatgaaatgtactggatttccaatggaacaggcaacatcgttgctagcgtgaataccgtctctagactgcttctgaaccgcttcaccatgacacaccggagaccgacgaccgagaaggacgtggatctcggggccggaacacgccatgtgaacgcggaacccgagacccctaatatggacgtcattggcgagcggatcaaaagaattaaggaagagcacaacagcacatggcactatgacgatgaaaatccctacaaaacctgggcctatcatgggtcctacgaggttaaggctacaggatctgccagctccatgatcaacggcgtggtgaagctgctgaccaaaccttgggacgtcgtgcccatggttacgcagatggctatgaccgatacaaccccgtttggccagcaacgcgtgttcaaggaaaaagtcgacacacggacccctagaagcatgcccgggacgcgccgggtgatgggaatcacagccgagtggctctggagaaccctgggccgcaataagaaacctcggctttgcacaagagaggaatttaccaagaaggttcgcacgaacgccgcgatgggggctgtgttcaccgaggaaaatcagtgggattccgccaaagccgctgtcgaggacgaagatttttggaagctggtggacagagagcgggagctccacaaactgggaaagtgtggctcttgcgtttataacatgatggggaaacgcgaaaagaaacttggcgagttcggaaaggccaagggcagcagagctatttggtacatgtggctgggggcccggtacctcgaatttgaggcgctgggattcctgaatgaggatcattggttttccagagaaaactcttatagcggcgtggagggggaaggactccacaaactgggctacatccttcgggacatttccaagatccccgggggcgccatgtatgctgatgacacagccggatgggacacccgcattacagaggatgacctgcataatgaagagaaaatcacccagcagatggatcctgagcacagacaactcgctaacgccatcttcaagctgacataccagaataaagtcgtgaaggtccagcggcccaccccgacgggcacagtgatggacattatctctcgcaaggatcagagagggagcggacaagttggcacctatgggcttaacacctttacaaatatggaagcgcagctgattcggcagatggagggagaaggcgtgctctccaaagccgacctggagaaccctcacctgcccgaaaagaaaatcacccagtggctcgagacaaagggggtcgagcgcctgaaaagaatggctattagcggcgatgactgcgtggtgaagcccatcgatgaccggttcgccaacgctcttctggccctcaatgatatgggaaaggttcgcaaagacatccctcaatggcagccgtctaagggctggcatgattggcagcaggtgcccttttgttcccaccatttccacgaactgattatgaaagacgggagaaagcttgtcgtgccttgccggccccaagacgagctgatcggacgcgctagaattagccagggcgccgggtggtctctccgggaaacggcgtgtctgggaaaagcctacgctcagatgtggtccctgatgtatttccaccgcagagatctccggctggccagcaacgccatctgctctgctgttcctgtgcattgggtccccacctccagaacaacctggagcattcacgcccatcaccaatggatgacaaccgaggacatgcttacggtgtggaatcgcgtctggatcgaagataacccttggatggaggacaagacccccgtgacaacctgggagaatgttccgtacctgggcaagcgggaagatcagtggtgtgggtccctcattggcctgacaagcagagcgacctgggctcagaacatccctacggccatccagcaagtgcgctctcttattggaaatgaggaatttctggactacatgcccagcatgaaacggttcagaaaggaggaggaatccgagggcgccatctggtga

SEQ ID NO: 20371 - RNA, 9873 nt, synthetic construct
  misc_feature 1..9873: note = derived and/or modified CDS sequence (opt5) from DENV-3__JX669506__SS-prME
  source 1..9873: mol_type = other RNA
accagcttctgcctgatgatgatcctccccgccgctctggcctttcaccttacatccagagacggcgagcctcggatgattgtggggaagaacgaacgcggaaaatctctgctcttcaagacggcgagcggcatcaatatgtgtaccctgattgctatggatcttggggagatgtgcgacgatacagtcacctacaaatgtccgcatatcacagaagttgagcccgaagacattgattgctggtgtaacctgacctccacatgggtgacctatggaacgtgcaatcaggccggcgagagacggcgcgacaagagatctgtggccctcgctcctcacgtcgggatgggactggatacccggacacaaacctggatgagcgccgagggcgcttggcgccaggtggaaaaagttgagacatgggccctgagacatcccggctttaccatcctcgcgctgttccttgcccactacatcgggacgtccctgacacagaaggtggtcatttttatcctcctgatgcttgtgaccccttctatgacaatgcggtgtgttggagtgggcaaccgcgacttcgtcgaagggctgagcggagctacctgggtggatgtggtcctcgagcatggcgggtgcgttaccacaatggccaagaataaacccacgctggacattgagctgcagaagaccgaagctacacaactcgccaccctgagaaaactttgtatcgagggaaagattacaaacatcaccacggattcccggtgccctacacagggcgaagcggtgctgccggaggaacaggaccagaattatgtgtgtaaacacacctacgtcgatcgcggctgggggaacggatgcggcctctttgggaagggaagcctggtgacctgcgccaagttccaatgtcttgagcccattgagggcaaagttgtgcagtatgaaaatctgaagtacacagtcatcatcaccgtgcacacaggggaccagcatcaggttggaaacgagacgcaaggcgtgaccgctgaaattacacctcaggcctctaccacagaggctatcctccccgaatatggcaccctggggctggagtgctcccctagaacgggactcgactttaatgagatgattctgcttaccatgaaaaacaaggcctggatggtccaccggcagtggttctttgatctgcccctcccgtggacaagcggcgccaccacagaaacccctacgtggaatcgcaaagagctgcttgtgacattcaagaacgctcatgcgaaaaagcaagaagtcgtggttctggggtctcaggagggagccatgcacaccgctctcacaggcgccaccgaaatccagaattccgggggcaccagcatttttgccggacacctgaagtgtagactgaaaatggacaagctcgagctgaaaggcatgtcttacgctatgtgcacaaacacgttcgtgcttaagaaagaggtctccgaaacccagcatgggacaatcctgatcaaggtggagtacaagggagaagatgccccctgtaaaattcctttcagcaccgaggacggccaagggaaggcgtataacggacggctcatcacagctaatcccgttgtgaccaaaaaggaggaacccgtcaacattgaggccgaacctccgtttggcgagtccaatatcgtgattgggatcggcgataacgccctgaaaatcaattggtacaagaagggatctagcattggcaaaatgttcgaagctacggccagaggggctcgccggatggccatcctgggagacacagcgtgggattttggctccgtggggggagttcttaacagcctcggcaagatggtccaccagattttcgggtctgcctataccgctctgttttccggcgtgagctgggtgatgaaaatcggaattggcgtcctgctcacctggatcgggctgaattctaagaacacaagcatgtccttctcttgcattgccatcggaatcattaccctttacctgggcgctgtggttcaggccgacatggggtgtgtgatcaattggaaaggaaaggagctcaagtgcggcagcgggatttttgtcacaaacgaggtgcatacgtggaccgaacagtataaattccaagcggattcccccaagagactggccacagctatcgccggcgcttgggagaatggagtttgtggcattcgcagcaccacacggatggaaaacctgctttggaaacagatcgccaatgagctcaactacatcctgtgggaaaataacattaagctgaccgtggtcgtgggggacatcattggagttctcgagcagggcaaaagaacgctgacccctcagcccatggagcttaagtattcttggaaaacatgggggaaggccaagatcgtgaccgctgaaacacaaaactccagctttattatcgatggacctaatacccccgagtgcccgtctgcgtcccgcgcctggaacgtctgggaagtggaggactacggcttcggcgtgtttacaaccaatatctggctgaaactccgggaagtctacacgcagctgtgtgaccacagactgatgagcgctgccgttaaggatgagcgcgccgtgcatgctgacatggggtattggattgagtcccagaaaaacggatcttggaagcttgaaaaagccagcctcatcgaggtgaagacatgcacctggcctaagtcccacaccctgtggtctaatggcgtcctggaaagcgatatgattatccccaaatccctcgcggggcctattagccagcacaaccatcggcccggataccacacacaaaccgctggcccttggcatctggggaagcttgagctggacttcaattattgcgagggaacgacagtggttatcaccgaaaactgtggcacaagaggcccctctctccgcaccacaaccgtgtccgggaaactgatccacgagtggtgctgtcggagctgcacgctgccgcctcttagatacatgggagaagatggctgttggtatgggatggagattcggcccatctctgaaaaggaggagaatatggtcaaatccctcgtgagcgccggatctggcaaggttgacaactttaccatgggggtgctgtgcctggccattctcttcgaagaggtcatgcgcggaaagttcggcaaaaagcacatgatcgctggcgtgtttttcacatttgttctgcttctgagcgggcagattacctggagagatatggcccatacactcatcatgattggatccaatgcgagcgaccggatgggcatgggggtgacctacctggctctgatcgccacgttcaaaatccagccctttcttgccctgggattctttctcagaaagctgacatctcgcgaaaacctcctgcttggcgtcgggctggctatggccaccacactccaactgcctgaggatattgaacagatggctaatggaatcgccctgggccttatggcgctgaaactcattacccagttcgagacctatcagctgtggacagccctcatctccctgacgtgtagcaacaccatgtttacacttaccgtggcttggcggacagccaccctgattctcgctggcgtgtccctgctgccggtctgccaatctagctccatgagaaagacggactggcttcccatggccgttgccgctatgggggtgcctcccctgcctctcttcatcttttctctgaaggatacactcaaacgcagaagctggcccctgaatgagggagtgatggcggtcggccttgtgtccatcctggcctctagcctgctccggaacgacgttcctatggctgggcccctggtggccggaggccttctgattgcctgttacgtcatcaccgggacctccgctgatctcacagtggaaaaggccgcggacattacctgggaggaagaggctgaacagacaggagttagccacaacctgatgatcacggtggacgatgacggcaccatgcgcattaaagatgacgagacagagaatatcctcaccgtcctgcttaagacagccctgctgatcgtgtctggcgtcttcccgtactccattcctgccaccctcctggtgtggcatacgtggcagaaacagacccaaagaagcggggttctttgggatgtgccctctcctcccgaaacacagaaggctgagctggaagagggagtctatcggatcaaacagcagggcatttttgggaagacccaagtgggagttggcgtgcagaaggagggggtcttccacacaatgtggcatgtgacccgcggagccgtgctcacatacaacggcaaaagactggaaccgaattgggcgtccgttaagaaagacctcatcagctatggcgggggatggcggctgtctgctcagtggcaaaagggcgaggaagtccaggtgattgccgtggagcctgggaaaaaccccaagaatttccagacgatgcctggaacctttcagacaaccaccggcgaaatcggggccattgctcttgatttcaagcccggaacatccggcagccccatcatcaaccgcgagggcaaagtcgtggggctgtacggaaatggcgttgtgacgaagaacgggggatatgtctccggcattgcccaaaccaatgctgagcctgacgggccgacacccgaactggaggaagagatgtttaaaaagagaaacctcaccatcatggatctgcaccctggcagcggaaaaacacggaagtaccttcccgccattgtgcgcgaagcgatcaagagacggctgagaaccctcattctggcccctacgcgcgttgtggctgccgagatggaggaagctctcaaaggcctgcccatccggtatcagacaaccgccaccaagtctgagcacacagggagagaaatcgtcgaccttatgtgccatgccaccttcacaatgcgcctgctgagccctgtgcgggttccgaattacaacctcattatcatggatgaggctcactttaccgaccccgcgtccattgccgctagaggatacatctctacgcgcgtgggcatgggggaagccgccgctattttcatgacagccacccctcccggaacagcggatgcttttcctcagagcaatgcccccatccaggacgaggagcgggacatcccggaaagatcctggaactctggcaatgagtggattaccgatttcgccgggaaaacggtctggtttgtgcctagcatcaaggctggcaacgacattgccaactgtctgcgcaaaaatggaaagaaggtgatccaactttcccggaaaaccttcgatacagaatatcagaagaccaaactgaacgactgggattttgtcgttacaaccgacatttctgagatgggcgcgaatttcaaggccgatagagtgatcgacccccggcgctgcctcaaacccgtgattctgacagatgggcctgagagagtcatcctggctggacccatgcctgtgaccgccgctagcgccgctcagcggcgcggcagagttgggcggaacccgcagaaggaaaatgaccaatacatcttcacgggacagcccctcaacaatgatgaggaccatgcccactggacagaagcgaagatgcttctggacaacattaatacccctgagggcatcattcccgccctgtttgaacctgagagagagaaatccgctgccatcgatggggaatatcgcctcaagggcgagagccggaaaaccttcgtggaactgatgagacgcggagaccttcccgtctggctggctcataaggtggcctctgagggcattaaatacacagatcggaagtggtgctttgacgggcagagaaacaatcagatcctcgaagagaacatggatgttgagatctggaccaaagaaggagagaagaagaaactgcgcccgcggtggctggacgccagaacatattccgatcctctcgctcttaaggaattcaaagactttgcggccggccgcaagagcattgctctggatctggtgacggagatcgggagagtcccctctcacctcgcccaccggacccgcaatgccctggacaaccttgtgatgctgcatacatccgaacacggaggcagagcttaccggcatgccgtcgaggagctccctgaaaccatggagacactgctgctccttggcctgatgattctgctcaccgggggagcgatgctgttccttatcagcggcaaagggattggaaagacgtccatcggcctgatctgtgtgattgcctctagcgggatgctctggatggctgaaatccccctgcaatggattgcctccgctatcgttctggagtttttcatgatggtgctccttattcctgagcccgaaaagcagcgcaccccgcaggataatcaactggcctatgtggtcatcggaattctgacactcgcggccatcatcgctgccaacgagatgggcctgcttgaaaccacaaaaagagacctgggcatgagcaaggagcctggggttgtgtctcccacctcctacctcgatgtggacctgcaccccgctagcgcctggacgctgtacgctgtcgccacaaccgtgattacacctatgctccggcacaccatcgaaaattctaccgcgaacgttagccttgccgctattgccaaccaggctgtggtcctgatgggactggacaaaggctggccgatctccaagatggatctcggggtgcccctgcttgccctgggatgctattctcaggtcaatcctctcacactgacggccgcggtgctgctccttattacccattacgctatcatcggccccgggctgcaggccaaagctacaagagaggcccaaaagcgcaccgccgctggaattatgaagaaccctacagttgacggcatcatgaccattgatctggaccccgtgatctatgatagcaaatttgagaagcagctcggccaggtcatgctgcttgtgctgtgtgccgttcagctcctgctgatgcggacgtcctgggcgctctgcgaagcccttacactggctaccgggcctattaccacactgtgggagggatctccgggcaaattctggaataccacaatcgccgtgagcatggctaacatctttagagggtcctacctcgccggagcgggcctggccttcagcattatgaagtctgtcgggacgggaaaacgcggcaccggctcccaaggggaaacacttggagagaagtggaagaaaaagctgaatcagctcagccggaaagaatttgacctgtataagaaatccggcatcaccgaggtggatagaacagaggctaaggaagggctgaaacggggagagattacccaccatgccgtgtctcgcggcagcgctaagctccagtggttcgttgaaagaaacatggtcatccccgaggggcgggtgattgaccttggatgtggccgcggcgggtggtcctactattgcgccggactgaagaaagtgacggaagtcagaggctacaccaaggggggacctggccacgaggagcccgttcctatgtctacatacgggtggaatatcgtgaaactgatgagcggaaaggatgtgttctatctccccccggaaaaatgtgacaccctgctttgcgatattggcgagtccagcccttctcccacagtcgaagagtcccggaccatccgcgtgctgaagatggttgagccctggctcaagaacaatcagttttgtatcaaagtgctgaacccttacatgcccacagtcattgaacatctggagagactccaacggaagcacggcgggatgcttgtgcgcaatcctctgagcagaaactctacccacgaaatgtattggatctccaatggaacgggcaacattgttgctagcgtgaatatggtctctcggctgctcctgaacagattcacaatgacccatcgccggccgaccatcgagaaagacgtggatcttggggccggaacaagacacgtgaacgcggaacccgagacgcctaatatggacgtcattggcgagcgcatcaagcggatcaaagaagagcataacagcacctggcactacgacgatgaaaatccctataagacatgggcctaccacgggtcctatgaggttaaggctaccggatctgccagctccatgattaacggcgtggtgaaactgctcacaaagccttgggacgtcgtgcccatggttacccagatggctatgacagataccacgccgtttggccagcaaagagtgttcaaagaaaaggtcgacacccgcacacctcggagcatgcccgggaccagacgcgtgatgggaatcacagccgagtggctgtggcggaccctgggcagaaataaaaagcctcgcctctgcacgcgggaggaatttacaaagaaagttagaaccaacgccgcgatgggggctgtgttcacagaggaaaatcagtgggattccgccaaggccgctgtcgaggacgaagatttttggaaactggtggaccgcgagagagagcttcataagctgggaaaatgtggctcttgcgtttacaacatgatggggaagcgggaaaaaaagctcggcgagttcggaaaggccaaaggcagccgcgctatttggtacatgtggctgggggccagatatcttgaatttgaggcgctgggattcctcaatgaggatcactggttttcccgggaaaactcttacagcggcgtggagggggaaggactgcataagctgggctatatcctcagagacatttccaaaatccccgggggcgccatgtacgctgatgacaccgccggatgggacacgcggatcaccgaggatgacctgcacaatgaagagaagattacacagcagatggatcctgagcatcgccaacttgctaacgccatcttcaaactgacctatcagaataaggtcgtgaaggtccagagacccacaccgaccggcacagtgatggacattatctctcggaaagatcagcgcgggagcggacaagttggcacctacgggctcaacacgtttacaaatatggaagcgcagctgattagacagatggagggagaaggcgtgctttccaaggccgacctggagaaccctcacctccccgaaaaaaagatcacccagtggctggagaccaaaggggtcgagcggctgaagcgcatggctatcagcggcgatgactgcgtggtgaagcccattgatgacagattcgccaacgctctcctggcccttaatgatatgggaaaagttcggaaggacatccctcaatggcagccgtctaaaggctggcacgattggcagcaggtgcccttctgttcccatcactttcatgaactgattatgaaggacgggcgcaaactcgtcgtgccttgcagaccccaagacgagctgatcggacgggctcgcattagccagggcgccgggtggtctcttagagaaacagcgtgtctgggaaaggcctatgctcagatgtggtccctcatgtacttccaccggcgcgatctgagactggccagcaacgccatctgctctgctgttcctgtgcactgggtccccacctcccggacaacgtggagcattcatgcccaccatcaatggatgaccacagaggacatgctcaccgtgtggaatagagtctggatcgaagataacccttggatggaggacaagacacccgtgaccacgtgggagaatgttccgtacctgggcaaacgcgaagatcagtggtgtgggtcccttatcggcctgaccagccgggcgacatgggctcagaacattcctaccgccatccagcaagtgagatctctcattggaaatgaggaatttctggactatatgcccagcatgaagcgcttccggaaagaggaggaatccgagggcgccatctggtga

SEQ ID NO: 20372 - RNA, 9873 nt, synthetic construct
  misc_feature 1..9873: note = derived and/or modified CDS sequence (opt5) from DENV-3__JX669496__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcaccaatatgtgtacacttatcgctatggatctgggggagatgtgcgacgataccgtcacatacaaatgtccgcatattaccgaagttgagcccgaagacatcgattgctggtgtaacctcacatccacctgggtgacgtatggaacctgcaatcaggccggcgagagacggcgcgacaagagatctgtggccctggctcctcacgtcgggatgggactggatacacggacccaaacatggatgagcgccgagggcgcttggcgccaggtggaaaaagttgagacctgggccctcagacatcccggcttcacgattctggcgctttttctggcccactacatcgggacatccctcacccagaaggtggtcatcttcattctgcttatgctggtgacaccttctatgaccatgcggtgtgttggagtgggcaaccgcgactttgtcgaagggctcagcggagctacctgggtggatgtggtcctggagcatggcgggtgcgttacaacgatggccaagaataaacccaccctggacatcgagctccagaagacagaagctacccaactggccacacttagaaaactgtgtattgagggaaagatcaccaacattacgacagattcccggtgccctacccagggcgaagcggtgctcccggaggaacaggaccagaattatgtgtgtaaacacacctacgtcgatcgcggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcacacgggggaccagcatcaggttggaaacgagacccaaggcgtgacagctgaaatcacccctcaggcctctacaaccgaggctattctgcccgaatatggcacgctggggctcgagtgctcccctagaaccggactggacttcaatgagatgatccttctgacaatgaaaaacaaggcctggatggtccaccggcagtggtttttcgatctccccctgccgtggaccagcggcgccacaaccgaaacgcctacatggaatcgcaaagagcttctggtgacctttaagaacgctcatgcgaaaaagcaagaagtcgtggttctcgggtctcaggagggagccatgcacacagctctgaccggcgccaccgaaattcagaattccgggggcacaagcatcttcgccggacacctgaagtgtagactcaaaatggacaagctggagcttaaaggcatgtcttacgctatgtgcgccaacacgtttgtgctgaagaaagaggtctccgaaacccagcatgggacaattctcatcaaggtggagtaccggggagaagatgcgccctgtaagatccctttcagcaccgaggacggccaagggaaagctcacaacggaagactgattacagccaatcccgttgtgaccaagaaagaggaacccgtcaacatcgaggccgaacctccgttcggcgagtccaatattgtgatcgggattggcgataacgctctgaagatcaattggtataaaaagggatctagcatcggcaagatgtttgaagccacggctcgcggggcccggagaatggcgattcttggagacacagcctgggatttcggctccgtggggggagttctcaacagcctgggcaaaatggtccatcagatctttgggtctgcttacaccgccctgttctccggcgtgagctgggtgatgaagattggaatcggcgtcctcctgacctggattgggcttaattctaaaaacacaagcatgtccttttcttgcatcgctattggaatcatcaccctgtatctcggcgccgtggttcaggcggacatggggtgtgtgattaattggaagggaaaagagctgaagtgcggcagcgggatcttcgtcacaaacgaggtgcacacgtggaccgaacagtacaagtttcaagccgattcccccaaacgcctggctacagccattgctggcgcctgggagaatggagtttgtggcatccggagcaccacaagaatggaaaaccttctctggaagcagattgccaatgagctgaactatatcctgtgggaaaataacatcaaactcaccgtggtcgtgggggacattatcggagttctggagcagggcaagcgcacgcttacccctcagcccatggagctgaaatactcttggaagacatgggggaaagctaagattgtgaccgcggaaacacaaaactccagcttcatcattgatggacctaatacccccgagtgcccgtctgcctcccgggcttggaacgtctgggaagtggaggactatggctttggcgtgttcacaaccaatatctggctcaagctgagagaagtctacacgcagctgtgtgaccatcgccttatgagcgccgccgttaaagatgagcgggctgtgcacgccgacatggggtactggatcgagtcccagaagaacggatcttggaaactcgaaaaggcgagcctgattgaggtgaaaacatgcacctggcctaagtcccacaccctgtggtctaatggcgtcctcgaaagcgatatgatcattcccaagtccctggctgggcctatcagccagcataaccacagacccggatatcatacacaaaccgccggcccttggcaccttgggaaactggagctcgactttaattactgcgagggaacgacagtggttattaccgaaaactgtggcacacgcggcccctctctgcggaccacaaccgtgtccgggaagctgatccacgagtggtgctgtagaagctgcacgcttccgcctctccggtatatgggagaagatggctgttggtacgggatggagatccgccccatttctgaaaaagaggagaatatggtcaagtccctggtgagcgccggatctggcaaagttgacaacttcaccatgggggtgctgtgcctcgctatcctgtttgaagaggtcatgagaggaaagttcggcaagaaacatatgattgccggcgtgcttttcacatttgttctgctcctgagcgggcagatcacctggcgggatatggcgcacacactgattatgatcggatccaatgctagcgacagaatgggcatgggggtgacctatcttgccctgattgccacgttcaagatccagccctttctcgctctgggattctttctccgcaaactgacatctcgggaaaaccttctgctcggcgtcgggctggccatggctaccacactgcaacttcctgaggatatcgaacagatggccaatggaattgcgctgggcctcatggccctgaagctcatcacccagttcgagacctaccagctgtggacagctcttatttccctgacgtgtagcaacaccatgtttacactcaccgtggcctggagaacagctaccctgatcctggccggcgtgtcccttctgccggtctgccaatctagctccatgcgcaaaacggactggctccccatggccgttgctgcgatgggggtgcctcccctgcctctcttcattttttctctgaaggatacacttaagagacggagctggcccctgaatgagggagtgatggccgtcggcctggtgtccatcctcgcttctagcctgcttcgcaacgacgttcctatggccgggcccctggtggccggaggcctcctgatcgcttgttatgtcattaccgggacctccgccgatctcacagtggaaaaagcggctgacatcacctgggaggaagaggccgaacagacaggagttagccataacctgatgattacggtggacgatgacggcaccatgagaatcaaggatgacgagacagagaatattcttaccgtcctgctgaaaacagccctcctgatcgtgtctggcgtcttcccgtactccatccctgctacccttctggtgtggcacacgtggcagaagcagacccaacggagcggggttctctgggatgtgccctctcctcccgaaacacagaaagccgagctggaagagggagtctaccgcattaagcagcagggcatctttgggaaaacccaagtgggagttggcgtgcagaaggagggggtcttccatacaatgtggcacgtgaccagaggagcggtgctcacatataacggcaagcggctggaaccgaattgggcttccgttaaaaaggaccttattagctacggcgggggatggcgcctgtctgcccagtggcaaaaaggcgaggaagtccaggtgatcgccgtggagcctgggaagaaccccaaaaattttcagacgatgcctggaaccttccagacaaccaccggcgaaattggggctatcgccctggatttcaagcccggaacatccggcagccccattatcaacagagagggcaaggtcgtggggctctatggaaatggcgttgtgacgaaaaacgggggatacgtctccggcatcgctcaaaccaatgccgagcctgacgggccgacacccgaactggaggaagagatgtttaagaaacggaaccttaccattatggatctgcaccctggcagcggaaagacacgcaaatatctccccgcgatcgtgagagaagccattaagcggagactgcgcaccctcatcctggctcctacgcgggttgtggccgctgagatggaggaagcccttaagggcctgcccattagataccagacaaccgccaccaaatctgagcatacagggcgcgaaatcgtcgacctgatgtgccacgctaccttcacaatgcggctcctgagccctgtgagagttccgaattataaccttatcattatggatgaggcgcattttaccgaccccgcctccatcgctgcccgcggatacatttctacgcgggtgggcatgggggaagccgctgccatcttcatgacagcgacccctcccggaacagctgatgcctttcctcagagcaatgcccccattcaggacgaggagagagacatcccggaacgctcctggaactctggcaatgagtggatcaccgatttcgctgggaagacggtctggtttgtgcctagcattaaagccggcaacgacatcgcgaactgtctgcggaagaatggaaaaaaggtgattcaactctccagaaagaccttcgatacagaataccagaaaaccaagctgaacgactgggattttgtcgttacaaccgacatctctgagatgggcgccaatttcaaagctgatcgggtgattgacccccgcagatgcctgaagcccgtgatcctcacagatgggcctgagcgggtcattcttgccggacccatgcctgtgaccgctgccagcgctgcccagcgcagaggccgggttgggagaaacccgcagaaagaaaatgaccaatatatctttacgggacagcccctgaacaatgatgaggaccacgcgcattggacagaagccaagatgctgctcgacaacatcaatacccctgagggcattatccccgctctgttcgaacctgagcgcgagaagtccgccgctattgatggggaataccggcttaaaggcgagagcagaaagaccttcgtggaactgatgcgccggggagacctccccgtctggctggcccacaaagtggcctctgagggcatcaagtatacagatagaaaatggtgctttgacgggcagcgcaacaatcagattctggaagagaacatggatgttgagatctggaccaaggaaggagagaaaaagaagctccggccgagatggcttgacgctcgcacatactccgatcctctggcgctgaaagaattcaaggactttgccgctggcagaaaaagcatcgccctcgatctggtgacggagattgggcgggtcccctctcaccttgcccatcgcaccagaaatgctctggacaacctcgtgatgctgcacacatccgaacatggaggccgggcctatcgccacgcggtcgaggagctgcctgaaaccatggagacactccttctgctgggcctcatgatcctgcttaccgggggagccatgctgttcctcattagcggcaaggggatcggaaaaacgtccattggcctgatctgtgtgatcgcttctagcgggatgctgtggatggccgaaattcccctccaatggatcgcttccgccattgttcttgagtttttcatgatggtgctgctgatccctgagcccgaaaagcagagaaccccgcaggataatcaactcgcgtacgtggtcattggaatcctgacacttgccgctattatcgccgctaacgagatgggcctgctcgaaaccacaaagcgggacctgggcatgagcaaagagcctggggttgtgtctcccacctcctatctggatgtggacctccaccccgccagcgcttggacgctttacgccgtcgcgacaaccgtgatcacacctatgctgagacataccattgaaaattctaccgccaacgttagcctggctgccatcgctaaccaggccgtggtcctcatgggactggacaagggctggccgatttccaaaatggatcttggggtgcccctgctcgccctgggatgctactctcaggtcaatcctctgacactcacggcggctgtgcttctgctgatcacccactatgccattatcggccccgggctccaggctaaggccacacgcgaggcccaaaaacggaccgctgccggaatcatgaagaaccctacagttgacggcattatgaccatcgatctggaccccgtgatttacgatagcaagtttgagaaacagcttggccaggtcatgctgctcgtgctgtgtgcggttcagctgctccttatgagaacgtcctgggccctgtgcgaagctctgacactcgccaccgggcctatcaccacactgtgggagggatctccgggcaagttctggaataccacaattgctgtgagcatggccaacatctttcgcgggtcctatcttgcgggagccggcctggctttcagcatcatgaaatctgtcgggacgggaaagcggggcaccggctcccaaggggaaacactcggagagaaatggaagaagaaactgaatcagctgagcagaaaggaatttgacctctacaaaaagtccggcattaccgaggtggatcggacagaggccaaagaagggcttaagcgcggagagatcacccatcacgctgtgtctagaggcagcgccaaactgcagtggttcgttgaacggaacatggtcattcccgaggggcgcgtgatcgacctgggatgtggcagaggcgggtggtcctattactgcgctggactcaagaaggtgacggaagtccggggctataccaaagggggacctggccatgaggagcccgttcctatgtctacatacgggtggaatattgtgaagctgatgagcggaaaagatgtgttttaccttcccccggaaaagtgtgacaccctgctctgcgatatcggcgagtccagcccttctcccacagtcgaagagtcccgcaccattagagtgctgaaaatggttgagccctggctgaagaacaatcagttctgtatcaaggtgctcaacccttatatgcccacagtcatcgaacaccttgagcggctgcaacgcaaacacggcgggatgctggtgagaaatcctctcagccggaactctacccatgaaatgtactggatttccaatggaacgggcaacatcgttgccagcgtgaatacagtctctagactgcttctgaaccgcttcaccatgacccaccggagaccgacaacggagaaggacgtggatctcggggcgggaacccgccatgtgaacgccgaacccgagacacctaatatggacgtcattggcgagcggatcaaaagaattaaggaagagcacaacagcacctggcactatgacgatgaaaatccctacaaaacatgggcttatcatgggtcctacgaggttaaggccaccggatctgctagctccatgatcaacggcgtggtgaagctgctgacaaaaccttgggacgtcgtgcccatggttacccagatggccatgacggataccacaccgtttggccagcaacgcgtgttcaaggaaaaagtcgacacccggacacctagaagcatgcccgggacccgccgggtgatgggaatcacggccgagtggctctggagaacactgggccgcaataagaaacctcggctttgcaccagagaggaatttacaaagaaggttcgcaccaacgcggctatgggggccgtgttcacggaggaaaatcagtgggattccgccaaagctgccgtcgaggacgaagatttttggaagctggtggacagagagcgggagctccacaaactgggaaagtgtggctcttgcgtttataacatgatggggaaacgcgaaaagaaacttggcgagttcggaaaggctaagggcagcagagccatttggtacatgtggctgggggcgcggtacctcgaatttgaggccctgggattcctgaatgaggatcattggttttccagagaaaactcttatagcggcgtggagggggaaggactccacaaactgggctacatccttcgggacatttccaagatccccgggggcgctatgtatgccgatgacaccgctggatgggacacacgcattaccgaggatgacctgcataatgaagagaaaatcacacagcagatggatcctgagcacagacaactcgccaacgcgatcttcaagctgacctaccagaataaagtcgtgaaggtccagcggcccacaccgaccggcacggtgatggacattatctctcgcaaggatcagagagggagcggacaagttggcacatatgggcttaacacctttaccaatatggaagcccagctgattcggcagatggagggagaaggcgtgctctccaaagctgacctggagaaccctcacctgcccgaaaagaaaatcacacagtggctcgagaccaagggggtcgagcgcctgaaaagaatggccattagcggcgatgactgcgtggtgaagcccatcgatgaccggttcgctaacgcccttctggctctcaatgatatgggaaaggttcgcaaagacatccctcaatggcagccgtctaagggctggcatgattggcagcaggtgcccttttgttcccaccatttccacgaactgattatgaaagacgggagaaagcttgtcgtgccttgccggccccaagacgagctgatcggacgcgccagaattagccagggcgcggggtggtctctccgggaaacagcctgtctgggaaaagcttacgcccagatgtggtccctgatgtatttccaccgcagagatctccggctggccagcaacgctatctgctctgccgttcctgtgcattgggtccccacgtccagaaccacatggagcattcacgcgcatcaccaatggatgaccacagaggacatgcttaccgtgtggaatcgcgtctggatcgaagataacccttggatggaggacaagacgcccgtgaccacatgggagaatgttccgtacctgggcaagcgggaagatcagtggtgtgggtccctcattggcctgaccagcagagctacatgggcccagaacatccctaccgccatccagcaagtgcgctctcttattggaaatgaggaatttctggactacatgcccagcatgaaacggttcagaaaggaggaggaatccgagggcgctatctggtga

SEQ ID NO: 20373 - RNA, 9873 nt, synthetic construct
  misc_feature 1..9873: note = derived and/or modified CDS sequence (opt5) from DENV-3__JX669490__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtaccggggagaagatgccccctgtaagattcctttcagcaccgaggacggccaagggaaagcgcacaacggaagactgatcacagctaatcccgttgtgaccaagaaagaggaacccgtcaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgtggggggagttctcaacagcctgggcaaaatggtccatcagatttttgggtctgcctacaccgctctgttctccggcgtgagctgggtgatgaagatcggaattggcgtcctcctgacctggatcgggcttaattctaaaaacacaagcatgtccttttcttgcattgccatcggaatcattaccctgtatctcggcgctgtggttcaggccgacatggggtgtgtgatcaattggaagggaaaagagctgaagtgcggcagcgggattttcgtcacaaacgaggtgcacacgtggaccgaacagtacaagtttcaagcggattcccccaaacgcctggccacagctatcgccggcgcttgggagaatggagtttgtggcattcggagcaccacaagaatggaaaaccttctctggaagcagatcgccaatgagctgaactatatcctgtgggaaaataacattaaactcaccgtggtcgtgggggacatcattggagttctggagcagggcaagcgcacgcttacccctcagcccatggagctgaaatactcttggaagacatgggggaaagccaagatcgtgaccgctgaaacacaaaactccagcttcattatcgatggacctaatacccccgagtgcccgtctgcgtcccgggcctggaacgtctgggaagtggaggactatggctttggcgtgttcacaaccaatatctggctcaagctgagagaagtctacacgcagctgtgtgaccatcgccttatgagcgctgccgttaaagatgagcgggccgtgcacgctgacatggggtactggattgagtcccagaagaacggatcttggaaactcgaaaaggccagcctgatcgaggtgaaaacatgcacctggcctaagtcccacaccctgtggtctaatggcgtcctcgaaagcgatatgattatccccaagtccctggcggggcctattagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgatccacgagtggtgctgtagaagctgcacgcttccgcctctccggtatatgggagaagatggctgttggtacgggatggagattcgccccatctctgaaaaagaggagaatatggtcaagtccctggtgagcgccggatctggcaaagttgacaacttcaccatgggggtgctgtgcctcgccattctgtttgaagaggtcatgagaggaaagttcggcaagaaacatatgatcgctggcgtgttctttacattcgttcttctgctcagcgggcagattacctggcgggatatggcccacacactgatcatgattggatccaatgcgagcgacagaatgggcatgggggtgacctatctggctcttatcgccacgtttaagatccagcccttcctggccctcggatttttcctgcgcaaactcacatctcgggaaaacctgcttctgggcgtcgggctcgctatggccaccacactgcaactgcctgaggatattgaacagatggctaatggaatcgcccttggcctgatggcgctcaagctgattacccagtttgagacctaccagctctggacagccctgatctcccttacgtgtagcaacaccatgttcacactgaccgtggcttggagaacagccaccctcattctggctggcgtgtccctgcttccggtctgccaatctagctccatgcgcaaaacggactggctgcccatggccgttgccgctatgggggtgcctcccctccctctgtttatcttctctctcaaggatacactgaagagacggagctggccccttaatgagggagtgatggcggtcggcctggtgtccatcctggcctctagcctcctgcgcaacgacgttcctatggctgggccccttgtggccggaggcctgctcattgcctgttatgtcatcaccgggacctccgctgatctgacagtggaaaaagccgcggacattacctgggaggaagaggctgaacagacaggagttagccataacctcatgatcacggtggacgatgacggcaccatgagaattaaggatgacgagacagagaatatcctgaccgtccttctgaaaacagccctgctcatcgtgtctggcgtctttccgtactccattcctgccaccctgcttgtgtggcacacgtggcagaagcagacccaacggagcggggttctgtgggatgtgccctctcctcccgaaacacagaaagctgagctcgaagagggagtctaccgcatcaagcagcagggcattttcgggaaaacccaagtgggagttggcgtgcagaaggagggggtctttcatacaatgtggcacgtgaccagaggagccgtgctgacatataacggcaagcggctcgaaccgaattgggcgtccgttaaaaaggacctgatcagctacggcgggggatggcgcctttctgctcagtggcaaaaaggcgaggaagtccaggtgattgccgtggagcctgggaagaaccccaaaaatttccagacgatgcctggaaccttccagacaaccaccggcgaaatcggggccattgctctggattttaagcccggaacatccggcagccccatcatcaacagagagggcaaggtcgtggggctgtatggaaatggcgttgtgacgaaaaacgggggatacgtctccggcattgcccaaaccaatgctgagcctgacgggccgacacccgaactcgaggaagagatgttcaagaaacggaacctgaccatcatggatcttcaccctggcagcggaaagacacgcaaatatctgcccgccattgtgagagaagcgatcaagcggagactccgcaccctgattctcgcccctacgcgggttgtggctgccgagatggaggaagctctgaagggccttcccatcagataccagacaaccgccaccaaatctgagcatacagggcgcgaaatcgtcgacctgatgtgccacgccacctttacaatgcggctgctcagccctgtgagagttccgaattataacctgattatcatggatgaggctcatttcaccgaccccgcgtccattgccgctcgcggatacatctctacgcgggtgggcatgggggaagccgccgctatttttatgacagccacccctcccggaacagcggatgctttccctcagagcaatgcccccatccaggacgaggagagagacatcccggaacgctcctggaactctggcaatgagtggattaccgattttgccgggaagacggtctggttcgtgcctagcatcaaagctggcaacgacattgccaactgtcttcggaagaatggaaaaaaggtgatccaactgtccagaaagacctttgatacagaataccagaaaaccaagctcaacgactgggatttcgtcgttacaaccgacatttctgagatgggcgcgaattttaaagccgatcgggtgatcgacccccgcagatgcctgaagcccgtgattctgacagatgggcctgagcgggtcatcctcgctggacccatgcctgtgaccgccgctagcgccgctcagcgcagaggccgggttgggagaaacccgcagaaagaaaatgaccaatatatcttcacgggacagccccttaacaatgatgaggaccacgcccattggacagaagcgaagatgctgctggacaacattaatacccctgagggcatcattcccgccctcttcgaacctgagcgcgagaagtccgctgccatcgatggggaataccggctgaaaggcgagagcagaaagacctttgtggaacttatgcgccggggagacctgcccgtctggctcgctcacaaagtggcctctgagggcattaagtatacagatagaaaatggtgcttcgacgggcagcgcaacaatcagatcctggaagagaacatggatgttgagatctggaccaaggaaggagagaaaaagaagctgcggccgagatggctcgacgcccgcacatactccgatcctcttgctctgaaagaatttaaggacttcgcggccggcagaaaaagcattgctctggatctcgtgacggagatcgggcgggtcccctctcacctggcccatcgcaccagaaatgcccttgacaacctggtgatgctccacacatccgaacatggaggccgggcttatcgccacgccgtcgaggagctgcctgaaaccatggagacactgctccttctgggcctgatgattctcctgaccgggggagcgatgctttttctgatcagcggcaaggggattggaaaaacgtccatcggcctcatctgtgtgattgcctctagcgggatgctgtggatggctgaaatccccctgcaatggattgcctccgctatcgttctcgagttctttatgatggtgcttctgattcctgagcccgaaaagcagagaaccccgcaggataatcaactggcctacgtggtcatcggaattctcacactggcggccatcatcgctgccaacgagatgggccttctggaaaccacaaagcgggacctcggcatgagcaaagagcctggggttgtgtctcccacctcctatctggatgtggacctgcaccccgctagcgcctggacgctctacgctgtcgccacaaccgtgattacacctatgcttagacataccatcgaaaattctaccgcgaacgttagcctggccgctattgccaaccaggctgtggtcctgatgggactcgacaagggctggccgatctccaaaatggatctgggggtgccccttctggccctcggatgctactctcaggtcaatcctctgacactgacggccgcggtgctccttctgattacccactatgctatcatcggccccgggctgcaggccaaggctacacgcgaggcccaaaaacggaccgccgctggaattatgaagaaccctacagttgacggcatcatgaccattgatctcgaccccgtgatctacgatagcaagttcgagaaacagctgggccaggtcatgcttctggtgctctgtgccgttcagctgctgctcatgagaacgtcctgggcgctttgcgaagccctgacactggctaccgggcctattaccacactctgggagggatctccgggcaagttttggaataccacaatcgccgtgagcatggctaacatcttccgcgggtcctatctggccggagcgggccttgcctttagcattatgaaatctgtcgggacgggaaagcggggcaccggctcccaaggggaaacactgggagagaaatggaagaagaaactcaatcagctgagcagaaaggaattcgacctgtacaaaaagtccggcatcaccgaggtggatcggacagaggctaaagaagggctcaagcgcggagagattacccatcacgccgtgtctagaggcagcgctaaacttcagtggtttgttgaacggaacatggtcatccccgaggggcgcgtgattgacctgggatgtggcagaggcgggtggtcctattactgcgccggactgaagaaggtgacggaagtccggggctataccaaagggggacctggccatgaggagcccgttcctatgtctacatacgggtggaatatcgtgaagctcatgagcggaaaagatgtgttctacctgcccccggaaaagtgtgacacccttctgtgcgatattggcgagtccagcccttctcccacagtcgaagagtcccgcaccatcagagtgctcaaaatggttgagccctggctgaagaacaatcagttctgtatcaaggtgctgaacccttatatgcccacagtcattgaacacctcgagcggcttcaacgcaaacacggcgggatgctggtgagaaatcctctgagccggaactctacccatgaaatgtactggatctccaatggaacgggcaacattgttgctagcgtgaatatggtctctagactcctgcttaaccgctttacaatgacccaccggagaccgaccatcgagaaggacgtggatctgggggccggaacacgccatgtgaacgcggaacccgagacgcctaatatggacgtcattggcgagcggatcaaaagaatcaaggaagagcacaacagcacctggcactatgacgatgaaaatccctacaaaacatgggcctatcatgggtcctacgaggttaaggctaccggatctgccagctccatgattaacggcgtggtgaagctcctgacaaaaccttgggacgtcgtgcccatggttacccagatggctatgacagataccacgccgttcggccagcaacgcgtgtttaaggaaaaagtcgacacccggacacctagaagcatgcccgggacccgccgggtgatgggaatcacagccgagtggctgtggagaaccctcggccgcaataagaaacctcggctgtgcacgagagaggaattcacaaagaaggttcgcaccaacgccgcgatgggggctgtgtttacagaggaaaatcagtgggattccgccaaagccgctgtcgaggacgaagatttctggaagcttgtggacagagagcgggagctgcacaaactcggaaagtgtggctcttgcgtttataacatgatggggaaacgcgaaaagaaactgggcgagtttggaaaggccaagggcagcagagctatttggtacatgtggcttggggcccggtacctggaattcgaggcgctcggatttctgaatgaggatcattggttctccagagaaaactcttatagcggcgtggagggggaaggactgcacaaactcggctacatcctgcgggacatttccaagatccccgggggcgccatgtatgctgatgacaccgccggatgggacacgcgcatcaccgaggatgaccttcataatgaagagaaaattacacagcagatggatcctgagcacagacaactggctaacgccatctttaagctcacctaccagaataaagtcgtgaaggtccagcggcccacaccgaccggcacagtgatggacattatctctcgcaaggatcagagagggagcggacaagttggcacctatgggctgaacacgttcacaaatatggaagcgcagcttattcggcagatggagggagaaggcgtgctgtccaaagccgacctcgagaaccctcacctgcccgaaaagaaaatcacccagtggctggagaccaagggggtcgagcgcctcaaaagaatggctatcagcggcgatgactgcgtggtgaagcccattgatgaccggtttgccaacgctctgcttgccctgaatgatatgggaaaggttcgcaaagacatccctcaatggcagccgtctaagggctggcatgattggcagcaggtgcccttctgttcccaccatttccacgaactcattatgaaagacgggagaaagctggtcgtgccttgccggccccaagacgagcttatcggacgcgctagaattagccagggcgccgggtggtctctgcgggaaacagcgtgtctcggaaaagcctacgctcagatgtggtccctgatgtattttcaccgcagagatctgcggctcgccagcaacgccatctgctctgctgttcctgtgcattgggtccccacctccagaacaacgtggagcattcacgcccatcaccaatggatgaccacagaggacatgctgaccgtgtggaatcgcgtctggatcgaagataacccttggatggaggacaagacacccgtgaccacgtgggagaatgttccgtaccttggcaagcgggaagatcagtggtgtgggtccctgatcggcctcaccagcagagcgacatgggctcagaacattcctaccgccatccagcaagtgcgctctctgattggaaatgaggaattccttgactacatgcccagcatgaaacggtttagaaaggaggaggaatccgagggcgccatctggtga

SEQ ID NO: 20374 - RNA, 9873 nt, synthetic construct
  misc_feature 1..9873: note = derived and/or modified CDS sequence (opt5) from DENV-3__JN406515__SS-prME
  source 1..9873: mol_type = other RNA
accagcctctgcctcatgatgatgctgcccgccacccttgctttccacctgacgtcccgggacggagagcctcggatgatcgtggggaagaacgaacgcggaaagtctctcctgtttaagaccgccagcggcattaatatgtgtacacttatcgcgatggatctgggggagatgtgcgacgataccgtcacctacaagtgtccgctcattaccgaagttgagcccgaagacatcgattgctggtgtaacctgacatccacctgggtgacgtatggaacctgcaatcaggctggcgagcatcggcgggacaagcgctctgtggccctggcccctcacgtcgggatgggactcgatacacgggctcaaacctggatgagcgccgagggcgcttggagacaggtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagcccccgcaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacgagcaaggcaaagctcataacgggcgcctgattacagccaaccctgtggtcaccaagaaagaggaacccgtgaatatcgaagccgagcccccttttggagaatctaacattatcattggcatcggggataaggctcttaagatcaattggtacaaaaagggcagctccattggaaaaatgttcgaggccacagctagaggcgcccggagaatggcgatcctcggggacaccgcctgggattttggaagcgtgggcggggttctgaactctctgggaaagatggtccaccagattttcggctccgcttatacggccctctttagcggggtgtcttggatcatgaaaattggcatcggagtgctgcttacatggattggcctgaatagcaagaacacctccatgtctttcagctgcatcgtcatcgggattatcaccctctacctgggagctgtggttcaggccgacatgggctgtgtgattaattggaaggggaaagagctgaagtgcggatccggcatctttgtcacaaacgaagtgcatacctggacagagcagtataaattccaagcggatagcccgaagcgccttgccacggctattgccggggcttgggaaaatggcgtttgtggaatccggtctaccacaagaatggagaacctcctgtggaaacagatcgccaatgaactgaactacattctctgggagaataacatcaagctgaccgtggtcgtgggcgacattatcggggttcttgagcagggaaaacgcacactgacaccccagcctatggaactcaagtattcctggaagacgtggggcaaagccaagattgtgaccgctgagacacaaaatagctcttttatcatcgatgggcccaacacccctgaatgccccaacgcgtcccgggcctggaatgtctgggaggtggaagactacggattcggcgtgtttacaaccaacatttggctgaaactgagagagatgtatacacagctttgtgaccaccgcctcatgagcgctgccgtcaaggatgagcgggccgttcacgctgacatgggctactggatcgaatcccagaaaaatgggtcttggaagctggagaaggccagcctgattgaagtgaaaacctgcacgtggccgaagtcccatacactctggtctaacggagtgctggagagcgatatgatcattcctaaatcccttgcgggccccatcagccagcacaattacagacctgggtatcatacccaaaccgctggaccctggcacctgggcaagctcgagctggacttcaactactgcgaagggacaaccgtcgtgatcacggagaattgtggaacacgcggcccttctctgcggaccacaaccgtttccggcaaacttattcacgaatggtgctgtagaagctgcacactgcccccgctgcgctatatgggggaggatggatgttggtacggcatggaaatccggcctattaacgagaaggaggaaaatatggtgaagtctctggtctccgccgggagcggaaaagtggacaactttaccatgggcgttctctgcctggccatccttttcgaggaagtgatgagagggaagttcggcaagaagcatatgattgctggcgtcctgtttacgttcgtgctcctgctgtctggccagatcacctggcgggatatggcccgcacacttattatgatcgggagcaatgcgtccgacagaatgggaatgggcgttacctatctggctctcatcgccacatttaaaattcagcccttcctggccctcgggtttttcctgcggaaacttaccagcagagagaacctgctcctgggagtgggcctggctatggccacgacacttcaactgcccgaagatgtcgagcagatggctaatgggatcgccctcggactgatggcgctcaagctgattacccagtttgagacataccagctttggaccgccctggtgtctctcatgtgttccaacaccatcttcacactgacggtggcttggcgcaccgccacactgattcttgctggcatcagcctgtttcctgtctgccaatcctctagcatgcggaaaaccgactggctcccgatgacagttgccgccatgggcgtgccccctctgcccctcttcatcttttccctgaaggatacccttaaaagacgctcttggcctctgaatgaaggggtgatggctgtcggactggtgagcattctcgcgtcctctctgcttagaaacgacgttcccatggccggccctctggtggctgggggactcctgatcgcctgttatgtcattacgggcacaagcgccgatctcaccgtggagaaggctgccgacgttacctgggaagaggaagcggagcagacaggggtgtcccacaacctgatgatcaccgtcgacgatgacggaacaatgcggattaaagatgacgagacggaaaatatccttaccgtgctgctgaagacagctctcctgatcgtcagcggcattttcccctactctatcccggccacccttctggtgtggcatacatggcagaaacagacccaacgctccggcgttctctgggatgtgccttctccccctgagacgcagaaggccgaactggaggagggggtctacagaattaagcagcagggaatctttggcaaaacccaagtgggggttggagtgcagaaggaaggcgtcttccacacaatgtggcatgtgaccagaggggctgtgctcacatataacggaaaacgcctggagcccaattgggcctccgttaagaaagaccttatttcctacggcggcgggtggagactgagcgcgcagtggcaaaagggagaagaggtccaggtgatcgctgtggaaccgggcaagaaccctaaaaatttccagaccatgcccgggatttttcagacaacgaccggagagatcggcgccatcgccctggatttcaagcctgggacatctggatcccccattatcaaccgggagggcaaagtcgtgggcctctatgggaatggagttgtgaccaagaacggcgggtacgtcagcggaattgctcaaaccaatgccgaacccgacggccctacaccggagctggaagaggaaatgtttaaaaagcgcaaccttacgatgatggatctgcaccccgggtccggcaagaccagaaaatatctccctgctatcgtgcgggaggccattaagcgcagactgcggacactcatcctggcgcccaccagagttgtggccgctgagatggaagaggcccttaaaggactgcctatccgctaccagacaaccgctacaaagagcgaacacacgggcaaagagattgtcgacctgatgtgccatgccaccttcaccatgcggctcctgtctcccgtgagagttcctaattataaccttatcattatggatgaagcccactttacagacccggctagcatcgcggcccgcgggtacatttccacccgggtgggaatgggcgaggctgccgccatcttcatgacagctacaccccctgggacggccgatgcgtttccccagtctaatgctcctatccaggacgaggaaagagacattcccgagcgcagctggaactccggaaatgattggatcacagacttcgccggcaagaccgtctggtttgtgccgtctattaaggccgggaacgatatcgctaactgtctgcggaaaaatggcaagaaagtgattcaactcagcagaaagacattcgacaccgaataccagaaaacgaagctgaacgattgggactttgtcgttaccacagatatctccgagatgggagccaatttcaaggcggaccgcgtgattgatcctcggagatgcctgaaacccgtgatcctcaccgacggccccgagcgggtcatccttgccgggcctatgcccgtgacagttgcttctgccgctcagcgcagaggacgggtgggccgcaaccctcagaaggaaaatgatcaatatattttcaccgggcagccgctgaacaatgacgaggaccatgcccactggacagaagctaaaatgctgctcgataacatcaatacccccgagggaattatccctgccctgtttgaacccgagagagaaaagagcgcggccattgacggcgaataccggcttaaaggggagtccagaaagacgttcgtcgaactgatgcgccggggcgatctccctgtgtggctggctcataaagttgccagcgagggaatcaagtatacagacagaaagtggtgctttgatggcgaacgcaacaatcagatcctggaggagaacatggacgtggaaatttggaccaaagagggggaaaagaaaaagctccggcccagatggcttgatgctcgcacctactctgacccgctggccctgaaagagttcaaggattttgccgctggacggaagtccatcgcgctcgacctggtcacagaaattggcagagtgcctagccaccttgcccaccgcaccagaaatgctctggataacctcgtcatgctgcatacatctgagcacgggggacgggcctatcgccatgccgtggaggaactgcccgagacgatggaaaccctccttctgctgggcctcatgatcctgcttacaggcggggctatgctgttcctcatttccggaaaaggcgttgggaagaccagcatcggactgatctgtgtggtggcctcctctggcatgctgtggatggcggacattcctctccagtggatcgccagcgctattgtccttgagtttttcatgatggttctgctgatccccgagcctgaaaaacaaagaacaccccaggataatcagctcgcctacgtggtgattgggatcctgacccttgctgccattgtcgcggccaacgagatgggactgctcgaaacgaccaagcgggacctgggcatgtccaaagagccgggcgtggttagccctacatcttatctggacgtggatctccaccccgcttccgcctggaccctttacgctgtcgccacaaccgtgatcacgcccatgctgcgccacacaatcgaaaatagcaccgctaacgtctctctggccgcgattgccaaccaagctgtggttctcatggggctggacaagggatggcctatcagcaagatggatcttggcgtgccgctgctcgccctggggtgctactcccaggtcaatcccctgacactcaccgctgccgtgcttctgctggttacccattatgccattatcggacctggcctccaggcgaaagctacaagagaggcccagaagcggacggctgccgggattatgaaaaaccccaccgtggacggaatcatgacaatcgatctggaccctgtcatttacgattctaagtttgagaaacaacttggccaggtgatgctgctcgtgctgtgtgccgttcagctgctccttatgagaaccagctgggctttctgcgaagccctgacactggcgaccggccccatcacgacactctgggaggggtcccctggaaagttttggaataccaccattgccgtctctatggctaacatcttccgcggcagctatctggccggggctggacttgccttttccattatgaaaagcgtgggcacagggaaacggggaaccggctctcagggcgaaacactgggggagaagtggaaaaagaaactcaatcaactgtccagaaaggagttcgacctgtacaaaaagagcggaatcacggaggtggatcgcaccgaggcgaaggaaggcctcaaaagaggggaaatcacacaccatgccgtctccagaggatctgctaaacttcagtggttcgttgaacggaacatggtgattccggagggccgcgtgatcgacctggggtgtggaagaggcggctggagctattactgcgccgggctgaaaaaggtcaccgaagtgcggggatatacaaaaggcgggcccggacacgaggagcctgttcccatgtccacctacggctggaatattgtgaagctcatgtctgggaaggatgtcttttacctgcctcccgaaaaatgtgacacgcttctgtgcgatatcggagagagctccccgagccctaccgtggaagagtctcgcacaattagagttctcaagatggtggagccctggctgaaaaacaatcagttctgtatcaaggtcctgaacccctatatgcctaccgtgattgaacatctcgagcggcttcagcgcaaacacggcggcatgctggtgagaaatcccctgtcccggaacagcacacacgaaatgtactggatctctaatgggaccggaaacatcgtctccagcgttaatatggtgtctcgcctcctgcttaacagatttacaatgacctatcggagacctacgattgagaaggacgtggacctgggcgctgggacacgccatgtcaacgccgaaccggagacccccaatatggatgtgatcggagagcggattagacgcatcaaggaggagcacagctccacctggcattacgacgatgaaaacccttataaaacatgggcttaccacggctcttatgaggttaaggccacggggagcgcgtccagcatgattaatggagtggtcaaactcctgaccaagccctgggacgtggttcctacagtgacccaaatggccatgacagataccacacccttcggccagcagcgggtctttaaagaaaaggtggacaccagaacgccgaagcctatgcccggcacccgcaaagttatggagatcacagctgagtggctgtggcggaccctcgggagaaacaagcgccctcggctgtgcacaagagaagagttcaccaaaaaggtgcgcacgaatgccgctatgggagccgtctttacagaagagaaccaatgggattccgcccgggcggctgtggaagacgaggagttctggaaacttgtcgatagagaacgcgagctgcacaagctcggcaaatgtgggtcttgcgtgtacaatatgatgggaaagagagaaaagaaactgggcgagtttgggaaggccaaaggcagccgggccatctggtacatgtggcttggagctcgctatctggagttcgaagccctcggctttctgaacgaggaccattggttctccagagaaaattcttacagcggggttgagggagaaggcctgcacaagctcgggtatattctgcgggatatctccaaaattcccggaggcgctatgtacgccgacgacaccgcggggtgggatacaagaatcaccgaggacgatcttcataacgaggaaaagattacgcagcagatggaccctgagcaccggcagctggccaatgctatctttaagctcacctatcaaaacaaagtggtcaaggtgcagcgccccacaccgaaaggcaccgtgatggatatcatttctagaaaggaccagcggggaagcggccaggttgggacatacggactgaataccttcacaaacatggaagcccaacttatccgccagatggagggcgaaggggtgctgtccaaaaccgatctcgagaatcctcatctgctggagaagaagattacgcagtggctcgaaacaaaaggagtcgagagactgaagcggatggctatcagcggcgacgattgcgtggttaaacccattgacgatcgcttcgccaacgcgcttctggccctcaacgacatggggaaggtgagaaaagatatcccccagtggcaaccttctaagggctggcacgactggcagcaggtcccgttttgttcccaccatttccacgaactgatcatgaaggacggacggaaacttgtggtcccctgccgccctcaggatgagctgattggcagagctcggatcagccaaggggccggatggtctctcaaggaaaccgcttgtctgggcaaagcctatgctcagatgtgggccctgatgtactttcatcgcagagacctccggctggcgtccaatgccatttgcagcgctgtgcccgttcactgggtgcctacctctcgcacaacctggtccatccacgcccatcaccagtggatgacaacggaggatatgcttaccgtctggaacagagtgtggattgaggacaatccctggatggaagataaggcccctgttacaacctgggaggacgtgccctacctggggaaacgggaagatcaatggtgtggaagcctcatcggcctgacatccagagctacctgggcccagaacattcttacggcgatccagcaggtccgcagcctgatcgggaatgaggagttcctcgactatatgccgtctatgaagcggtttagaaaggaagaggaaagcgagggcgctatttggtga

SEQ ID NO: 20375 - RNA, 9873 nt, synthetic construct
  misc_feature 1..9873: note = derived and/or modified CDS sequence (opt5) from DENV-3__JN406514__SS-prME
  source 1..9873: mol_type = other RNA
acctccctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacccttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttctggaccttcccctgccgtggaccagcggcgccacaaccgagcggcctacatggaatcgcaaagaactcctggtgaccttcaagaacgcccatgctaaaaagcaagaggttgtggtcctggggtctcaggaaggagcgatgcacacggccctcacaggcgctaccgagattcaaaattccgggggcacaagcatctttgccggacacctgaagtgtagacttaaaatggataagctggaactcaaaggcatgtcttacgccatgtgcctgaacaccttcgtgctgaagaaagaggtttccgagacccagcatgggacaattcttatcaaggtggaatacaagggagaggacgctccctgtaaaatcccttttagcacggaagatggccaagggaaggcccacaacggacggctcattaccgcgaatcccgtcgtgaccaagaaggaggagcccgtgaacatcgaagctgagcctccgttcggcgaatccaatattgttatcgggattggcgacaaagccctgaagatcaactggtataagaaaggatctagcatcggcaagatgttcgaggccaccgctagaggggcccgccggatggctattctgggagatacagcctgggactttggctccgtcgggggagtgctcaatagcctgggcaaaatggtgcatcagatcttcgggtctgcgtacaccgccctcttttccggcgtcagctggattatgaagatcggaattggcgtgctgctcacgtggatcgggctgaactctaaaaatacaagcatgtccttctcttgcattgttatcggaatcattaccctgtatcttggcgctgtggtccaggccgatatggggtgtgtgatcaactggaagggaaaggaactcaaatgcggcagcgggatttttgttaccaatgaggtgcacacatggaccgagcagtacaagttccaagctgactcccccaaaagactggccacagcgatcgccggcgcttgggaaaacggagtctgtggcattcgcagcacgacccggatggagaatctgctctggaagcagatcgccaacgaactgaattatatcctttgggagaacaatattaaactgacagtggttgtgggggataccatcggagtcctcgaacagggcaagagaacactgacccctcagcccatggagctgaaatactcttggaagacgtgggggaaggctaaaattgtgaccgccgagacacaaaactccagctttatcattgacggacctaacacccccgaatgcccgtctgcctcccgcgcttggaatgtgtgggaggtcgaagactatggcttcggcgtttttagcacaaacatctggcttaagctccgggaggtgtacacccagtcctgtgatcatagactgatgtctgcggccatcaaagacgaacgcgctgtgcacgccgatatggggtactggattgagagccagaagaatggatcctggaaactggagaaggcctctttcatcgaagtcaagacatgcatttggcctaaaagccacaccctctggtccaacggcgtgctggagagcgacatgatcattcccaagtctcttgctgggcctatctcccagcataatcaccggcccggatatcatacgcaaacagccggcccttggcacctggggaaactcgaactggattttaactactgcgagggaaccaccgttgtgatcacagagaattgtggcaccagaggccccagcctgcgcacgacaaccgtctctgggaaacttattcacgaatggtgctgtcggtcctgcacactcccgcctctgagatatatgggagaggacggctgttggtacgggatggaaatccggcccattaacgagaaagaagagaatatggttaagagcctggtgtctgcgggaagcggcaaggtggataacttcaccatgggggtcctctgcctggctatcctttttgaggaagtgatgcgcggaaaattcggcaagaaacatatgattgccggcgttctgttcacatttgtgctcctgctgtccgggcagatcacctggagagacatggcccacacgcttattatgatcggaagcaatgcttctgatcggatgggcatgggggtcacctatctggccctcatcgcgacattcaagattcagccctttctggctctcggattctttctgagaaaacttacctcccgcgagaacctgctcctgggcgtggggctggccatggccacaacccttcaactgcctgaagacatcgagcagatggctaatggaattgccctcggcctgatgacgctcaagctgatcacacagttcgaaacctaccagctttggacagctctggtgagcctcacctgttccaacaccatttttacactgacggtcgcctggcggaccgcgacactgatccttgccggcgtttctctgctcccgctgtgccaaagctcctctatgagaaagaccgattggctccccatgacagtggctgccatgggggtgcctcccctgcctcttttcatctttagcctgaaagacacccccaagcgcagatcctggcctctgaatgagggagtcatggctgtgggcctcgtttctattctggccagctcccttctgcggaacgatgtgcccatggccgggccgctcgtcgctggaggcctgctcatcgcgtgttatgtgattacggggacaagcgccgacctgaccgttgagaaagctgccgacgtgacctgggaagaggaagccgagcagacaggagtctctcataaccttatgatcaccgtggatgacgatggcacaatgcgcattaaggacgatgaaacggagaatatcctgaccgtcctgctcaaaacagctctgcttatcgtgtccggcattttcccttacagcatccccgccaccctgctcgtttggcacacatggcagaagcagacccaaagatctggggtgctgtgggacgtcccttctcccccggagacgcagaaagcggaactcgaggaaggagtgtaccggattaagcagcagggcatctttgggaagacccaagttggagtgggcgtccagaaagagggggtgttccatacaatgtggcacgtgacccgcggagctgttctgacacacaacggcaagagacttgagcctaattgggccagcgtcaaaaaggatctgattagctatggcgggggatggcggctgtccgcccagtggcaaaaaggcgaagaggtccaggtgatcgctgtcgaacccgggaagaaccctaagaattttcagaccatgcccggaattttccagacaacgaccggcgagatcggggccatcgcgctcgacttcaaacccggaacaagcggctcccctattatcaaccgcgaaggcaaggtggttgggctgtacggaaatggcgtggtcaccaaaaacgggggatatgtgagcggcattgctcaaaccaatgccgagccggatgggcccacacctgagcttgaagaggaaatgtttaagaaaagaaacctgacgatcatggacctccatcccggctctggaaagacccggaagtacctgcctgccattgttcgcgaggctatcaaaagacggctcagaacactgatccttgcccccacccgcgtggtcgctgccgaaatggaggaggcgctgaagggcctgcctattcggtatcagacaaccgccacgaaaagcgaacacacagggagagagatcgtggatctcatgtgccatgctaccttcaccatgcgcctgctttccccggttcgggtgcccaattacaacctgattatcatggacgaagcccactttacagatcctgcttctattgccgccagaggatatatcagcacccgcgtcggcatgggggaggctgcggccatcttcatgacagctacaccccctggaacggccgaagcctttccccagtccaatgctccgattcaggacgaggagcgggacatccctgaaagatcttggaacagcggcaatgagtggattacagatttcgtggggaagaccgtgtggtttgtcccctccatcaaagccggcaacgacattgcgaactgtctccgcaagaatggaaagaaagttatccaactgtctcggaagacattcgataccgaataccagaaaacgagactgaacgactgggattttgtggtgaccacagacattagcgagatgggcgctaatttcaaggccgatcgggtcatcgacccccgcagatgcctcaaacctgtgatccttaccgatgggcccgagcgggttattctggccggacctatgccggtgacagctgcctccgcggcccagcgcagaggccgggtcgggagaaacccccagaaggaaaatgaccaatacatctttaccggacagcctctgaacaatgatgaggaccatgctcactggacagaagccaagatgctcctggacaacattaatacccccgagggcatcattcctgctcttttcgaacccgagcgcgagaaaagcgccgctatcgatggggaatatcggctgaagggcgagtctagaaaaacgttcgtggaactcatgcgccggggagacctgccggtttggctggcccacaaggtggcgtccgagggcatcaaatacacagatagaaagtggtgctttgacggggaacgcaacaatcagattctcgaggagaacatggatgtcgaaatctggaccaaagagggagaacggaagaaacttagacctcgctggctggacgccagaacctatagcgatcccctggctctcaaagagttcaaggactttgccgctggccggaaatctattgccctggatcttgtgacagaaatcgggcgcgtcccttcccatctggcccacagaacccggaatgctctcgacaacctggtgatgctgcatacaagcgagcacggaggccgcgcgtacagacacgccgttgaggaactccccgagacgatggaaacccttctgctgctcggcctgatgattcttctgacagggggagctatgcttttcctgatctccggcaaggggatcggaaaaacctctattggcctgatctgtgtgattgtgagctccgggatgctctggatggccgatgtccctcttcagtggatcgccagcgctattgttctggagtttttcatgatggtgctgctcatccccgagccggaaaagcaacggacacctcaggacaatcagctggcctatgtggtcattggaatccttaccctggcggccatcgtggctgccaacgagatgggcctcctggaaacgaccaagagagatctgggcatgtctaaagagcccggggttgtgtcccccacaagctacctcgacgtcgaccttcatcctgcttctgcctggaccctgtatgcggtggccacaaccgtcattacgccgatgctgcgccacacaatcgaaaatagcaccgctaacgtgtccctcgccgctattgccaaccaagctgttgtgctgatgggacttgataagggctggcccatctctaaaatggacctgggggtccctctcctggccctgggatgctacagccaggtgaatcccctcacacttaccgcggccgttctgctgctcgtgacccattacgctattatcggccctgggctgcaggccaaggctacacgggaggcccagaaaagaacggccgcgggaatcatgaagaaccccaccgtcgatggcattatgacaatcgaccttgatcctgtgatttatgactccaagtttgagaaacaactgggccaggtgatgctcctggttctgtgtgctgtccagctccttctgatgcgcacctcttgggccctgtgcgaagctctcacactggccaccgggccgatcacgacactttgggagggaagccccggcaagttctggaataccaccattgccgtgtccatggctaacatctttcgggggagctacctggccggagcgggcctcgccttctctatcatgaaatccgtggggacaggaagacggggcaccggcagccagggggaaacactgggagagaagtggaaaaagaagctgaatcaactctcccgcaaagaatttgatctttataagaaatctggcattacggaggtcgacagaaccgaggctaaggaagggctgaaacggggagagacaacccaccatgccgttagccgcggctccgctaagctgcagtggttcgtggaaagaaacatggtgatccctgaggggcgggtcattgatctcggatgtggccgcggcgggtggtcttactattgcgccggactgaaaaaggtgacagaagttagaggctacaccaaaggcgggcccgggcacgaggagcctgtgcccatgagcacgtatgggtggaatatcgtcaaacttatgtccggaaaggacgtgttttacctgccgcctgaaaaatgtgataccctcctgtgcgacattggcgagagctctccctcccccacagttgaagagagccggaccatccgcgtgctgaagatggtcgagccttggctcaaaaacaatcagttctgtattaaggtgcttaacccctacatgcctacagtgatcgaacacctggagagactgcagcggaagtatggcgggatgctcgtcagaaatccgctgtctcgcaactccacccatgaaatgtactggatcagcaatggaacaggcaacattgtttctagcgtgaatatggtgtcccggcttctgctcaacagattcaccatgacgcaccgccggcccacaatcgagaaagatgtcgacctgggggcgggaaccagacatgtgaacgccgaacctgagacccccaatatggacgttattggcgagcgcatcaagcggattaaagaggaacactctagcacatggcactatgatgacgaaaacccttacaagacgtgggcttatcatgggtcctacgaggtgaaagccaccggaagcgcttcctctatgatcaatggcgtcgtgaagctgctcacaaagccctgggatgttgtgccgatggtcacccaaatggccatgacagacaccacaccttttggccagcagagagtgttcaaagaaaaggttgatacccgcacgccccggcctatgcccgggaccagaaaagtgatggagatcacagctgagtggctgtggcgcacccttggacggaacaagaaacctagactgtgcacacgcgaagagtttaccaagaaggtcagaacgaatgccgcgatgggcgccgtgttcacagaagagaaccaatgggacagcgctcgggccgctgtcgaagatgaggagttttggaaactcgtggaccgcgaaagagagctgcacaaacttgggaaatgtggatcctgcgtttataatatgatgggcaagcgggagaagaagctgggggagttcggcaaagccaagggatctagagccatttggtacatgtggctcggcgcgcggtacctggagtttgaagctctggggttcctcaacgaggatcattggtttagccgcgaaaattcctattctggagtggagggcgaagggctgcacaaacttggatacatcctgagagacattagcaaaatccccggcggggccatgtatgccgatgacaccgctggctgggacacacggattaccgaggatgacctccataacgaggaaaagatcacgcagcagatggatccggagcacaaacagctggccaatgctatcttcaaacttacctaccaaaacaaagtcgtgaaggtgcagcgccctacacccaagggaaccgttatggacattatctccagaaaagatcagcggggcagcggacaggtgggaacatatggcctgaatacctttacaaacatggaagcccaactcgtccgccagatggagggggaaggagtgctgtctaaggcggacctggagaatccccacctcctggagaaaaagattacccagtggcttgaaacgaaaggcgttgagagactgaagcggatggccatctccggggatgactgcgtggtcaagcctattgatgaccgcttcgctaacgccctcctggctcttaacgatatgggcaaagtgagaaaggacatcccgcagtggcaacccagcaaaggatggcatgattggcagcaggtccctttttgttctcaccatttccacgaactgatcatgaaggacggccggaaactcgtggttccctgccgccctcaggacgagctgattgggagagcccggatctcccaaggagcgggctggagcctgaaggaaacagcctgtctcgggaaggcttacgcccagatgtggtctctgatgtatttccaccgcagagatcttcggctggcttccaatgccatttgcagcgctgtgcccgtccattgggtgcctacctccagaaccacatggagcatccacgcccatcaccagtggatgaccacagaggacatgctcacggtttggaaccgcgtgtggattgaggataatccctggatggaagacaaaaccccggtcacaacctgggaggatgtgccttacctgggaaagcgggaagaccaatggtgtggctctcttatcgggctgacaagcagagcgacctgggcccagaacattctcacggctatccaacaggtgcgctccctgatcggcgatgaggagtttctggactacatgccctctatgaaacggttcagaaaggaagaggaaagcgagggagccatttggtga

SEQ ID NO: 20376 - RNA, 9873 nt, synthetic construct
  misc_feature 1..9873: note = derived and/or modified CDS sequence (opt5) from DENV-3__KT726340__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtgatcaccaaaaacgggggatatgtctccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgatcctcgcccctacaagagttgtggcggccgagatggaagaggctctgaagggccttcccattcgctatcagaccaccgccacaaaatctgaacataccgggcgggagatcgtcgacctgatgtgccacgctacatttaccatgagactgctcagccctgtgcgcgttccgaattacaacctgattatcatggatgaagcccatttcacggaccccgcctccattgctgcgcggggatacatctctacaagagtgggcatgggggaggccgctgccatctttatgaccgccacacctcccggaaccgctgatgccttccctcagagcaatgcgcccattcaggacgaggaacgcgacatcccggagcggtcctggaactctggcaatgaatggattacggattttgctgggaagaccgtctggttcgtgcctagcatcaaagccggcaacgacattgccaactgtcttagaaagaatggcaaaaaggtgatccaactgtcccgcaagacatttgataccgagtatcagaaaacaaagctcaacgactgggatttcgtcgttaccacagacatttctgagatgggagctaattttaaagccgatcgggtgatcgaccccagacggtgcctgaagcccgtgatcctgaccgatgggcctgaacgcgtcattctcgcgggacccatgcctgtgacggccgctagcgccgctcagagacggggccgcgttgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtctggctcgctcacaaagtggcctctgaaggcatcaagtacaccgatcgcaaatggtgcttcgacgggcagcggaacaatcagattctggaggagaacatggatgttgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtcccctctcacctggcccatagaacacggaatgctcttgacaacctggtgatgctccacacctccgagcatggaggcaaggcctaccgccacgccgtcgaggaactgcctgagacaatggaaaccctgctccttctgggcctgatgattctcctgacagggggagctatgctttttctgatcagcggcaaagggatcggaaagacctccattggcctcatctgtgtgattgcctctagcgggatgctgtggatggcggagatccccctgcaatggattgcctccgctatcgttctcgagttctttatgatggtgcttctgattcctgaacccgagaagcagagaacaccgcaggataatcaactggcctatgtggtcatcggaatcctcaccctggctgccattatcgcggccaacgaaatgggccttctggagacaaccaaacgggacctcggcatgagcaaggaacctggggttgtgtctcccacgtcctacctggatgtggacctgcaccccgctagcgcctggacactctacgctgtcgccaccacagtgattacccctatgcttcgccataccatcgaaaattctacagctaacgttagcctggccgcgattgccaaccaggctgtggtcctgatgggactcgacaaaggctggccgatctccaagatggatctgggggtgccccttctggccctcggatgctattctcaggtcaatcctctgacgctgaccgctgccgtgctccttctgatcacacactacgccattatcggccccgggctgcaggcgaaagctaccagagaggcccaaaagcggacagctgccggaattatgaagaaccctaccgttgacggcatcatgacgattgatctcgaccccgtgatctatgatagcaaattcgagaagcagctgggccaggtcatgcttctggtgctctgtgccgttcagctgctgctcatgagaacatcctgggctctttgcgaggccctgaccctggcgaccgggcctatcacaaccctctgggaaggatctccgggcaaattttggaatacaacgattgccgtgagcatggctaacatcttccgcgggtcctacctggccggagctggccttgcctttagcattatgaagtctgtcgggaccggaaaacggggcacaggctcccaaggggagaccctgggagaaaagtggaagaaaaagctcaatcagctgagcagaaaagagttcgacctgtataagaaatccggcatcacagaggtggatcgcaccgaagcgaaggaggggctcaaacggggagaaattacgcatcacgccgtgtctagaggcagcgctaaacttcagtggtttgttgagcggaacatggtcatccccgaagggcgcgtgattgacctgggatgtggcagaggcgggtggtcctactattgcgccggactgaagaaagtgaccgaggtccggggctacacaaaagggggacctggccatgaggaacccgttcctatgtctacctacgggtggaatatcgtgaaactcatgagcggaaaggatgtgttctatctgcccccggagaaatgtgacacacttctgtgcgatatcggcgaatccagcccttctcccaccgtcgaggagtcccgcacaattagagtgctcaagatggttgaaccctggctgaagaacaatcagttctgtatcaaagtgctgaacccttacatgcccaccgtcgtggagcacctcgaacggcttcaacgcaagcacggcgggatgctggttagaaatcctctgagccggaactctacgcatgagatgtattggatttccaatggaacaggcaacatcgtggctagcgtcaatatggtgtctcgcctcctgcttaacagatttaccatgacccaccggagaccgacaattgaaaaagacgtggatctgggggccggaacgcgccatgtcaacgctgagcccgagacccctaatatggacgttatcggcgaacggatcaagagaattaaagaggaacacaacagcacatggcactacgacgatgagaatccctataagacctgggcctaccatgggtcctatgaagtgaaggcgacaggatctgccagctccatgatcaacggcgtggtcaaactcctgaccaagccttgggacgtggttcccatggtgacacagatggctatgaccgatacgaccccgttcggccagcaacgcgtctttaaagagaaggtggacacacggacccctagaagcatgcccgggacacgccgggttatgggaattaccgccgagtggctgtggagaacgctcggccgcaataaaaagcctcggctgtgcacaagagaagagttcaccaagaaagtgcgcacaaacgctgccatgggggccgtctttaccgaagagaatcagtgggattccgcgaaggctgccgtggaagacgaggatttctggaaacttgttgaccgggagagagaactgcacaagctcggaaaatgtggctcttgcgtgtacaacatgatggggaagcgcgagaaaaagctgggcgaatttggaaaggccaaaggcagcagagctatctggtacatgtggcttggggcccggtatctggagttcgaggctctcggatttctgaatgaagatcattggttctcccgcgagaactcttacagcggcgtcgaaggggagggactgcacaagctcggctatattctgagagacatctccaaaatccccgggggcgccatgtacgcggatgacacggccggatgggacacccggattacagaagatgaccttcataatgaggagaagatcacccagcagatggatcctgaacacagacaactggctaacgccatttttaaactcacatatcagaataaggtggtcaaggtgcagcggcccaccccgacaggcaccgttatggacatcatttctcgcaaagatcagagagggagcggacaagtgggcacgtacgggctgaacacattcaccaatatggaggctcagcttatccggcagatggaaggagagggcgtcctgtccaaggccgacctcgaaaaccctcgcctgcccgagaaaaagatcacccagtggctggagacaaaaggggtggaaagactcaagcggatggcgattagcggcgatgactgcgtggttaagcccatcgatgaccgctttgccaacgctctgcttgccctgaatgatatgggaaaagtgagaaaggacattcctcaatggcagccgtctaaaggctggcacgattggcagcaggtccccttctgttcccatcacttccatgagctcatcatgaaggacgggcggaaactggtggttccttgccgcccccaagacgaacttattggacgggctcggatcagccagggcgccgggtggtctctgcgcgagaccgcttgtctcggaaaggcctatgcgcagatgtggtccctgatgtactttcacagacgggatctgcgcctcgccagcaacgctatttgctctgccgtgcctgtccactgggtgcccacatccagaacgacctggagcatccatgcccaccatcaatggatgacaaccgaagacatgctgacagtctggaatcgggtgtggatcgaggataacccttggatggaggacaagacccccattacgacctgggaaaatgttccgtaccttggcaaaagagaggatcagtggtgtgggtccctgatcggcctcacaagccgcgctacctgggcccagaacattcctacagcgatccagcaagtgcggtctctgattggaaatgaagagttccttgactatatgcccagcatgaagagatttcgcaaagaggaagagtccgaaggcgctatctggtga

SEQ ID NO: 20377 - RNA, 9873 nt, synthetic construct
  misc_feature 1..9873: note = derived and/or modified CDS sequence (opt5) from DENV-3__KT726345__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcatttgggaggaagaggcggaacagaccggagtgagccacaacctcatgatcacagtcgacgatgacggcacgatgcggatcaaagatgacgagaccgagaatattctgacagtgcttctgaagaccgctctgctcatcgtctctggcatttttccgtactccatccctgccacactgcttgtgtggcatacctggcagaaacagacgcaacgcagcggggttctgtgggatgtgccctctcctcccgaaacccagaaggccgagctcgaagagggagtctacagaattaaacagcagggcatcttcgggaagacacaagtgggagttggcgtgcagaaggagggggtctttcacaccatgtggcacgtgacacggggagctgtgctgacccataacggcaaacgcctcgaaccgaattgggcctccgttaagaaagacctgattagctatggcgggggatggagactttctgcgcagtggcaaaagggcgaggaagtccaggtgatcgctgtggagcctgggaaaaaccccaagaatttccagacaatgcctggaacgttccagaccacaaccggcgaaatcggggccattgccctggattttaagcccggaacctccggcagccccatcattaaccgggagggcaaagtcgtggggctgtacggaaatggcgttgtgacaaagaacgggggatatgtctccggcatcgctcaaacgaatgccgagcctgacgggccgacccccgaactcgaggaagagatgttcaaaaagcgcaacctgacaattatggatcttcaccctggcagcggaaaaaccagaaagtacctgcccgctatcgtgcgggaagccatcaagcgcagactccggacactgattctcgcgcctaccagagttgtggccgctgagatggaggaagccctgaaaggccttcccatccgctatcagacgacagctaccaagtctgagcataccgggcgggaaattgtcgacctgatgtgccacgccacatttaccatgagactgctcagccctgtgcgcgttccgaattacaacctgatcattatggatgaggcccatttcacagaccccgcttccatcgcggcccggggatatatctctaccagagtgggcatgggggaagctgccgccatttttatgacggctacacctcccggaaccgccgatgcgttccctcagagcaatgctcccatccaggacgaggagcgcgacattccggaacggtcctggaactctggcaatgagtggatcacagattttgccgggaaaaccgtctggttcgtgcctagcattaaggccggcaacgacatcgctaactgtcttcgcaaaaatggaaagaaggtgattcaactgtccagaaaaacgtttgataccgaataccagaagacaaaactcaacgactgggatttcgtcgttaccacagacatctctgagatgggcgccaattttaaggcggatcgggtgatcgaccccagacggtgcctgaaacccgtgattctgaccgatgggcctgagcgcgtcatcctcgccggacccatgcctgtgacagctgccagcgctgcccagagacggggccgcgttgggagaaacccgcagaaggaaaatgaccaatacattttcaccggacagccccttaacaatgatgaggaccacgctcactggacggaagccaagatgctgctggacaacatcaatacacctgagggcattatccccgccctcttcgaacctgagcgggagaaatccgccgctatcgatggggaatatagactgaagggcgagagccgcaaaacctttgtggaacttatgcggagaggagacctgcccgtctggctcgcccataaggtggcttctgagggcattaaatacaccgatcgcaagtggtgcttcgacgggcagcggaacaatcagatcctggaagagaacatggatgttgagatttggacaaaagaaggagagaagaagaaactgagaccgcgctggctcgacgcccggacctattccgatcctcttgccctgaaggaatttaaagacttcgctgcgggcagaaagagcatcgccctggatctcgtgacagagattgggcgcgtcccctctcacctggctcatagaacgcggaatgcccttgacaacctggtgatgctccacacctccgaacacggaggccgcgcctacagacatgctgtcgaggagctgcctgaaacaatggagaccctgctccttctgggcctgatgatcctcctgacagggggagccatgctttttctgatcagcggcaaagggattggaaagacctccatcggcctcatttgtgtgatcgcgtctagcgggatgctgtggatggccgaaattcccctgcaatggatcgcttccgccattgttctcgagttctttatgatggtgcttctgatccctgagcccgaaaagcagcggacgccgcaggataatcaactggcttatgtggtcatcggcattctcaccctggccgcgatcattgccgctaacgagatgggccttctggaaacaaccaaacgcgacctcggcatgagcaaggagcctggggttgtgtctcccacatcctacctggatgtggacctgcaccccgccagcgcttggaccctctatgccgtcgctacgacagtgatcacccctatgcttagacatacaattgaaaattctaccgccaacgttagcctggcggccatcgctaaccaggccgtggtcctgatgggactcgacaaaggctggccgatctccaagatggatctgggggtgccccttctggctctcggatgctactctcaggtcaatcctctgaccctgacagccgccgtgctccttctgattacgcactacgcgatcattggccccgggctgcaggctaaagccacccgggaggctcaaaagagaacagccgccggaatcatgaagaaccctaccgttgacggcattatgacaatcgatctcgaccccgtgatctatgatagcaaattcgagaagcagctgggccaggtcatgcttctggtgctctgtgctgttcagctgctgctcatgcgcacctcctgggccctttgcgaagcgctgacgctggccacagggcctattaccaccctctgggagggatctccgggcaaattttggaatacaaccatcgctgtgagcatggccaacattttccgggggtcctacctggctggagccggccttgcgtttagcatcatgaagtctgtcgggacaggaaaaagaggcacgggctcccaaggggaaaccctgggagagaagtggaagaaaaagctcaatcagctgagccgcaaagagttcgacctgtataagaaatccggcattacagaggtggatcggaccgaggccaaggaagggctcaaaagaggagagatcacacatcacgctgtgtctcggggcagcgccaaacttcagtggtttgttgaacgcaacatggtcattcccgaggggagagtgatcgacctgggatgtggccggggcgggtggtcctactattgcgctggactgaagaaagtgaccgaagtccgcggctacacgaaagggggacctggccacgaggagcccgttcctatgtctacctatgggtggaatatcgtgaaactcatgagcggaaaggatgtgttctacctgcccccggaaaaatgtgacacacttctgtgcgatattggcgagtccagcccttctcccaccgtcgaagagtccagaacaatccgggtgctcaagatggttgagccctggctgaagaacaatcagttctgtattaaagtgctgaacccttacatgcccaccgtcatcgaacatctcgagcgccttcaaagaaagcacggcgggatgctggtgcggaatcctctgagccgcaactctacacatgaaatgtattggatttccaatggaaccggcaacatcgttgccagcgtgaatatggtctctagactcctgcttaaccggtttacgatgacacacagacgcccgaccatcgagaaagacgtggatctgggggctggaacccggcacgtgaacgccgaacccgagacacctaatatggacgtcattggcgagagaatcaagcgcattaaagaagaacacaacagcacgtggcactacgacgatgaaaatccctataagacctgggcgtaccatgggtcctatgaggttaaggccacaggatctgctagctccatgatcaacggcgtggtgaaactcctgaccaagccttgggacgtcgtgcccatggttacacagatggccatgaccgatacaaccccgttcggccagcaacgggtgtttaaagaaaaggtcgacacgagaacccctcgcagcatgcccgggacacggagagtgatgggaattaccgctgagtggctgtggcgcacactcggccggaataaaaagcctagactgtgcacccgcgaggagttcacgaagaaagttcggacaaacgccgccatgggggcggtgtttaccgaggaaaatcagtgggattccgctaaggccgccgtcgaggacgaagatttctggaaacttgtggacagagagcgcgagctgcacaagctcggaaaatgtggctcttgcgtttacaacatgatggggaagagagagaagaagctgggcgagtttggaaaggctaaaggcagccgggccatctggtatatgtggcttggggctcgctacctggagttcgaggccctcggatttctgaatgaggatcattggttctccagagaaaactcttacagcggcgtggagggggaaggactgcacaagctcggctatatcctgcgggacatttccaaaatccccgggggcgcgatgtacgccgatgacacagctggatgggacaccagaattacggaggatgaccttcacaatgaagagaagatcacccagcagatggatcctgagcatcggcaactggccaacgctatttttaaactcacatatcagaataaggtcgtgaaggtccagcgccccaccccgacaggcaccgtgatggacatcatctctagaaaagatcagcgggggagcggacaagttggcacatacgggctgaacaccttcacgaatatggaagcccagcttattcgccagatggagggagaaggcgtgctgtccaaggcggacctcgagaaccctcatctgcccgagaagaagatcacacagtggctggagaccaaaggggtcgagagactcaagcggatggccattagcggcgatgactgcgtggtgaagcccatcgatgaccgctttgctaacgccctgcttgctctgaatgatatgggaaaagttagaaaggacattcctcaatggcagccgtctaaaggctggcatgattggcaacaggtgcccttctgttcccaccacttccatgaactcatcatgaaggacgggcggaaactggtcgtgccttgccgcccccaagacgagcttattggacgggcccggatcagccagggcgctgggtggtctctgcgcgaaaccgcctgtctcggaaaggcgtatgcccagatgtggtccctgatgtactttcacagacgggatctgcgcctcgctagcaacgccatctgctctgccgttcctgtgcattgggtccccacatccagaaccacatggagcattcacgctcatcaccaatggatgacgaccgaggacatgctgacagtgtggaatcgggtctggatcgaagataacccttggatggaggacaagacccccgtgacaacctgggagaatgttccgtatcttggcaaaagagaagatcagtggtgtgggtccctgattggcctcacgagccgcgccacctgggcgcagaacatccctacagctattcagcaagtgcggtctctgatcggaaatgaggagttccttgactacatgcccagcatgaagagatttcgcaaagaggaggaatccgagggcgccatctggtga

SEQ ID NO: 20378 - RNA, 9873 nt, synthetic construct
  misc_feature 1..9873: note = derived and/or modified CDS sequence (opt5) from DENV-3__KT726349__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacagacaggagtgagccacaacctcatgattacggtcgacgatgacggcaccatgcggatcaaagatgacgagacagagtctatcctgaccgtgcttctgaagacagctctgctcattgtctccggcatctttccgtacagcattcctgccaccctgcttgtgtggcatacgtggcagaaacagacccaacgctctggggttctgtgggatgtgccctcccctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacacataatggcaaacgcctcgaaccgaactgggccagcgttaagaaagacctgatctcttatggcgggggatggagactttccgcgcagtggcaaaagggcgaggaagtccaggtgattgctgtggagcctgggaaaaatcccaagaacttccagacgatgcctggaaccttccagacaaccaccggcgaaatcggggccatcgccctggattttaagcccggaacaagcggctcccccattatcaatcgggagggcaaagtcgtggggctgtacggaaacggcgttgtgacgaagaatgggggatatgtcagcggcattgctcaaaccaacgccgagcctgacgggccgacacccgaactcgaggaagagatgttcaaaaagcgcaatctgaccatcatggatcttcaccctggctctggaaaaacaagaaagtacctgcccgctattgtgcgggaagccatcaagcgcagactccggaccctgatcctcgcgcctacgagagttgtggccgctgagatggaggaagccctgaaaggccttcccattcgctatcagacaaccgctaccaagagcgagcatacagggcgggaaatcgtcgacctgatgtgccacgccacctttacaatgagactgctctcccctgtgcgcgttccgaactacaatctgattatcatggatgaggcccatttcaccgaccccgcttctattgcggcccggggatatatcagcacgagagtgggcatgggggaagctgccgccatctttatgacagctacccctcccggaacagccgatgcgttccctcagtccaacgctcccattcaggacgaggagcgcgacatcccggaacggtcttggaatagcggcaacgagtggattaccgattttgccgggaaaacggtctggttcgtgccttccatcaaggccggcaatgacattgctaactgtcttcgcaaaaacggaaagaaggtgatccaactgtctagaaaaacctttgatacagaataccagaagaccaaactcaatgactgggatttcgtcgttacaaccgacattagcgagatgggcgccaactttaaggcggatcgggtgatcgaccccagacggtgcctgaaacccgtgatcctgacagatgggcctgagcgcgtcattctcgccggacccatgcctgtgaccgctgcctccgctgcccagagacggggccgcgttgggagaaatccgcagaaggaaaacgaccaatacatcttcacgggacagccccttaataacgatgaggaccacgctcactggacagaagccaagatgctgctggacaatattaacacccctgagggcatcattcccgccctcttcgaacctgagcgggagaaaagcgccgctatcgatggggaatatagactgaagggcgagtctcgcaaaacctttgtggaacttatgcggagaggagacctgcccgtctggctcgcccataaggtggcttccgagggcatcaaatacacagatcgcaagtggtgcttcgacgggcagcggaataaccagattctggaagagaatatggatgttgagatctggaccaaagaaggagagaagaagaaactgagaccgcgctggctcgacgcccggacatatagcgatcctcttgccctgaaggaatttaaagacttcgctgcgggcagaaagtctattgccctggatctcgtgacggagatcgggcgcgtcccctcccacctggctcatagaacccggaacgcccttgacaatctggtgatgctccacacaagcgaacacggaggccgcgcctacagacatgctgtcgaggagctgcctgaaaccatggagacactgctccttctgggcctgatgattctcctgaccgggggagccatgctttttctgatctccggcaaagggatcggaaagacgtctattggcctcatctgtgtgattgcgagctccgggatgctgtggatggccgaaatccccctgcaatggattgctagcgccatcgttctcgagttctttatgatggtgcttctgattcctgagcccgaaaagcagcggaccccgcaggataaccaactggcttatgtggtcatcggaatcctcacactggccgcgattatcgccgctaatgagatgggccttctggaaaccacaaaacgcgacctcggcatgtctaaggagcctggggttgtgtcccccaccagctacctggatgtggacctgcaccccgcctctgcttggacgctctatgccgtcgctacaaccgtgattacacctatgcttagacataccatcgaaaacagcaccgccaatgtttccctggcggccattgctaaccaggccgtggtcctgatgggactcgacaaaggctggccgatctctaagatggatctgggggtgccccttctggctctcggatgctacagccaggtcaaccctctgacactgacggccgccgtgctccttctgatcacccactacgcgattatcggccccgggctgcaggctaaagccacacgggaggctcaaaagagaaccgccgccggaattatgaagaatcctacagttgacggcatcatgaccattgatctcgaccccgtgatctatgattccaaattcgagaagcagctgggccaggtcatgcttctggtgctctgtgctgttcagctgctgctcatgcgcacgtcttgggccctttgcgaagcgctgacactggccaccgggcctatcaccacactctgggagggaagcccgggcaaattttggaacaccacaattgctgtgtccatggccaatatcttccgggggagctacctggctggagccggccttgcgttttctattatgaagtccgtcgggacgggaaaaagaggcaccggcagccaaggggaaacactgggagagaagtggaagaaaaagctcaaccagctgtcccgcaaagagttcgacctgtataagaaatctggcatcaccgaggtggatcggacagaggccaaggaagggctcaaaagaggagagattacccatcacgctgtgagccggggctccgccaaacttcagtggtttgttgaacgcaatatggtcatccccgaggggagagtgattgacctgggatgtggccggggcgggtggtcttactattgcgctggactgaagaaagtgacggaagtccgcggctacaccaaagggggacctggccacgaggagcccgttcctatgagcacatatgggtggaacatcgtgaaactcatgtccggaaaggatgtgttctacctgcccccggaaaaatgtgacacccttctgtgcgatatcggcgagagctctccttcccccacagtcgaagagagcagaaccattcgggtgctcaagatggttgagccctggctgaagaataaccagttctgtatcaaagtgctgaatccttacatgcccacagtcattgaacatctcgagcgccttcaaagaaagcacggcgggatgctggtgcggaaccctctgtctcgcaattccacccatgaaatgtattggatcagcaacggaacgggcaatattgttgcctctgtgaacatggtcagcagactcctgcttaatcggtttacaatgacccacagacgcccgaccatcgagaaagacgtggatctgggggctggaacacggcacgtgaacgccgaacccgagacgcctaacatggacgtcatcggcgagagaattaagcgcatcaaagaagaacacaattccacctggcactacgacgatgaaaacccctataagacatgggcgtaccatgggtcttatgaggttaaggccaccggaagcgcttccagcatgattaatggcgtggtgaaactcctgacaaagccttgggacgtcgtgcccatggttacccagatggccatgacagataccacgccgttcggccagcaacgggtgtttaaagaaaaggtcgacaccagaacacctcgctccatgcccgggacccggagagtgatgggaatcacagctgagtggctgtggcgcaccctcggccggaacaaaaagcctagactgtgcacgcgcgaggagttcacaaagaaagttcggaccaatgccgccatgggggcggtgtttacagaggaaaaccagtgggattctgctaaggccgccgtcgaggacgaagatttctggaaacttgtggacagagagcgcgagctgcacaagctcggaaaatgtggcagctgcgtttacaatatgatggggaagagagagaagaagctgggcgagtttggaaaggctaaaggctcccgggccatttggtatatgtggcttggggctcgctacctggagttcgaggccctcggatttctgaacgaggatcattggttctctagagaaaatagctactccggcgtggagggggaaggactgcacaagctcggctatatcctgcgggacatctctaaaattcccgggggcgcgatgtacgccgatgacaccgctggatgggacacgagaatcaccgaggatgaccttcacaacgaagagaagattacacagcagatggatcctgagcatcggcaactggccaatgctatctttaaactcacctatcagaacaaggtcgtgaaggtccagcgccccacaccgaccggcacagtgatggacattatcagcagaaaagatcagcgggggtccggacaagttggcacctacgggctgaatacgttcacaaacatggaagcccagcttatccgccagatggagggagaaggcgtgctgagcaaggcggacctcgagaatcctcatctgcccgagaagaagattacccagtggctggagaccaaaggggtcgagagactcaagcggatggccatctctggcgatgactgcgtggtgaagcccattgatgaccgctttgctaacgccctgcttgctctgaacgatatgggaaaagttagaaaggacatccctcaatggcagccgtccaaaggctggcatgattggcaacaggtgcccttctgtagccaccacttccatgaactcattatgaaggacgggcggaaactggtcgtgccttgccgcccccaagacgagcttatcggacgggcccggatttctcagggcgctgggtggtccctgcgcgaaacagcctgtctcggaaaggcgtatgcccagatgtggagcctgatgtactttcacagacgggatctgcgcctcgcttctaatgccatctgctccgccgttcctgtgcattgggtccccaccagcagaacaacgtggtccatccacgctcatcaccaatggatgaccacagaggacatgctgaccgtgtggaaccgggtctggattgaagataatccttggatggaggacaagacacccgtgaccacgtgggagaacgttccgtatcttggcaaaagagaagatcagtggtgtgggagcctgatcggcctcacctctcgcgccacatgggcgcagaatattcctaccgctatccagcaagtgcggagcctgattggaaacgaggagttccttgactacatgccctccatgaagagatttcgcaaagaggaggaatctgagggcgccatctggtga

SEQ ID NO: 20379 - RNA, 9873 nt, synthetic construct
  misc_feature 1..9873: note = derived and/or modified CDS sequence (opt5) from DENV-3__KT726347__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctggccatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcaccaagaaggaggaacccgtgaacattgaggccgaacctccgttcggcgagtccaatatcgtgattgggatcggcgataacgccctgaaaatcaattggtataagaagggatctagcattggcaaaatgtttgaagctaccgccagaggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgaccaacgaggttcatacatggacggaacagtacaaatttcaagcggattcccccaagcggctggccaccgctatcgccggcgcttgggagaatggagtgtgtggcattagaagcacaacccgcatggaaaaccttctctggaaacagatcgccaatgagctgaactatatcctgtgggaaaataacattaagctcacagtcgtggttggggacatcattggagtgctggagcagggcaaacggacccttacgcctcagcccatggagctgaagtactcttggaaaacctgggggaaggccaagatcgtcacagctgaaacccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaaccatcgccccggatatcacacccaaacagctggcccttggcaccttgggaagctggagctcgactttaattactgcgagggaaccacggttgtgatcacagaaaactgtggcacccggggcccctctctgagaacaaccacagtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgccggatctggcaaggtggacaacttcacgatgggggtcctgtgcctcgccattctgtttgaagaggtgatgcggggaaagttcggcaaaaagcacatgatcgctggcgttttctttaccttcgtgcttctgctcagcgggcagattacatggcgcgatatggcccataccctgatcatgattggatccaatgcgagcgacagaatgggcatgggggtcacatatctggctcttatcgccacctttaaaatccagcccttcctggccctcggatttttcctgcggaagctcacgtctagagaaaacctgcttctgggcgtggggctcgctatggccacaaccctgcaactgcctgaggatattgaacagatggctaatggaatcgcccttggcctgatggcgctcaaactgattacacagtttgagacctaccagctctggaccgccctgatctcccttacatgtagcaacacgattttcaccctgacagtggcttggcgcaccgccacactcatcctggctggcgtctccctgcttccggtttgccaatctagctccatgcggaagaccgactggctgcccatggccgtggccgctatgggggtgcctcccctccctctgtttatcttctctctcaaggatacgctgaaaagacgcagctggccccttaatgagggagtcatggcggtgggcctggtttccattctggcctctagcctcctgagaaacgacgtgcctatggctgggccccttgtcgccggaggcctgctcatcgcctgttatgtgattacagggacctccgctgatctgaccgttgaaaaggccgcggacatcacatgggaggaagaggctgaacagaccggagtgagccacaacctcatgattacagtcgacgatgacggcacgatgcggatcaaagatgacgagaccgagaatatcctgacagtgcttctgaagaccgccctgctcattgtctctggcatctttccgtactccattcctgccacactgcttgtgtggcatacctggcagaaacagacgcaacgcagcggggttctgtgggatgtgccctctcctcccgaaacccagaaggctgagctcgaagagggagtctacagaatcaaacagcagggcattttcgggaagacacaagtgggagttggcgtgcagaaggagggggtctttcacaccatgtggcacgtgacacggggagccgtgctgacccataacggcaaacgcctcgaaccgaattgggcgtccgttaagaaagacctgatcagctatggcgggggatggagactttctgctcagtggcaaaagggcgaggaagtccaggtgattgccgtggagcctgggaaaaaccccaagaatttccagacaatgcctggaacgttccagaccacaaccggcgaaatcggggccatcgctctggattttaagcccggaacctccggcagccccattatcaaccgggagggcaaagtcgtggggctgtacggaaatggcgttgtgacaaagaacgggggatatgtctccggcattgcccaaacgaatgctgagcctgacgggccgacccccgaactcgaggaagagatgttcaaaaagcgcaacctgacaatcatggatcttcaccctggcagcggaaaaaccagaaagtacctgcccgccattgtgcgggaagcgatcaagcgcagactccggacactgatcctcgcccctaccagagttgtggctgccgagatggaggaagctctgaaaggccttcccattcgctatcagacgacagccaccaagtctgagcataccgggcgggaaatcgtcgacctgatgtgccacgccacatttaccatgagactgctcagccctgtgcgcgttccgaattacaacctgattatcatggatgaggctcatttcacagaccccgcgtccattgccgctcggggatatatctctaccagagtgggcatgggggaagccgccgctatctttatgacggccacacctcccggaaccgcggatgctttccctcagagcaatgcccccattcaggacgaggagcgcgacatcccggaacggtcctggaactctggcaatgagtggattacagattttgccgggaaaaccgtctggttcgtgcctagcatcaaggctggcaacgacattgccaactgtcttcgcaaaaatggaaagaaggtgatccaactgtccagaaaaacgtttgataccgaataccagaagacaaaactcaacgactgggatttcgtcgttaccacagacatttctgagatgggcgcgaattttaaggccgatcgggtgatcgaccccagacggtgcctgaaacccgtgatcctgaccgatgggcctgagcgcgtcattctcgctggacccatgcctgtgacagccgctagcgccgctcagagacggggccgcgttgggagaaacccgcagaaggaaaatgaccaatacatcttcaccggacagccccttaacaatgatgaggaccacgcccactggacggaagcgaagatgctgctggacaacattaatacacctgagggcatcattcccgccctcttcgaacctgagcgggagaaatccgctgccatcgatggggaatatagactgaagggcgagagccgcaaaacctttgtggaacttatgcggagaggagacctgcccgtctggctcgctcataaggtggcctctgagggcatcaaatacaccgatcgcaagtggtgcttcgacgggcagcggaacaatcagattctggaagagaacatggatgttgagatctggacaaaagaaggagagaagaagaaactgagaccgcgctggctcgacgcccggacctattccgatcctcttgctctgaaggaatttaaagacttcgcggccggcagaaagagcattgctctggatctcgtgacagagatcgggcgcgtcccctctcacctggcccatagaacgcggaatgcccttgacaacctggtgatgctccacacctccgaacacggaggccgcgcttacagacatgccgtcgaggagctgcctgaaacaatggagaccctgctccttctgggcctgatgattctcctgacagggggagcgatgctttttctgatcagcggcaaagggatcggaaagacctccattggcctcatctgtgtgattgcctctagcgggatgctgtggatggctgaaatccccctgcaatggattgcctccgctatcgttctcgagttctttatgatggtgcttctgattcctgagcccgaaaagcagcggacgccgcaggataatcaactggcctatgtggtcatcggaatcctcaccctggcggccattatcgctgccaacgagatgggccttctggaaacaaccaaacgcgacctcggcatgagcaaggagcctggggttgtgtctcccacatcctacctggatgtggacctgcaccccgctagcgcctggaccctctatgctgtcgccacgacagtgattacccctatgcttagacatacaatcgaaaattctaccgcgaacgttagcctggccgctattgccaaccaggctgtggtcctgatgggactcgacaaaggctggccgatctccaagatggatctgggggtgccccttctggccctcggatgctactctcaggtcaatcctctgaccctgacagccgcggtgctccttctgatcacgcactacgctattatcggccccgggctgcaggccaaagctacccgggaggcccaaaagagaacagccgctggaattatgaagaaccctaccgttgacggcatcatgacaattgatctcgaccccgtgatctatgatagcaaattcgagaagcagctgggccaggtcatgcttctggtgctctgtgccgttcagctgctgctcatgcgcacctcctgggcgctttgcgaagccctgacgctggctacagggcctatcaccaccctctgggagggatctccgggcaaattttggaatacaaccattgccgtgagcatggctaacatcttccgggggtcctacctggccggagcgggccttgcctttagcattatgaagtctgtcgggacaggaaaaagaggcacgggctcccaaggggaaaccctgggagagaagtggaagaaaaagctcaatcagctgagccgcaaagagttcgacctgtataagaaatccggcatcacagaggtggatcggaccgaggctaaggaagggctcaaaagaggagagattacacatcacgccgtgtctcggggcagcgctaaacttcagtggtttgttgaacgcaacatggtcatccccgaggggagagtgattgacctgggatgtggccggggcgggtggtcctactattgcgccggactgaagaaagtgaccgaagtccgcggctacacgaaagggggacctggccacgaggagcccgttcctatgtctacctatgggtggaatatcgtgaaactcatgagcggaaaggatgtgttctacctgcccccggaaaaatgtgacacacttctgtgcgatatcggcgagtccagcccttctcccaccgtcgaagagtccagaacaattcgggtgctcaagatggttgagccctggctgaagaacaatcagttctgtatcaaagtgctgaacccttacatgcccaccgtcattgaacatctcgagcgccttcaaagaaagcacggcgggatgctggtgcggaatcctctgagccgcaactctacacatgaaatgtattggatctccaatggaaccggcaacattgttgctagcgtgaatatggtctctagactcctgcttaaccggtttacgatgacacacagacgcccgaccatcgagaaagacgtggatctgggggccggaacccggcacgtgaacgcggaacccgagacacctaatatggacgtcatcggcgagagaattaagcgcatcaaagaagaacacaacagcacgtggcactacgacgatgaaaatccctataagacctgggcctaccatgggtcctatgaggttaaggctacaggatctgccagctccatgattaacggcgtggtgaaactcctgaccaagccttgggacgtcgtgcccatggttacacagatggctatgaccgatacaaccccgttcggccagcaacgggtgtttaaagaaaaggtcgacacgagaacccctcgcagcatgcccgggacacggagagtgatgggaatcaccgccgagtggctgtggcgcacactcggccggaataaaaagcctagactgtgcacccgcgaggagttcacgaagaaagttcggacaaacgccgcgatgggggctgtgtttaccgaggaaaatcagtgggattccgccaaggccgctgtcgaggacgaagatttctggaaacttgtggacagagagcgcgagctgcacaagctcggaaaatgtggctcttgcgtttacaacatgatggggaagagagagaagaagctgggcgagtttggaaaggccaaaggcagccgggctatttggtatatgtggcttggggcccgctacctggagttcgaggcgctcggatttctgaatgaggatcattggttctccagagaaaactcttacagcggcgtggagggggaaggactgcacaagctcggctatatcctgcgggacatctccaaaattcccgggggcgccatgtacgctgatgacacagccggatgggacaccagaatcacggaggatgaccttcacaatgaagagaagattacccagcagatggatcctgagcatcggcaactggctaacgccatctttaaactcacatatcagaataaggtcgtgaaggtccagcgccccaccccgacaggcaccgtgatggacattatctctagaaaagatcagcgggggagcggacaagttggcacatacgggctgaacaccttcacgaatatggaagcgcagcttatccgccagatggagggagaaggcgtgctgtccaaggccgacctcgagaaccctcatctgcccgagaaaaagattacacagtggctggagaccaaaggggtcgagagactcaagcggatggctatcagcggcgatgactgcgtggtgaagcccattgatgaccgctttgccaacgctctgcttgccctgaatgatatgggaaaagttagaaaggacatccctcaatggcagccgtctaaaggctggcatgattggcaacaggtgcccttctgttcccaccacttccatgaactcattatgaaggacgggcggaaactggtcgtgccttgccgcccccaagacgagcttatcggacgggctcggattagccagggcgccgggtggtctctgcgcgaaaccgcgtgtctcggaaaggcctatgctcagatgtggtccctgatgtactttcacagacgggatctgcgcctcgccagcaacgccatctgctctgctgttcctgtgcattgggtccccacatccagaaccacatggagcatccacgcccatcaccaatggatgacgaccgaggacatgctgacagtgtggaatcgggtctggattgaagataacccttggatggaggacaagacccccgtgacaacctgggagaatgttccgtatcttggcaaaagagaagatcagtggtgtgggtccctgatcggcctcacgagccgcgcgacctgggctcagaacattcctacagccatccagcaagtgcggtctctgattggaaatgaggagttccttgactacatgcccagcatgaagagatttcgcaaagaggaggaatccgagggcgccatctggtga

SEQ ID NO: 20380 - RNA, 9873 nt, synthetic construct
  misc_feature 1..9873: note = derived and/or modified CDS sequence (opt5) from DENV-3__KT726352__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacagacaggagtgagccacaacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcatacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacacataacggcaaacgcctcgaaccgaattgggcctccgttaagaaagacctgatcagctatggcgggggatggagactttctgcgcagtggcaaaagggcgaggaagtccaggtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtacggaaatggcgttgtgacgaagaacgggggatatgtctccggcattgctcaaaccaatgccgagcctgacgggccgacacccgaactcgaggaagagatgttcaaaaagcgcaacctgaccatcatggatcttcaccctggcagcggaaaaacaagaaagtacctgcccgctattgtgcgggaagccatcaagcgcagactccggaccctgatcctcgcgcctacgagagttgtggccgctgagatggaggaagccctgaaaggccttcccattcgctatcagacaaccgctaccaagtctgagcatacagggcgggaaatcgtcgacctgatgtgccacgccacctttacaatgagactgctcagccctgtgcgcgttccgaattacaacctgattatcatggatgaggcccatttcaccgaccccgcttccattgcggcccggggatatatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccaactgtccagaaaaacctttgatacagaataccagaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatacatcttcacgggacagccccttaacaatgatgaggaccacgctcactggacagaagccaagatgctgctggacaacattaatacccctgagggcatcattcccgccctcttcgaacctgagcgggagaaatccgccgctatcgatggggaatatagactgaagggcgagagccgcaaaacctttgtggaacttatgcggagaggagacctgcccgtctggctcgcccataaggtggcttctgagggcatcaaatacacagatcgcaagtggtgcttcgacgggcagcggaacaatcagattctggaagagaacatggatgttgagatctggaccaaagaaggagagaagaagaaactgagaccgcgctggctcgacgcccggacatattccgatcctcttgccctgaaggaatttaaagacttcgctgcgggcagaaagagcattgccctggatctcgtgacggagatcgggcgcgtcccctctcacctggctcatagaacccggaatgcccttgacaacctggtgatgctccacacatccgaacacggaggccgcgcctacagacatgctgtcgaggagctgcctgaaaccatggagacactgctccttctgggcctgatgattctcctgaccgggggagccatgctttttctgatcagcggcaaagggatcggaaagacgtccattggcctcatctgtgtgattgcgtctagcgggatgctgtggatggccgaaatccccctgcaatggattgcttccgccatcgttctcgagttctttatgatggtgcttctgattcctgagcccgaaaagcagcggaccccgcaggataatcaactggcttatgtggtcatcggaatcctcacactggccgcgattatcgccgctaacgagatgggccttctggaaaccacaaaacgcgacctcggcatgagcaaggagcctggggttgtgtctcccacctcctacctggatgtggacctgcaccccgccagcgcttggacgctctatgccgtcgctacaaccgtgattacacctatgcttagacataccatcgaaaattctaccgccaacgttagcctggcggccattgctaaccaggccgtggtcctgatgggactcgacaaaggctggccgatctccaagatggatctgggggtgccccttctggctctcggatgctactctcaggtcaatcctctgacactgacggccgccgtgctccttctgatcacccactacgcgattatcggccccgggctgcaggctaaagccacacgggaggctcaaaagagaaccgccgccggaattatgaagaaccctacagttgacggcatcatgaccattgatctcgaccccgtgatctatgatagcaaattcgagaagcagctgggccaggtcatgcttctggtgctctgtgctgttcagctgctgctcatgcgcacgtcctgggccctttgcgaagcgctgacactggccaccgggcctatcaccacactctgggagggatctccgggcaaattttggaataccacaattgctgtgagcatggccaacatcttccgggggtcctacctggctggagccggccttgcgtttagcattatgaagtctgtcgggacgggaaaaagaggcaccggctcccaaggggaaacactgggagagaagtggaagaaaaagctcaatcagctgagccgcaaagagttcgacctgtataagaaatccggcatcaccgaggtggatcggacagaggccaaggaagggctcaaaagaggagagattacccatcacgctgtgtctcggggcagcgccaaacttcagtggtttgttgaacgcaacatggtcatccccgaggggagagtgattgacctgggatgtggccggggcgggtggtcctactattgcgctggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatatcggcgagtccagcccttctcccacagtcgaagagtccagaaccattcgggtgctcaagatggttgagccctggctgaagaacaatcagttctgtatcaaagtgctgaacccttacatgcccacagtcattgaacatctcgagcgccttcaaagaaagcacggcgggatgctggtgcggaatcctctgagccgcaactctacccatgaaatgtattggatctccaatggaacgggcaacattgttgccagcgtgaatatggtctctagactcctgcttaaccggtttacaatgacccacagacgcccggctatcgagaaagacgtggatctgggggccggaacccggcacgtgaacgcggaacccgagacacctaatatggacgtcatcggcgagagaattaagcgcatcaaagaagaacacaacagcacgtggcactacgacgatgaaaatccctataagacctgggcctaccatgggtcctatgaggttaaggctacaggatctgccagctccatgattaacggcgtggtgaaactcctgaccaagccttgggacgtcgtgcccatggttacacagatggctatgaccgatacaaccccgttcggccagcaacgggtgtttaaagaaaaggtcgacacgagaacccctcgcagcatgcccgggacacggagagtgatgggaatcaccgccgagtggctgtggcgcacactcggccggaataaaaagcctagactgtgcacccgcgaggagttcacgaagaaagttcggacaaacgccgcgatgggggctgtgtttaccgaggaaaatcagtgggattccgccaaggccgctgtcgaggacgaagatttctggaaacttgtggacagagagcgcgagctgcacaagctcggaaaatgtggctcttgcgtttacaacatgatggggaagagagagaagaagctgggcgagtttggaaaggccaaaggcagccgggctatttggtatatgtggcttggggcccgctacctggagttcgaggcgctcggatttctgaatgaggatcattggttctccagagaaaactcttacagcggcgtggagggggaaggactgcacaagctcggctatatcctgcgggacatctccaaaattcccgggggcgccatgtacgctgatgacacagccggatgggacaccagaatcacggaggatgaccttcacaatgaagagaagattacccagcagatggatcctgagcatcggcaactggctaacgccatctttaaactcacatatcagaataaggtcgtgaaggtccagcgccccaccccgacaggcaccgtgatggacattatctctagaaaagatcagcgggggagcggacaagttggcacatacgggctgaacaccttcacgaatatggaagcgcagcttatccgccagatggagggagaaggcgtgctgtccaaggccgacctcgagaaccctcatctgcccgagaagaagattacacagtggctggagaccaaaggggtcgagagactcaagcggatggctatcagcggcgatgactgcgtggtgaagcccattgatgaccgctttgccaacgctctgcttgccctgaatgatatgggaaaagttagaaaggacatccctcaatggcagccgtctaaaggctggcatgattggcaacaggtgcccttctgttcccaccacttccatgaactcattatgaaggacgggcggaaactggtcgtgccttgccgcccccaagacgagcttatcggacgggctcggattagccagggcgccgggtggtctctgcgcgaaaccgcgtgtctcggaaaggcctatgctcagatgtggtccctgatgtactttcacagacgggatctgcgcctcgccagcaacgccatctgctctgctgttcctgtgcattgggtccccacatccagaaccacatggagcatccacgcccatcaccaatggatgacgaccgaggacatgctgacagtgtggaatcgggtctggattgaagataacccttggatggaggacaagacccccgtgacaacctgggagaatgttccgtatcttggcaaaagagaagatcagtggtgtgggtccctgatcggcctcacgagccgcgcgacctgggctcagaacattcctacagccatccagcaagtgcggtctctgattggaaatgaggagttccttgactacatgcccagcatgaagagatttcgcaaagaggaggaatccgagggcgccatctggtga

SEQ ID NO: 20381 - RNA, 9873 nt, synthetic construct
  misc_feature 1..9873: note = derived and/or modified CDS sequence (opt5) from DENV-3__KT726356__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttctggctggaggcctcctgatcgcctgttatgtcattaccgggacctccgccgatctcacagtggaaaaggctgccgacatcacctgggaggaagaggcggaacagacaggagttagccacaacctgatgattacggtggacgatgacggcaccatgcggatcaaagatgacgagacagagaatatccttaccgtcctgctgaagacagctctcctgattgtgtctggcatctttccgtactccattcctgccacccttctggtctggcatacgtggcagaaacagacccaacgcagcggggtgctctgggatgttccctctcctcccgaaacacagaaggccgagctggaagagggagtgtacagaatcaaacagcagggcattttcgggaagacccaagtcggagtgggcgttcagaaggagggggtgtttcacacaatgtggcacgtcacccggggagctgtgctcacacataacggcaaacgcctggaaccgaattgggcctccgtgaagaaagaccttatcagctatggcgggggatggagactgtctgcgcagtggcaaaagggcgaggaagttcaggtcattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtggtcgggctctacggaaatggcgtggttacgaagaacgggggatatgtgtccggcattgctcaaaccaatgccgagcctgacgggccgacacccgaactggaggaagagatgttcaaaaagcgcaaccttaccatcatggatctgcaccctggcagcggaaaaacaagaaagtacctccccgctattgtccgggaagccatcaagcgcagactgcggaccctcatcctggcgcctacgagagtggttgccgctgagatggaggaagcccttaaaggcctgcccattcgctatcagacaaccgctaccaagtctgagcatacagggcgggaaatcgtggacctgatgtgccacgccacctttacaatgagactcctgagccctgtccgcgtgccgaattacaaccttattatcatggatgaggcccatttcaccgaccccgcttccattgcggcccggggatatatctctacgagagttggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtgtggttcgtccctagcatcaaggccggcaacgacattgctaactgtctgcgcaaaaatggaaagaaggtgatccaactctccagaaaaacctttgatacagaataccagaagaccaaactgaacgactgggatttcgtggtcacaaccgacatttctgagatgggcgccaattttaaggcggatcgggttatcgaccccagacggtgcctgaaacccgtgatcctcacagatgggcctgagcgcgtgattcttgccggacccatgcctgtcaccgctgccagcgctgcccagagacggggccgcgtggggagaaacccgcagaaggaaaatgaccaatacatcttcacgggacagcccctgaacaatgatgaggaccacgctcactggacagaagccaagatgctgctcgacaacattaatacccctgagggcatcattcccgcgctgttcgaacctgagcgggagaaatccgccgctatcgatggggaatatagacttaagggcgagagccgcaaaacctttgttgaactgatgcggagaggagacctccccgtgtggctggcccataaggtcgcttctgagggcatcaaatacacagatcgcaagtggtgcttcgacgggcagcggaacaatcagattctggaagagaacatggatgtggagatctggaccaaagaaggagagaagaagaaactcagaccgcgctggcttgacgcccggacatattccgatcctctggccctgaaggaatttaaagacttcgctgcgggcagaaagagcattgccctcgatctggttacggagatcgggcgcgtgccctctcaccttgctcatagaacccggaatgccctggacaacctcgtcatgctgcacacatccgaacacggaggccgcgcctacagacatgctgtggaggagctgcctgaaaccatggagacactccttctgctgggcctcatgattctgcttaccgggggagccatgctgtttctcatcagcggcaaagggatcggaaagacgtccattggcctgatctgtgtcattgcgtctagcgggatgctgtggatggccgaaatccccctccaatggattgcttccgccatcgtgcttgagttctttatgatggttctgctgattcctgagcccgaaaagcagcggaccccgcaggataatcaactcgcttatgtggtgatcggaatcctgacacttgccgcgattatcgccgctaacgagatgggcctgctcgaaaccacaaaacgcgacctgggcatgagcaaggagcctggggtcgtttctcccacctcctacctggatgtggacctccaccccgccagcgcttggacgctttatgccgtggctacaaccgtcattacacctatgctgagacataccatcgaaaattctaccgccaacgtgagcctggcggccattgctaaccaggccgttgtgctcatgggactggacaaaggctggccgatctccaagatggatcttggggtccccctgctcgctctgggatgctactctcaggtgaatcctctgacactcacggccgccgtccttctgctgatcacccactacgcgattatcggccccgggctccaggctaaagccacacgggaggctcaaaagagaaccgccgccggaattatgaagaaccctacagtggacggcatcatgaccattgatctggaccccgttatctatgatagcaaattcgagaagcagcttggccaggtgatgctgctcgtcctgtgtgctgtgcagctgctccttatgcgcacgtcctgggccctgtgcgaagcgctgacactcgccaccgggcctatcaccacactgtgggagggatctccgggcaaattttggaataccacaattgctgttagcatggccaacatcttccgggggtcctaccttgctggagccggcctggcgtttagcattatgaagtctgtggggacgggaaaaagaggcaccggctcccaaggggaaacactcggagagaagtggaagaaaaagctgaatcagctgagccgcaaagagttcgacctctataagaaatccggcatcaccgaggtcgatcggacagaggccaaggaagggcttaaaagaggagagattacccatcacgctgtgtctcggggcagcgccaagctgcagtggtttgtggaacgcaacatggttatccccgaggggagagtcattgacctgggatgtggccggggcgggtggtcctactattgcgctggactcaagaaagtgacggaagtgcgcggctacaccaaagggggacctggccacgaggagcccgtccctatgtctacatatgggtggaatatcgttaaactgatgagcggaaaggatgtgttctaccttcccccggaaaaatgtgacaccctgctctgcgatatcggcgagtccagcccttctcccacagtggaagagtccagaaccattcgggtcctgaagatggtggagccctggctgaagaacaatcagttctgtatcaaagttctcaacccttacatgcccacagtgattgaacatcttgagcgcctgcaaagaaagcacggcgggatgctggtccggaatcctctcagccgcaactctacccatgaaatgtattggatctccaatggaacgggcaacattgtggccagcgttaatatggtgtctagactgcttctgaaccggtttacaatgacctacagacgcccgaccatcgagaaagacgtcgatctcggggctggaacacggcacgtgaacgccgaacccgagacgcctaatatggacgtgatcggcgagagaattaagcgcatcaaagaagaacacaacagcacctggcattatgacgatgaaaatccctacaagacatgggcgtatcacgggtcctacgaggtcaaggccaccggatctgctagctccatgattaacggcgttgtgaaactgctgacaaagccttgggacgtggtccccatggtgacccagatggccatgacagataccacgccgttcggccagcaacgggtttttaaagaaaaggtggacaccagaacacctcgcagcatgcccgggacccggagagtcatgggaatcacagctgagtggctctggcgcaccctgggccggaataaaaagcctagactttgcacgcgcgaggagttcacaaagaaagtgcggaccaacgccgccatgggggcggtttttacagaggaaaatcagtgggattccgctaaggccgccgtggaggacgaagatttctggaaactggtcgacagagagcgcgagctccataagctgggaaaatgtggctcttgcgtgtataacatgatggggaagagagagaagaaacttggcgagtttggaaaggctaaaggcagccgggccatttggtacatgtggctgggggctcgctacctcgagttcgaggccctgggatttctgaatgaggatcactggttctccagagaaaactcttatagcggcgttgagggggaaggactccataagctgggctacatccttcgggacatctccaaaattcccgggggcgcgatgtatgccgatgacaccgctggatgggacacgagaatcaccgaggatgacctgcacaatgaagagaagattacacagcagatggatcctgagcaccggcaactcgccaacgctatctttaaactgacctaccagaataaggtggtcaaggtgcagcgccccacaccgaccggcacagtcatggacattatctctagaaaagatcagcgggggagcggacaagtgggcacctatgggcttaacacgttcacaaatatggaagcccagctgatccgccagatggagggagaaggcgttctctccaaggcggacctggagaaccctcatctgcccgagaagaagattacccagtggctcgagaccaaaggggtggagagactgaagcggatggccatcagcggcgatgactgcgtcgtgaagcccattgatgaccgctttgctaacgcccttctggctctcaatgatatgggaaaagtgagaaaggacatccctcaatggcagccgtctaaaggctggcacgattggcagcaggttcccttctgttcccatcacttccacgaactgattatgaaggacgggcggaaacttgtggtcccttgccgcccccaagacgagctgatcggacgggcccggattagccagggcgctgggtggtctctccgcgaaacagcctgtctgggaaaggcgtacgcccagatgtggtccctgatgtattttcatagacgggatctccgcctggctagcaacgccatctgctctgccgtgcctgttcactgggtgcccacctccagaacaacgtggagcatccatgctcaccatcaatggatgaccacagaggacatgcttaccgtctggaatcgggtgtggattgaagataacccttggatggaggacaagacacccgtcaccacgtgggagaatgtgccgtacctgggcaaaagagaagatcagtggtgtgggtccctcatcggcctgaccagccgcgccacatgggcgcagaacattcctaccgctatccagcaagttcggtctcttattggaaatgaggagttcctggactacatgcccagcatgaagagatttcgcaaagaggaggaatccgagggcgccatctggtga

SEQ ID NO: 20382 - RNA, 9873 nt, synthetic construct
  misc_feature 1..9873: note = derived and/or modified CDS sequence (opt5) from DENV-3__KT726342__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacagacaggagtgagccacaacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcatacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacacataacggcaaacgcctcgaaccgaattgggcctccgttaagaaagacctgatcagctatggcgggggatggagactttctgcgcagtggcaaaagggcgaggaagtccaggtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtacggaaatggcgttgtgacgaagaacgggggatatgtctccggcattgctcaaaccaatgccgagcctgacgggccgacacccgaactcgaggaagagatgttcaaaaagcgcaacctgaccatcatggatcttcaccctggcagcggaaaaacaagaaagtacctgcccgctattgtgcgggaagccatcaagcgcagactccggaccctgatcctcgcgcctacgagagttgtggccgctgagatggaggaagccctgaaaggccttcccattcgctatcagacaaccgctaccaagtctgagcatacagggcgggaaatcgtcgacctgatgtgccacgccacctttacaatgagactgctcagccctgtgcgcgttccgaattacaacctgattatcatggatgaggcccatttcaccgaccccgcttccattgcggcccggggatatatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccaactgtccagaaaaacctttgatacagaataccagaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatacatcttcacgggacagccccttaacaatgatgaggaccacgctcactggacagaagccaagatgctgctggacaacattaatacccctgagggcatcattcccgccctcttcgaacctgagcgggagaaatccgccgctatcgatggggaatatagactgaagggcgagagccgcaaaacctttgtggaacttatgcggagaggagacctgcccgtctggctcgcccataaggtggcttctgagggcatcaaatacacagatcgcaagtggtgcttcgacgggcagcggaacaatcagattctggaagagaacatggatgttgagatctggaccaaagaaggagagaagaagaaactgagaccgcgctggctcgacgcccggacatattccgatcctcttgccctgaaggaatttaaagacttcgctgcgggcagaaagagcattgccctggatctcgtgacggagatcgggcgcgtcccctctcacctggctcatagaacccggaatgcccttgacaacctggtgatgctccacacatccgaacacggaggccgcgcctacagacatgctgtcgaggagctgcctgaaaccatggagacactgctccttctgggcctgatgattctcctgaccgggggagccatgctttttctgatcagcggcaaagggatcggaaagacgtccattggcctcatctgtgtgattgcgtctagcgggatgctgtggatggccgaaatccccctgcaatggattgcttccgccatcgttctcgagttctttatgatggtgcttctgattcctgagcccgaaaagcagcggaccccgcaggataatcaactggcttatgtggtcatcggaatcctcacactggccgcgattatcgccgctaacgagatgggccttctggaaaccacaaaacgcgacctcggcatgagcaaggagcctggggttgtgtctcccacctcctacctggatgtggacctgcaccccgccagcgcttggacgctctatgccgtcgctacaaccgtgattacacctatgcttagacataccatcgaaaattctaccgccaacgttagcctggcggccattgctaaccaggccgtggtcctgatgggactcgacaaaggctggccgatctccaagatggatctgggggtgccccttctggctctcggatgctactctcaggtcaatcctctgacactgacggccgccgtgctccttctgatcacccactacgcgattatcggccccgggctgcaggctaaagccacacgggaggctcaaaagagaaccgccgccggaattatgaagaaccctacagttgacggcatcatgaccattgatctcgaccccgtgatctatgatagcaaattcgagaagcagctgggccaggtcatgcttctggtgctctgtgctgttcagctgctgctcatgcgcacgtcctgggccctttgcgaagcgctgacactggccaccgggcctatcaccacactctgggagggatctccgggcaaattttggaataccacaattgctgtgagcatggccaacatcttccgggggtcctacctggctggagccggccttgcgtttagcattatgaagtctgtcgggacgggaaaaagaggcaccggctcccaaggggaaacactgggagagaagtggaagaaaaagctcaatcagctgagccgcaaagagttcgacctgtataagaaatccggcatcaccgaggtggatcggacagaggccaaggaagggctcaaaagaggagagattacccatcacgctgtgtctcggggcagcgccaaacttcagtggtttgttgaacgcaacatggtcatccccgaggggagagtgattgacctgggatgtggccggggcgggtggtcctactattgcgctggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatatcggcgagtccagcccttctcccacagtcgaagagtccagaaccattcgggtgctcaagatggttgagccctggctgaagaacaatcagttctgtatcaaagtgctgaacccttacatgcccacagtcattgaacatctcgagcgccttcaaagaaagcacggcgggatgctggtgcggaatcctctgagccgcaactctacccatgaaatgtattggatctccaatggaacgggcaacattgttgccagcgtgaatatggtctctagactcctgcttaaccggtttacaatgacccacagacgcccgaccatcgagaaagacgtggatctgggggctggaacacggcacgtgaacgccgaacccgagacgcctaatatggacgtcatcggcgagagaattaagcgcatcaaagaagaacacaacagcacctggcactacgacgatgaaaatccctataagacatgggcgtaccatgggtcctatgaggttaaggccaccggatctgctagctccatgattaacggcgtggtgaaactcctgacaaagccttgggacgtcgtgcccatggttacccagatggccatgacagataccacgccgttcggccagcaacgggtgtttaaagaaaaggtcgacaccagaacacctcgcagcatgcccgggacccggagagtgatgggaatcacagctgagtggctgtggcgcaccctcggccggaataaaaagcctagactgtgcacgcgcgaggagttcacaaagaaagttcggaccaacgccgccatgggggcggtgtttacagaggaaaatcagtgggattccgctaaggccgccgtcgaggacgaagatttctggaaacttgtggacagagagcgcgagctgcacaagctcggaaaatgtggctcttgcgtttacaacatgatggggaagagagagaagaagctgggcgagtttggaaaggctaaaggcagccgggccatttggtatatgtggcttggggctcgctacctggagttcgaggccctcggatttctgaatgaggatcattggttctccagagaaaactcttacagcggcgtggagggggaaggactgcacaagctcggctatatcctgcgggacatctccaaaattcccgggggcgcgatgtacgccgatgacaccgctggatgggacacgagaatcaccgaggatgaccttcacaatgaagagaagattacacagcagatggatcctgagcatcggcaactggccaacgctatctttaaactcacctatcagaataaggtcgtgaaggtccagcgccccacaccgaccggcacagtgatggacattatctctagaaaagatcagcgggggagcggacaagttggcacctacgggctgaacacgttcacaaatatggaagcccagcttatccgccagatggagggagaaggcgtgctgtccaaggcggacctcgagaaccctcatctgcccgagaagaagattacccagtggctggagaccaaaggggtcgagagactcaagcggatggccatcagcggcgatgactgcgtggtgaagcccattgatgaccgctttgctaacgccctgcttgctctgaatgatatgggaaaagttagaaaggacatccctcaatggcagccgtctaaaggctggcatgattggcaacaggtgcccttctgttcccaccacttccatgaactcattatgaaggacgggcggaaactggtcgtgccttgccgcccccaagacgagcttatcggacgggcccggattagccagggcgctgggtggtctctgcgcgaaacagcctgtctcggaaaggcgtatgcccagatgtggtccctgatgtactttcacagacgggatctgcgcctcgctagcaacgccatctgctctgccgttcctgtgcattgggtccccacctccagaacaacgtggagcatccacgctcatcaccaatggatgaccacagaggacatgctgaccgtgtggaatcgggtctggattgaagataacccttggatggaggacaagacacccgtgaccacgtgggagaatgttccgtatcttggcaaaagagaagatcagtggtgtgggtccctgatcggcctcaccagccgcgccacatgggcgcagaacattcctaccgctatccagcaagtgcggtctctgattggaaatgaggagttccttgactacatgcccagcatgaagagatttcgcaaagaggaggaatccgagggcgccatctggtga

SEQ ID NO: 20383 - RNA, 9873 nt, synthetic construct
  misc_feature 1..9873: note = derived and/or modified CDS sequence (opt5) from DENV-3__KT726343__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaaccatcgccccggatatcacacacaaaccgctggcccttggcaccttgggaagctggagctcgactttaattactgcgagggaacgacagtggttatcaccgaaaactgtggcacacggggcccctctctgagaaccacaaccgtgtccgggaaactgatccatgagtggtgctgtcgcagctgcacgcttccgcctctccggtatatgggagaagatggctgttggtacgggatggagattagacccatctctgaaaaggaggagaatatggtcaaatccctggtgagcgccggatctggcaaggttgacaacttcaccatgggggtgctgtgcctcgccattctgtttgaagaggtcatgcggggaaagttcggcaaaaagcacatgatcgctggcgtgttctttacattcgttcttctgctcagcgggcagattacctggcgcgatatggcccatacactgatcatgattggatccaatgcgagcgacagaatgggcatgggggtgacctatctggctcttatcgccacgtttaaaatccagcccttcctggccctcggatttttcctgcggaagctcacatctagagaaaacctgcttctgggcgtcgggctcgctatggccaccacactgcaactgcctgaggatattgaacagatggctaatggaatcgcccttggcctgatggcgctcaaactgattacccagtttgagacctaccagctctggacagccctgatctcccttacgtgtagcaacaccattttcacactgaccgtggcttggcgcacagccaccctcatcctggctggcgtgtccctgcttccggtctgccaatctagctccatgcggaagacggactggctgcccatggccgttgccgctatgggggtgcctcccctccctctgtttatcttctctctcaaggatacactgaaaagacgcagctggccccttaatgagggagtgatggcggtcggcctggtgtccattctggcctctagcctcctgagaaacgacgttcctatggctgggccccttgtggccggaggcctgctcatcgcctgttatgtcattaccgggacctccgctgatctgacagtggaaaaggccgcggacatcacctgggaggaagaggctgaacagacaggagttagccacaacctcatgattacggtggacgatgacggcaccatgcggatcaaagatgacgagacagagaatatcctgaccgtccttctgaagacagccctgctcattgtgtctggcatctttccgtactccattcctgccaccctgcttgtctggcatacgtggcagaaacagacccaacgcagcggggtgctgtgggatgttccctctcctcccgaaacacagaaggctgagctcgaagagggagtgtacagaatcaaacagcagggcattttcgggaagacccaagtcggagtgggcgttcagaaggagggggtgtttcacacaatgtggcacgtcacccggggagccgtgctgacacataacggcaaacgcctcgaaccgaattgggcgtccgtgaagaaagacctgatcagctatggcgggggatggagactttctgctcagtggcaaaagggcgaggaagttcaggtcattgccgtggagcctgggaaaaaccccaagaatttccagacgatgcctggaaccttccagacaaccaccggcgaaatcggggccatcgctctggattttaagcccggaacatccggcagccccattatcaaccgggagggcaaagtggtcgggctgtacggaaatggcgtggttacgaagaacgggggatatgtgtccggcattgcccaaaccaatgctgagcctgacgggccgacacccgaactcgaggaagagatgttcaaaaagcgcaacctgaccatcatggatcttcaccctggcagcggaaaaacaagaaagtacctgcccgccattgtccgggaagcgatcaagcgcagactccggaccctgatcctcgcccctacgagagtggttgctgccgagatggaggaagctctgaaaggccttcccattcgctatcagacaaccgccaccaagtctgagcatacagggcgggaaatcgtggacctgatgtgccacgccacctttacaatgagactgctcagccctgtccgcgtgccgaattacaacctgattatcatggatgaggctcatttcaccgaccccgcgtccattgccgctcggggatatatctctacgagagttggcatgggggaagccgccgctatctttatgacagccacccctcccggaacagcggatgctttccctcagagcaatgcccccattcaggacgaggagcgcgacatcccggaacggtcctggaactctggcaatgagtggattaccgattttgccgggaaaacggtgtggttcgtccctagcatcaaggctggcaacgacattgccaactgtcttcgcaaaaatggaaagaaggtgatccaactgtccagaaaaacctttgatacagaataccagaagaccaaactcaacgactgggatttcgtggtcacaaccgacatttctgagatgggcgcgaattttaaggccgatcgggttatcgaccccagacggtgcctgaaacccgtgatcctgacagatgggcctgagcgcgtgattctcgctggacccatgcctgtcaccgccgctagcgccgctcagagacggggccgcgtggggagaaacccgcagaaggaaaatgaccaatacatcttcacgggacagccccttaacaatgatgaggaccacgcccactggacagaagcgaagatgctgctggacaacattaatacccctgagggcatcattcccgccctcttcgaacctgagcgggagaaatccgctgccatcgatggggaatatagactgaagggcgagagccgcaaaacctttgttgaacttatgcggagaggagacctgcccgtgtggctcgctcataaggtcgcctctgagggcatcaaatacacagatcgcaagtggtgcttcgacgggcagcggaacaatcagattctggaagagaacatggatgtggagatctggaccaaagaaggagagaagaagaaactgagaccgcgctggctcgacgcccggacatattccgatcctcttgctctgaaggaatttaaagacttcgcggccggcagaaagagcattgctctggatctcgttacggagatcgggcgcgtgccctctcacctggcccatagaacccggaatgcccttgacaacctggtcatgctccacacatccgaacacggaggccgcgcttacagacatgccgtggaggagctgcctgaaaccatggagacactgctccttctgggcctgatgattctcctgaccgggggagcgatgctttttctgatcagcggcaaagggatcggaaagacgtccattggcctcatctgtgtcattgcctctagcgggatgctgtggatggctgaaatccccctgcaatggattgcctccgctatcgtgctcgagttctttatgatggttcttctgattcctgagcccgaaaagcagcggaccccgcaggataatcaactggcctatgtggtgatcggaatcctcacactggcggccattatcgctgccaacgagatgggccttctggaaaccacaaaacgcgacctcggcatgagcaaggagcctggggtcgtttctcccacctcctacctggatgtggacctgcaccccgctagcgcctggacgctctatgctgtggccacaaccgtcattacacctatgcttagacataccatcgaaaattctaccgcgaacgtgagcctggccgctattgccaaccaggctgttgtgctgatgggactcgacaaaggctggccgatctccaagatggatctgggggtcccccttctggccctcggatgctactctcaggtgaatcctctgacactgacggccgcggtcctccttctgatcacccactacgctattatcggccccgggctgcaggccaaagctacacgggaggcccaaaagagaaccgccgctggaattatgaagaaccctacagtggacggcatcatgaccattgatctcgaccccgttatctatgatagcaaattcgagaagcagctgggccaggtgatgcttctggtcctctgtgccgtgcagctgctgctcatgcgcacgtcctgggcgctttgcgaagccctgacactggctaccgggcctatcaccacactctgggagggatctccgggcaaattttggaataccacaattgccgttagcatggctaacatcttccgggggtcctacctggccggagcgggccttgcctttagcattatgaagtctgtggggacgggaaaaagaggcaccggctcccaaggggaaacactgggagagaagtggaagaaaaagctcaatcagctgagccgcaaagagttcgacctgtataagaaatccggcatcaccgaggtcgatcggacagaggctaaggaagggctcaaaagaggagagattacccatcacgccgtgtctcggggcagcgctaaacttcagtggtttgtggaacgcaacatggttatccccgaggggagagtcattgacctgggatgtggccggggcgggtggtcctactattgcgccggactgaagaaagtgacggaagtgcgcggctacaccaaagggggacctggccacgaggagcccgtccctatgtctacatatgggtggaatatcgttaaactcatgagcggaaaggatgtgttctacctgcccccggaaaaatgtgacacccttctgtgcgatatcggcgagtccagcccttctcccacagtggaagagtccagaaccattcgggtcctcaagatggtggagccctggctgaagaacaatcagttctgtatcaaagttctgaacccttacatgcccacagtgattgaacatctcgagcgccttcaaagaaagcacggcgggatgctggtccggaatcctctgagccgcaactctacccatgaaatgtattggatctccaatggaacgggcaacattgtggctagcgttaatatggtgtctagactcctgcttaaccggtttacaatgacccacagacgcccgaccatcgagaaagacgtcgatctgggggccggaacacggcacgtgaacgcggaacccgagacgcctaatatggacgtgatcggcgagagaattaagcgcatcaaagaagaacacaacagcacctggcactacgacgatgaaaatccctataagacatgggcctaccatgggtcctatgaggtcaaggctaccggatctgccagctccatgattaacggcgttgtgaaactcctgacaaagccttgggacgtggtccccatggtgacccagatggctatgacagataccacgccgttcggccagcaacgggtttttaaagaaaaggtggacaccagaacacctcgcagcatgcccgggacccggagagtcatgggaatcacagccgagtggctgtggcgcaccctcggccggaataaaaagcctagactgtgcacgcgcgaggagttcacaaagaaagtgcggaccaacgccgcgatgggggctgtttttacagaggaaaatcagtgggattccgccaaggccgctgtggaggacgaagatttctggaaacttgtcgacagagagcgcgagctgcacaagctcggaaaatgtggctcttgcgtgtacaacatgatggggaagagagagaagaagctgggcgagtttggaaaggccaaaggcagccgggctatttggtatatgtggcttggggcccgctacctggagttcgaggcgctcggatttctgaatgaggatcattggttctccagagaaaactcttacagcggcgttgagggggaaggactgcacaagctcggctatatcctgcgggacatctccaaaattcccgggggcgccatgtacgctgatgacaccgccggatgggacacgagaatcaccgaggatgaccttcacaatgaagagaagattacacagcagatggatcctgagcatcggcaactggctaacgccatctttaaactcacctatcagaataaggtggtcaaggtgcagcgccccacaccgaccggcacagtcatggacattatctctagaaaagatcagcgggggagcggacaagtgggcacctacgggctgaacacgttcacaaatatggaagcgcagcttatccgccagatggagggagaaggcgttctgtccaaggccgacctcgagaaccctcatctgcccgagaagaagattacccagtggctggagaccaaaggggtggagagactcaagcggatggctatcagcggcgatgactgcgtcgtgaagcccattgatgaccgctttgccaacgctctgcttgccctgaatgatatgggaaaagtgagaaaggacatccctcaatggcagccgtctaaaggctggcatgattggcagcaggttcccttctgttcccaccacttccatgaactcattatgaaggacgggcggaaactggtggtcccttgccgcccccaagacgagcttatcggacgggctcggattagccagggcgccgggtggtctctgcgcgaaacagcgtgtctcggaaaggcctatgctcagatgtggtccctgatgtactttcacagacgggatctgcgcctcgccagcaacgccatctgctctgctgtgcctgttcattgggtgcccacctccagaacaacgtggagcatccacgcccatcaccaatggatgaccacagaggacatgctgaccgtctggaatcgggtgtggattgaagataacccttggatggaggacaagacacccgtcaccacgtgggagaatgtgccgtatcttggcaaaagagaagatcagtggtgtgggtccctgatcggcctcaccagccgcgcgacatgggctcagaacattcctaccgccatccagcaagttcggtctctgattggaaatgaggagttccttgactacatgcccagcatgaagagatttcgcaaagaggaggaatccgagggcgccatctggtga

SEQ ID NO: 20384 - RNA, 9873 nt, synthetic construct
  misc_feature 1..9873: note = derived and/or modified CDS sequence (opt5) from DENV-3__KT726351__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtcacctacaagtgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacagacaggagtgagccacaacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcatacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacacataacggcaaacgcctcgaaccgaattgggcctccgttaagaaagacctgatcagctatggcgggggatggagactttctgcgcagtggcaaaagggcgaggaagtccaggtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtacggaaatggcgttgtgacgaagaacgggggatatgtctccggcattgctcaaaccaatgccgagcctgacgggccgacacccgaactcgaggaagagatgttcaaaaagcgcaacctgaccatcatggatcttcaccctggcagcggaaaaacaagaaagtacctgcccgctattgtgcgggaagccatcaagcgcagactccggaccctgatcctcgcgcctacgagagttgtggccgctgagatggaggaagccctgaaaggccttcccattcgctatcagacaaccgctaccaagtctgagcatacagggcgggaaatcgtcgacctgatgtgccacgccacctttacaatgagactgctcagccctgtgcgcgttccgaattacaacctgattatcatggatgaggcccatttcaccgaccccgcttccattgcggcccggggatatatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccaactgtccagaaaaacctttgatacagaataccagaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatacatcttcacgggacagccccttaacaatgatgaggaccacgctcactggacagaagccaagatgctgctggacaacattaatacccctgagggcatcattcccgccctcttcgaacctgagcgggagaaatccgccgctatcgatggggaatatagactgaagggcgagagccgcaaaacctttgtggaacttatgcggagaggagacctgcccgtctggctcgcccataaggtggcttctgagggcatcaaatacacagatcgcaagtggtgcttcgacgggcagcggaacaatcagattctggaagagaacatggatgttgagatctggaccaaagaaggagagaagaagaaactgagaccgcgctggctcgacgcccggacatattccgatcctcttgccctgaaggaatttaaagacttcgctgcgggcagaaagagcattgccctggatctcgtgacggagatcgggcgcgtcccctctcacctggctcatagaacccggaatgcccttgacaacctggtgatgctccacacatccgaacacggaggccgcgcctacagacatgctgtcgaggagctgcctgaaaccatggagacactgctccttctgggcctgatgattctcctgaccgggggagccatgctttttctgatcagcggcaaagggatcggaaagacgtccattggcctcatctgtgtgattgcgtctagcgggatgctgtggatggccgaaatccccctgcaatggattgcttccgccatcgttctcgagttctttatgatggtgcttctgattcctgagcccgaaaagcagcggaccccgcaggataatcaactggcttatgtggtcatcggaatcctcacactggccgcgattatcgccgctaacgagatgggccttctggaaaccacaaaacgcgacctcggcatgagcaaggagcctggggttgtgtctcccacctcctacctggatgtggacctgcaccccgccagcgcttggacgctctatgccgtcgctacaaccgtgattacacctatgcttagacataccatcgaaaattctaccgccaacgttagcctggcggccattgctaaccaggccgtggtcctgatgggactcgacaaaggctggccgatctccaagatggatctgggggtgccccttctggctctcggatgctactctcaggtcaatcctctgacactgacggccgccgtgctccttctgatcacccactacgcgattatcggccccgggctgcaggctaaagccacacgggaggctcaaaagagaaccgccgccggaattatgaagaaccctacagttgacggcatcatgaccattgatctcgaccccgtgatctatgatagcaaattcgagaagcagctgggccaggtcatgcttctggtgctctgtgctgttcagctgctgctcatgcgcacgtcctgggccctttgcgaagcgctgacactggccaccgggcctatcaccacactctgggagggatctccgggcaaattttggaataccacaattgctgtgagcatggccaacatcttccgggggtcctacctggctggagccggccttgcgtttagcattatgaagtctgtcgggacgggaaaaagaggcaccggctcccaaggggaaacactgggagagaagtggaagaaaaagctcaatcagctgagccgcaaagagttcgacctgtataagaaatccggcatcaccgaggtggatcggacagaggccaaggaagggctcaaaagaggagagattacccatcacgctgtgtctcggggcagcgccaaacttcagtggtttgttgaacgcaacatggtcatccccgaggggagagtgattgacctgggatgtggccggggcgggtggtcctactattgcgctggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatatcggcgagtccagcccttctcccacagtcgaagagtccagaaccattcgggtgctcaagatggttgagccctggctgaagaacaatcagttctgtatcaaagtgctgaacccttacatgcccacagtcattgaacatctcgagcgccttcaaagaaagcacggcgggatgctggtgcggaatcctctgagccgcaactctacccatgaaatgtattggatctccaatggaacgggcaacattgttgccagcgtgaatatggtctctagactcctgcttaaccggtttacaatgacccacagacgcccgaccatcgagaaagacgtggatctgggggctggaacacggcacgtgaacgccgaacccgagacgcctaatatggacgtcatcggcgagagaattaagcgcatcaaagaagaacacaacagcacctggcactacgacgatgaaaatccctataagacatgggcgtaccatgggtcctatgaggttaaggccaccggatctgctagctccatgattaacggcgtggtgaaactcctgacaaagccttgggacgtcgtgcccatggttacccagatggccatgacagataccacgccgttcggccagcaacgggtgtttaaagaaaaggtcgacaccagaacacctcgcagcatgcccgggacccggaaagtgatgggaatcacagctgagtggctgtggagaaccctcggccgcaataagaagcctcggctgtgcacgagagaggagttcaccaagaaggttcgcaccaacgccgccatgggggcggtgtttacagaggaaaatcagtgggattccgctaaagccgccgtcgaggacgaagatttctggaaacttgtggaccgggagagagagctgcacaaactcggaaagtgtggctcttgcgtttacaacatgatggggaaacgcgaaaagaagctgggcgagtttggaaaagctaagggcagcagagccatttggtatatgtggcttggggctcggtacctggagttcgaggccctcggatttctgaatgaggatcattggttctcccgcgaaaactcttacagcggcgtggagggggaaggactgcacaaactcggctatatcctgagagacatctccaagattcccgggggcgcgatgtacgccgatgacaccgctggatgggacacgcggatcaccgaggatgaccttcacaatgaagagaaaattacacagcagatggatcctgagcatagacaactggccaacgctatctttaagctcacctatcagaataaggtcgtgaaagtccagcggcccacaccgaccggcacagtgatggacattatctctcgcaaggatcagagagggagcggacaagttggcacctacgggctgaacacgttcacaaatatggaagcccagcttatccggcagatggagggagaaggcgtgctgtccaaagcggacctcgagaaccctcatctgcccgaaaagaaaattacccagtggctggagaccaagggggtcgagcgcctcaagagaatggccatcagcggcgatgactgcgtggtgaaacccattgatgaccggtttgctaacgccctgcttgctctgaatgatatgggaaaggttcgcaaagacatccctcaatggcagccgtctaagggctggcatgattggcaacaggtgcccttctgttcccaccacttccatgaactcattatgaaagacgggagaaagctggtcgtgccttgccggccccaagacgagcttatcggacgcgccagaattagccagggcgctgggtggtctctgcgggaaacagcctgtctcggaaaggcgtatgcccagatgtggtccctgatgtactttcaccgcagagatctgcggctcgctagcaacgccatctgctctgccgttcctgtgcattgggtccccacctcccgcacaacgtggagcatccacgctcatcaccaatggatgaccacagaggacatgctgaccgtgtggaatagagtctggattgaagataacccttggatggaggacaaaacacccgtgaccacgtgggagaatgttccgtatcttggcaagcgggaagatcagtggtgtgggtccctgatcggcctcaccagcagagccacatgggcgcagaacattcctaccgctatccagcaagtgcgctctctgattggaaatgaggagttccttgactacatgcccagcatgaaacggtttagaaaggaggaggaatccgagggcgccatctggtga

SEQ ID NO: 20385 - RNA, 9873 nt, synthetic construct
  misc_feature 1..9873: note = derived and/or modified CDS sequence (opt5) from DENV-3__KT726360__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggagatgtgcgacgatacagtcacctacaagtgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacagacaggagtgagccacaacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcatacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacacataacggcaaacgcctcgaaccgaattgggcctccgttaagaaagacctgatcagctatggcgggggatggagactttctgcgcagtggcaaaagggcgaggaagtccaggtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtacggaaatggcgttgtgacgaagaacgggggatatgtctccggcattgctcaaaccaatgccgagcctgacgggccgacacccgaactcgaggaagagatgttcaaaaagcgcaacctgaccatcatggatcttcaccctggcagcggaaaaacaagaaagtacctgcccgctattgtgcgggaagccatcaagcgcagactccggaccctgatcctcgcgcctacgagagttgtggccgctgagatggaggaagccctgaaaggccttcccattcgctatcagacaaccgctaccaagtctgagcatacagggcgggaaatcgtcgacctgatgtgccacgccacctttacaatgagactgctcagccctgtgcgcgttccgaattacaacctgattatcatggatgaggcccatttcaccgaccccgcttccattgcggcccggggatatatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccaactgtccagaaaaacctttgatacagaataccagaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatacatcttcacgggacagccccttaacaatgatgaggaccacgctcactggacagaagccaagatgctgctggacaacattaatacccctgagggcatcattcccgccctcttcgaacctgagcgggagaaatccgccgctatcgatggggaatatagactgaagggcgagagccgcaaaacctttgtggaacttatgcggagaggagacctgcccgtctggctcgcccataaggtggcttctgagggcatcaaatacacagatcgcaagtggtgcttcgacgggcagcggaacaatcagattctggaagagaacatggatgttgagatctggaccaaagaaggagagaagaagaaactgagaccgcgctggctcgacgcccggacatattccgatcctcttgccctgaaggaatttaaagacttcgctgcgggcagaaagagcattgccctggatctcgtgacggagatcgggcgcgtcccctctcacctggctcatagaacccggaatgcccttgacaacctggtgatgctccacacatccgaacacggaggccgcgcctacagacatgctgtcgaggagctgcctgaaaccatggagacactgctccttctgggcctgatgattctcctgaccgggggagccatgctttttctgatcagcggcaaagggatcggaaagacgtccattggcctcatctgtgtgattgcgtctagcgggatgctgtggatggccgaaatccccctgcaatggattgcttccgccatcgttctcgagttctttatgatggtgcttctgattcctgagcccgaaaagcagcggaccccgcaggataatcaactggcttatgtggtcatcggaatcctcacactggccgcgattatcgccgctaacgagatgggccttctggaaaccacaaaacgcgacctcggcatgagcaaggatcctggggttgtgtctcccacctcctacctggacgtggacctgcaccccgccagcgcttggacgctctatgccgtcgctacaaccgtgattacacctatgcttagacataccatcgaaaattctaccgccaacgttagcctggcggccattgctaaccaggccgtggtcctgatgggactcgataaaggctggccgatctccaagatggacctgggggtgccccttctggctctcggatgctactctcaggtcaatcctctgacactgacggccgccgtgctccttctgatcacccactacgcgattatcggccccgggctgcaggctaaagccacacgggaagctcaaaagagaaccgccgccggaattatgaagaaccctacagttgatggcatcatgaccattgacctcgatcccgtgatctatgacagcaaattcgagaagcagctgggccaggtcatgcttctggtgctctgtgctgttcagctgctgctcatgcgcacgtcctgggccctttgcgaggcgctgacactggccaccgggcctatcaccacactctgggaaggatctccgggcaaattttggaataccacaattgctgtgagcatggccaacatcttccgggggtcctacctggctggagccggccttgcgtttagcattatgaagtctgtcgggacgggaaaaagaggcaccggctcccaaggggagacactgggagaaaagtggaagaaaaagctcaatcagctgagccgcaaagagttcgatctgtataagaaatccggcatcaccgaagtggaccggacagaggccaaggaggggctcaaaagaggagaaattacccatcacgctgtgtctcggggcagcgccaaacttcagtggtttgttgagcgcaacatggtcatccccgaagggagagtgattgatctgggatgtggccggggcgggtggtcctactattgcgctggactgaagaaagtgacggaggtccgcggctacaccaaagggggacctggccacgaggagcccgttcctatgtctacatatgggtggaatatcgtgaaactcatgagcggaaaggacgtgttctacctgcccccggagaaatgtgatacccttctgtgcgacatcggcgaatccagcccttctcccacagtcgaggaatccagaaccattcgggtgctcaagatggttgagccctggctgaagaacaatcagttctgtatcaaagtgctgaacccttacatgcccacagtcattgagcatctcgaacgccttcaaagaaagcacggcgggatgctggtgcggaatcctctgagccgcaactctacccatgagatgtattggatctccaatggaacgggcaacattgttgccagcgtgaatatggtctctagactcctgcttaaccggtttacaatgacccacagacgcccgaccatcgaaaaagatgtggacctgggggctggaacacggcacgtgaacgccgagcccgaaacgcctaatatggacgtcatcggcgagagaattaagcgcatcaaagaggaacataacagcacctggcactacgatgacgagaatccctataagacatgggcgtaccatgggtcctatgaagttaaggccaccggatctgctagctccatgattaacggcgtggtgaaactcctgacaaagccttgggatgtcgtgcccatggttacccagatggccatgacagacaccacgccgttcggccagcaacgggtgtttaaagagaaggtcgataccagaacacctcgcagcatgcccgggacccggagagtgatgggaatcacagctgaatggctgtggcgcaccctcggccggaataaaaagcctagactgtgcacgcgcgaggagttcacaaagaaagttcggaccaacgccgccatgggggcggtgtttacagaagagaatcagtgggactccgctaaggccgccgtcgaagatgaggacttctggaaacttgtggatagagaacgcgagctgcacaagctcggaaaatgtggctcttgcgtttacaacatgatggggaagagagagaaaaagctgggcgaatttggaaaggctaaaggcagccgggccatttggtatatgtggcttggggctcgctacctggagttcgaagccctcggatttctgaatgaggaccattggttctccagagagaactcttacagcggcgtggaaggggagggactgcacaagctcggctatatcctgcgggatatctccaaaattcccgggggcgcgatgtacgccgacgacaccgctggatgggatacgagaatcaccgaagacgatcttcacaatgaggaaaagattacacagcagatggaccctgagcatcggcaactggccaacgctatctttaaactcacctatcagaataaggtcgtgaaggtccagcgccccacaccgaccggcacagtgatggatattatctctagaaaagaccagcgggggagcggacaagttggcacctacgggctgaacacgttcacaaatatggaggcccagcttatccgccagatggaaggagagggcgtgctgtccaaggcggatctcgaaaaccctcatctgcccgagaaaaagattacccagtggctggaaaccaaaggggtcgagagactcaagcggatggccatcagcggcgacgattgcgtggtgaagcccattgacgatcgctttgctaacgccctgcttgctctgaatgacatgggaaaagttagaaaggatatccctcaatggcagccgtctaaaggctggcatgactggcaacaggtgcccttctgttcccaccacttccatgagctcattatgaaggacgggcggaaactggtcgtgccttgccgcccccaagatgaacttatcggacgggcccggattagccagggcgctgggtggtctctgcgcgagacagcctgtctcggaaaggcgtatgcccagatgtggtccctgatgtactttcacagacgggacctgcgcctcgctagcaacgccatctgctctgccgttcctgtgcattgggtccccacctccagaacaacgtggagcatccacgctcatcaccaatggatgaccacagaagatatgctgaccgtgtggaatcgggtctggattgaggacaacccttggatggaagataagacacccgtgaccacgtgggagaatgttccgtatcttggcaaaagagaggaccagtggtgtgggtccctgatcggcctcaccagccgcgccacatgggcgcagaacattcctaccgctatccagcaagtgcggtctctgattggaaatgaagagttccttgattacatgcccagcatgaagagatttcgcaaagaagaggagtccgaaggcgccatctggtga

SEQ ID NO: 20386 - RNA, 9873 nt, synthetic construct
  misc_feature 1..9873: note = derived and/or modified CDS sequence (opt5) from DENV-3__KF041259__SS-prME
  source 1..9873: mol_type = other RNA
acaagcctgtgcctcatgatgatcctgcccgcggctcttgccttccacctgacgtcccgggacggagaacctcggatgattgtggggaagaatgaacgcggaaagtctctcctgtttaagacggcgagcggcatcaatatgtgtacccttattgctatggatctgggggagatgtgcgacgatacagtgacctacaagtgtccgcatatcaacgaagttgagcccgaagacattgattgctggtgtaatctcacatccacctgggtgacatatggaacctgcaaccaggccggcgagcaccggcgggacaagcgctctgtggccctggctcctcatgtcgggatgggactggatacgcggacccaaacatggatgagcgccgagggcgcttggagacaggtggaaaaggttgagacctgggccctccgccaccccggcttcacaatcctggcgctttttctggcccattacatcgggacctccctcacgcagaaggtggtcattttcatcctgcttatgctggtgacaccttctatgaccatgagatgtgttggagtgggcaatcgggactttgtcgaagggctcagcggagctacatgggtggatgtggtcctggagcacggcgggtgcgttaccaccatggccaagaacaaacccacactggacattgagctccagaagacggaagctacccaactggccacacttcgcaaactgtgtatcgagggaaagattaccaatatcacaaccgattccagatgccctacgcagggcgaagcggtgctcccggaggaacaggaccagaactatgtgtgtaaacacacatacgtcgatcggggctgggggaatggatgcggcctgttcgggaagggaagccttgtgacctgcgccaagtttcaatgtctggagcccattgagggcaaagttgtgcagtatgaaaacctcaagtacaccgtcatcatcacagtgcataccggggaccagcaccaggttggaaatgagacacaaggcgtgacggctgaaattacccctcaggcctctacaaccgaggctatcctgcccgaatatggcacactggggctcgagtgctcccctcgcaccggactggacttcaacgagatgattcttctgacgatgaaaaataaggcctggatggtccatagacagtggtttttcgatctccccctgccgtggaccagcggcgccacaaccgaaacacctacctggaaccggaaagagcttctggtgacgtttaagaatgctcacgcgaaaaagcaagaagtcgtggttctcgggtctcaggagggagccatgcacacagctctgaccggcgccacagaaatccagaactccgggggcaccagcattttcgccggacatctgaagtgtcgcctcaaaatggacaagctggagcttaaaggcatgtcttacgctatgtgcaccaacacatttgtgctgaagaaagaggtctccgaaacgcagcacgggaccatcctcatcaaggtggagtacaagggagaagatgccccctgtaaaattcctttcagcacagaggacggccaagggaaggcgcataatggaagactgatcaccgctaaccccgttgtgaccaagaaggaggaacccgtcaatattgaggccgaacctccgttcggcgagtccaacatcgtgattgggatcggcgataatgccctgaaaatcaactggtataagaagggatctagcattggcaaaatgtttgaagctaccgccagaggggctagacgcatggccatccttggagacacggcgtgggatttcggctccgtcgggggagttctcaatagcctgggcaagatggtccaccagatttttgggtctgcctacacagctctgttctccggcgtgagctgggtgatgaaaatcggaattggcgtcctcctgacctggatcgggcttaactctaagaataccagcatgtccttttcttgcattgccatcggaatcattacactgtatctcggcgctgtggttcaggccgacatggggtgtgtgatcaactggaaaggaaaggagctgaagtgcggcagcgggattttcgtcaccaatgaggtgcatacatggacggaacagtacaaatttcaagcggattcccccaagcggctggccaccgctatcgccggcgcttgggagaacggagtttgtggcattagaagcacaacccgcatggaaaatcttctctggaaacagatcgccaacgagctgaattatatcctgtgggaaaacaacattaagctcacagtggtcgtgggggacaccatcggagttctggagcagggcaaacggacgcttacccctcagcccatggagctgaagtactcttggaaaacatgggggaaggccaagattgtgaccgctgaaacacaaaattccagcttcatcattgatggacctaacacccccgagtgcccgtctgcgtccagagcctggaatgtctgggaagtggaggactatggctttggcgtgttcacaaccaacatctggctcaaactgcgcgaagtctacacgcagatgtgtgaccaccggctgatgagcgctgccgttaaggatgagagagccgtgcacgctgacatggggtactggatcgagtcccagaaaaatggatcttggaaacttgaaaaagccagcctcattgaggtgaagacatgcacctggcctaagtcccataccctgtggtctaacggcgtcctggaaagcgatatgatcattcccaaatccctcgcggggcctatcagccagcacaattatcgccccggataccatacacaaaccgctggcccttggcacctggggcggcttgagctggactttaactattgcgagggaacgacagtggttattaccgaaaattgtggcacaagaggcccctctctccgcaccacaaccgtgtccgggaagctgatccacgagtggtgctgtcggagctgcacgctgccgcctcttagatacatgggagaagatggctgttggtatgggatggagatccggcccatttctgaaaaagaggagaacatggtcaagtccctcgtgagcgccggatctggcaaagttgacaatttcaccatgggggtgctgtgcctggccatcctctttgaagaggtcatgcgcggaaagttcggcaagaaacatatgattgctggcgtgttctttacattcgttctgcttctgagcgggcagatcacctggagagatatggcccacacactcattatgatcggatccaacgcgagcgaccggatgggcatgggggtgacctacctggctctgattgccacgtttaagatccagcccttccttgccctgggatttttcctcagaaaactgacatctcgcgaaaatctcctgcttggcgtcgggctggctatggccaccacactccaactgcctgaggatatcgaacagatggctaacggaattgccctgggccttatggcgctgaagctcatcacccagtttgagacctatcagctgtggacagccctcatttccctgacgtgtagcaataccatcttcacacttaccgtggcttggcggacagccaccctgattctcgctggcgtgtccctgctgccggtctgccaatctagctccatgagaaaaacggactggcttcccatgacagttgccgccatgggggtgcctcccctgcctctctttatcttctctctgaaggataccctcaagcgcagaagctggcccctgaacgagggagtgatggctgtcggccttgtgtccatcctggcgtctagcctgctccggaacgacgttcctatggccgggcccctggtggctggaggccttctgattgcctgttacgtcatcaccgggacatccgccgatctcaccgtggaaaaagctgccgacgttacatgggaggaagaggcggaacagacgggagtgagccataatctgatgattaccgtcgacgatgacggcacaatgcgcatcaaggatgacgagaccgagaacattctcacagtgctgcttaaaaccgctctgctgatcgtctctggcatctttccgtactccattcctgccacgctcctggtgtggcacacctggcagaagcagacacaaagaagcggggttctttgggatgtgccctctcctcccgaaacccagaaagccgagctggaagagggagtctatcggatcaagcagcagggcattctcgggaaaacacaagtgggagttggcgtgcagaaggagggggtcttccataccatgtggcacgtgacacgcggagctgtgctgacgcacaatggcaagagactcgaaccgaactgggcctccgttaaaaaggacctgatcagctacggcgggggatggcggctttctgcgcagtggcaaaaaggcgaggaagtccaggtgattgctgtggagcctgggaagaatcccaaaaactttcagaccatgcctggaacattccagaccaccacaggcgaaatcggggccattgccctggatttcaagcccggaacgtccggcagccccatcatcaatcgcgagggcaaggtcgtggggctgtatggaaacggcgttgtgaccaaaaatgggggatacgtctccggcattgctcaaacaaacgccgagcctgacgggccgacccccgaactcgaggaagagatgtttaagaaaagaaatctgacaatcatggatcttcatcctggcagcggaaagacccggaaatatctgcccgctattgtgcgcgaagccatcaagagacggctcagaacgctgattctcgcgcctacacgcgttgtggccgctgagatggaggaagccctgaagggccttcccatccggtaccagaccaccgctacaaaatctgagcacaccgggagagaaatcgtcgacctgatgtgccatgccacattcaccatgcgcctgctcagccctgtgcgggttccgaactataatctgattatcatggatgaggcccactttacggaccccgcttccattgcggccagaggatacatctctacacgcgtgggcatgggggaagctgccgccattttcatgaccgctacacctcccggaaccgccgatgcgtttcctcagagcaacgctcccatccaggacgaggagcgggacatcccggaaagatcctggaactctggcaacgagtggattacggatttcgccgggaagaccgtctggtttgtgcctagcatcaaagccggcaacgacattgctaattgtcttcgcaagaacggcaaaaaggtgatccaactgtcccggaagacattcgataccgaataccagaaaacaaagctcaatgactgggattttgtcgttaccacagacatttctgagatgggagccaacttcaaagcggatagagtgatcgacccccggcgctgcctgaagcccgtgattctgaccgatgggcctgagagagtcatcctcgccggacccatgcctgtgacggctgccagcgctgcccagcggcgcggcagagttgggcggaatccgcagaaagaaaacgaccaatatatctttacaggacagccccttaataacgatgaggaccatgctcactggaccgaagccaagatgctgctggacaatattaacacccctgagggcatcattcccgccctcttcgaacctgagagagagaagtccgccgctatcgatggggaataccgcctgaaaggcgagagccggaagacattcgtggaacttatgagacgcggagacctgcccgtctggctcgcccacaaagtggcttctgagggcattaagtataccgatcggaaatggtgctttgacgggcagagaaataaccagatcctggaagagaatatggatgttgagatctggacaaaggaaggagagaaacgcaagctgcggccgagatggctcgacgcccgcacgtactccgatcctcttgccctgaaggagttcaaagactttgctgcgggcagaaagagcattgccctggatctcgtgaccgagatcgggcgggtcccctctcatctggctcaccgcacaagaaacgcccttgacaatctggtgatgctccatacctccgaacacggaggccgggcctatcgccacgctgtcgaggagctgcctgaaacaatggagaccctgctccttctgggcctgatgattctcctgacagggggagccatgcttttcctgatcagcggcaaagggattggaaagacctccatcggcctcatctgtgtgattgcgtctagcgggatgctgtggatggccgaaatccccctgcaatggattgcttccgccatcgttctcgagtttttcatgatggtgcttctgattcctgagcccgaaaaacagagaacaccgcaggataaccaactggcttacgtggtcatcggcattctcaccctggccgcgatcatcgccgctaatgagatgggccttctggaaacaaccaagcgggacctcggcatgagcaaggagcctggggttgtgtctcccacgtcctatctggatgtggacctgcatcccgccagcgcttggacactctacgccgtcgctaccacagtgattacccctatgcttagacacaccatcgaaaactctacagccaacgttagcctggcggccattgctaatcaggccgtggtcctgatgggactcgacaaaggctggccgatctccaagatggatctgggggtgccccttctggctctcggatgctactctcaggtcaaccctctgacgctgaccgccgccgtgctccttctgattacacattatgcgatcatcggccccgggctgcaggctaaagccacccgcgaggctcaaaagcggacagccgccggaattatgaaaaatcctaccgttgacggcatcattacgatcgatctcgaccccgtgatttacgatagcaagtttgagaagcagctgggccaggtcatgcttctggtgctctgtgctgttcagctgctgctcatgagaacatcctgggccctttgcgaagcgctgaccctggccaccgggcctatcacaaccctctgggagggatctccgggcaaattctggaacacaacgatcgctgtgagcatggccaatatttttcgcgggtcctatctggctggagccggccttgcgttcagcatcatgaagtctgtcgggaccggaaaacggggcacaggctcccaaggggaaaccctgggagagaagtggaaaaagaagctcaaccagctgagcagaaaagaatttgacctgtacaagaaatccggcattacagaggtggatcggaccgaggccaaggaagggctcaaacgcggagagacgacccaccatgctgtgtctagaggcagcgccaaacttcagtggttcgttgaacggaatatggtcatccccgaggggcgcgtgattgacctgggatgtggcagaggcgggtggtcctattactgcgctggactgaaaaaggtgacagaagtccggggctataccaaagggggacctggccacgaggagcccgttcctatgtctacatacgggtggaacatcgtgaaactcatgagcggaaaggatgtgttttacctgcccccggaaaaatgtgacacccttctgtgcgatattggcgagtccagcccttctcccacagtcgaagagtcccgcaccatcagagtgctcaagatggttgagccctggctgaaaaataaccagttctgtatcaaggtgctgaatccttatatgcccgccgtcattgaacacctcgagcggcttcaacgcaagcatggcgggatgctggtgagaaaccctctgagcagaaattctacgcacgaaatgtactggatctccaacggaacaggcaatattgttagctctgtgaacatggtcagcagactcctgcttaaccgcttcaaaatgacccatcggagaccgaccatcgagaaggacgtggatctgggggctggaacacgccacgtgaatgccgaacccgagacgcctaacatggacgtcattggcgagcggatcaaaagaatcaaggaagaacacaattccacctggcattatgacgatgaaaacccctacaaaacatgggcgtatcacgggtcttacgaggttaaggccaccggaagcgcttccagcatgattaatggcgtggtgaagctcctgacaaaaccttgggacgtcgtgcccatggttacccagatggccatgacagataccacgccgtttggccagcaacgcgtgttcaaggaaaaagtcgacacccggacacctagacccatgcctgggacccgcaaggtgatggagatcacagctgagtggctgtggcggaccctcggaagaaacaaacgcccccggctgtgcacgagagaagagtttacaaagaaggttcgcaccaatgccgccatgggcgcggtgttcacagaagagaaccagtgggattccgctaaagccgccgtcgaagacgaggagttttggaaacttgtggatagagaacgggagctgcataaactcgggaagtgtggatcttgcgtttataatatgatgggcaaacgcgaaaagaaactgggggagttcggcaaggctaagggaagcagagccatttggtacatgtggcttggcgctcggtacctggagtttgaagccctcgggttcctgaacgaggaccactggttttccagagaaaattcttatagcggagtggagggcgaagggctgcataaactcggatacatcctgcgggatatttccaagatccctggcggggcgatgtatgccgacgataccgctggctgggacacgcgcatcaccgaggacgatcttcacaacgaggagaagattacacagcagatggaccccgagcacagactgctcgccaatgctatcttcaagctgacctaccaaaacaaagtcgtgaaggtccagcggccgacacctaccggaacagtgatggatattatctctcgcaaggaccagagaggcagcgggcaggttggaacctatggccttaatacgtttacaaacatggaagcccaactggtgcggcagatggagggggaaggagtcctctccaaagcggatctggagaacccccatctgcccgagaagaaaattacccagtggctcgaaaccaagggcgtggagcgcctgaaaagaatggccatcagcggggacgattgcgtggttaagcctatcgacgatcggttcgctaatgcccttctggctctcaacgacatgggcaaggtgcgcaaagatattccgcagtggcaaccctctaagggatggcacgactggcagcaggtccctttttgttcccatcacttccacgaactgatcatgaaagatggcagaaaacttgtggttccctgccggcctcaggacgagctgattgggcgcgccagaatcagccaaggagctggctggtctctccgggaaacagcctgtctggggaaagcgtacgcccagatgtggtccctgatgtatttccatcgcagagacctccggctggctagcaatgccatttgctctgccgtgcccgtccactgggtgcctacctccagaacaacgtggagcatccatgctcaccatcagtggatgaccacagaggatatgcttaccgtctggaaccgcgtgtggattgaggacaatccctggatggaagataagacaccggttaccacgtgggagaacgtgccttacctgggaaagcgggaagaccaatggtgtggctccctcatcgggctgaccagcagagccacatgggcgcagaatatccccaccgctattcagcaggtccgctctcttatcggcaacgaggagtttctggattacatgcctagcatgaaacggttcagaaaggaagaggaactcgagggagccatttggtga

SEQ ID NO: 20387 - RNA, 9873 nt, synthetic construct
  misc_feature 1..9873: note = derived and/or modified CDS sequence (opt5) from DENV-3__KF041258__SS-prME
  source 1..9873: mol_type = other RNA
accagcctgtgcctcatgatgatcctgcccgcggctcttgccttccacctgacatcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcggcggggttctcaacagcctggggaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacacgatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgaagtctacacacagatgtgtgaccaccggctgatgagcgctgccgttaaggatgagagagccgtgcacgctgacatggggtactggatcgagtcccagaaaaacggatcttggaaacttgaaaaagccagcctcattgaggtgaagacctgcacctggcctaagtcccatacactgtggtctaatggcgtcctggaaagcgatatgatcattcccaaatccctcgcggggcctatcagccagcacaactatcgccccggataccatacccaaacggctggcccttggcacctggggaaacttgagctggactttaattattgcgagggaacaaccgtggttattacagaaaactgtggcacccggggcccctctctcagaacaaccacggtgtccgggaaactgatccacgagtggtgctgtcgcagctgcaccctgccgcctcttcggtacatgggagaagatggctgttggtatgggatggagatcagacccatttctgaaaaggaggagaatatggtcaaatccctcgtgagcgccggatctggcaaggttgacaacttcacaatgggggtgctgtgcctggccatcctctttgaagaggtcatgcggggaaagttcggcaaaaagcatatgattgctggcgtgttctttaccttcgttctgcttctgagcgggcagatcacatggcgcgatatggcccacaccctcattatgatcggatccaatgcgagcgacagaatgggcatgggggtgacgtacctggctctgattgccacatttaaaatccagcccttccttgccctgggatttttcctccggaagctgacctctagagaaaacctcctgcttggcgtcgggctggctatggccacaaccctccaactgcctgaggatatcgaacagatggctaatggaattgccctgggccttatggcgctgaaactcatgacccagtttgagacatatcagctgtggacggccctcatctccctgacctgtagcaacacaattttcacccttacagtggcttggcgcaccgccacgctgatcctcgctggcgtgtccctgctgccggtctgccaatctagctccatgcggaagacagactggcttcccatgaccgttgccgccatgggggtgcctcccctgcctctctttattttctctctgaaggataccctcaaaagacgcagctggcccctgaatgagggagtgatggctgtcggccttgtgtccatcctggcgtctagcctgctcagaaacgacgttcctatggccgggcccctggtggctggaggccttctgatcgcctgttacgtcattacagggacctccgccgatctcacagtggaaaaggctgccgacgttacgtgggaggaagaggcggaacagaccggagtgagccataacctgatgatcacagtcgacgatgacggcaccatgcggattaaagatgacgagacagagaatatcctcaccgtgctgcttaagacggctctgctgattgtctctggcatctttccgtactccatccctgccaccctcctggtgtggcacacatggcagaaacagacccaacgcagcggggttctttgggatgtgccctctcctcccgaaacacagaaggccgagctggaagagggagtctatagaattaaacagcagggcatcctcgggaagacccaagtgggagttggcgtgcagaaggagggggtcttccatacaatgtggcacgtgacgcggggagctgtgctgacccacaacggcaaacgcctcgaaccgaattgggcctccgttaagaaagacctgattagctacggcgggggatggagactttctgcgcagtggcaaaagggcgaggaagtccaggtgatcgctgtggagcctgggaaaaaccccaagaattttcagacaatgcctggaaccttccagaccacaacgggcgaaattggggccatcgccctggatttcaagcccggaacctccggcagccccattatcaaccgggagggcaaagtcgtggggctgtatggaaatggcgttgtgacaaagaacgggggatacgtctccggcatcgctcaaaccaatgccgagcctgacgggccgacacccgaactcgaggaagagatgtttaaaaagcgcaacctgaccattatggatcttcatcctggcagcggaaaaacgagaaagtatctgcccgctatcgtgcgggaagccattaagcgcagactccggacactgatcctcgcgcctaccagagttgtggccgctgagatggaggaagccctgaaaggccttcccattcgctaccagaccacagctaccaagtctgagcacacagggcgggaaatcgtcgacctgatgtgccatgccaccttcacgatgagactgctcagccctgtgcgcgttccgaattataacctgatcattatggatgaggcccactttacagaccccgcttccatcgcggcccggggatacatttctaccagagtgggcatgggggaagctgccgccatcttcatgacagctacccctcccggaacggccgatgcgtttcctcagagcaatgctcccattcaggacgaggagcgcgacatcccggaacggtcctggaactctggcaatgagtggatcaccgatttcgccgggaaaacagtctggtttgtgcctagcattaaggccggcaacgacatcgctaactgtcttcgcaaaaatggaaagaaggtgattcaactgtccagaaaaaccttcgatacagaataccagaagaccaaactcaacgactgggattttgtcgttacaaccgacatctctgagatgggcgccaatttcaaggcggatcgggtgattgaccccagacggtgcctgaaacccgtgatcctgacggatgggcctgagcgcgtcattctcgccggacccatgcctgtgacagctgccagcgctgcccagagacggggccgcgttgggagaaacccgcagaaggaaaatgaccaatatatctttaccggacagccccttaacaatgatgaggaccatgctcactggaccgaagccaagatgctgctggacaacatcaatacacctgagggcattatccccgccctcttcgaacctgagcgggagaaatccgccgctattgatggggaatacagactgaagggcgagagccgcaaaaccttcgtggaacttatgcggagaggagacctgcccgtctggctcgcccacaaggtggcttctgagggcatcaaatatacagatcgcaagtggtgctttgacgggcagcggaacaatcagattctggaagagaacatggatgttgagatctggacgaaagaaggagagaagagaaagctgcgcccgcggtggctcgacgccagaacctactccgatcctcttgccctgaaagagttcaaggactttgctgcgggccgcaaaagcatcgccctggatctcgtgacagagattgggagagtcccctctcatctggctcaccggacccgcaatgcccttgacaacctggtgatgctccatacatccgaacacggaggcagagcctatcggcacgctgtcgaggagctgcctgaaaccatggagacgctgctccttctgggcctgatgatcctcctgaccgggggagccatgcttttcctgattagcggcaaggggatcggaaaaacatccattggcctcatctgtgtgatcgcgtctagcgggatgctgtggatggccgaaattcccctgcaatggatcgcttccgccattgttctcgagtttttcatgatggtgcttctgatccctgagcccgaaaagcagcgcaccccgcaggataatcaactggcttacgtggtcattggaatcctcacactggccgcgattatcgccgctaacgagatgggccttctggaaaccacgaagagagacctcggcatgagcaaagagcctggggttgtgtctcccacatcctatctggatgtggacctgcatcccgccagcgcttggaccctctacgccgtcgctacaaccgtgatcacccctatgcttcggcacacaattgaaaattctacggccaacgttagcctggcggccatcgctaaccaggccgtggtcctgatgggactcgacaagggctggccgatttccaaaatggatctgggggtgccccttctggctctcggatgctactctcaggtcaatcctctgaccctgacagccgccgtgctccttctgatcacccattatgcgattatcggccccgggctgcaggctaaggccacaagagaggctcaaaaacgcaccgccgccggaatcatgaagaaccctacggttgacggcattatcacaattgatctcgaccccgtgatctacgatagcaagtttgagaaacagctgggccaggtcatgcttctggtgctctgtgctgttcagctgctgctcatgcggacctcctgggccctttgcgaagcgctgaccctggccacagggcctattaccacactctgggagggatctccgggcaagttctggaatacgaccatcgctgtgagcatggccaacatctttagagggtcctatctggctggagccggccttgcgttcagcattatgaaatctgtcgggacaggaaagcgcggcaccggctcccaaggggaaacactgggagagaaatggaagaagaaactcaatcagctgagccggaaggaatttgacctgtacaaaaagtccggcatcaccgaggtggatagaacggaggccaaagaagggctcaagcggggagagaccacacaccatgctgtgtctcgcggcagcgccaaacttcagtggttcgttgaaagaaacatggtcattcccgaggggcgggtgatcgacctgggatgtggccgcggcgggtggtcctattactgcgctggactgaagaaggtgaccgaagtcagaggctatacaaaagggggacctggccacgaggagcccgttcctatgtctacctacgggtggaatattgtgaagctcatgagcggaaaagatgtgttttacctgcccccggaaaagtgtgacacacttctgtgcgatatcggcgagtccagcccttctcccaccgtcgaagagtcccggacgattcgcgtgctcaaaatggttgagccctggctgaagaacaatcagttctgtatcaaggtgctgaacccttatatgcccgccgtcatcgaacacctcgagagacttcaacggaaacatggcgggatgctggtgcgcaatcctctgagcagaaactctacacacgaaatgtactggatttccaatggaaccggcaacatcgttagctctgtgaatatggtcagccggctcctgcttaacagattcaccatgacacatcgccggccgacgattgagaaggacgtggatctgggggctggaaccagacacgtgaacgccgaacccgagacacctaatatggacgtcatcggcgagcgcattaaacggatcaaggaagaacacaactccacctggcattatgacgatgaaaatccctacaaaacatgggcgtatcacgggtcttacgaggttaaggccaccggaagcgcttccagcatgatcaacggcgtggtgaagctcctgacaaaaccttgggacgtcgtgcccatggttacccagatggccatgacggataccacaccgtttggccagcaaagagtgttcaaggaaaaagtcgacacccgcacacctcggcccatgcctgggaccagaaaggtgatggagattacggctgagtggctgtggcgcacactcggacggaataaaagaccccgcctgtgcacccgggaagagtttacaaagaaggttagaaccaacgccgccatgggcgcggtgttcacggaagagaatcagtgggattccgctaaagccgccgtcgaagacgaggagttttggaaacttgtggatcgcgaaagagagctgcataaactcgggaagtgtggatcttgcgtttataacatgatgggcaaacgggaaaagaaactgggggagttcggcaaggctaagggaagccgcgccatctggtacatgtggcttggcgctagatacctggagtttgaagccctcgggttcctgaatgaggaccactggttttcccgggaaaactcttatagcggagtggagggcgaagggctgcataaactcggatacgtcctgagagatatttccaagatccctggcggggcgatgtatgccgacgataccgctggctgggacacacggattaccgaggacgatcttcacaatgaggagaagatcacacagcagatggaccccgagcaccgcctgctcgccaacgctatcttcaagctgacctaccaaaataaagtggtcaaggtgcagagaccgacacctaccggaacggttatggatattatctctcggaaggaccagcgcggcagcggacaggtgggaacatatggccttaacacctttaccaatatggaagcccaactggtcagacagatggagggggaaggagtgctctccaaagcggatctggagaacccccatctgcccgagaagaaaattacacagtggctcgaaaccaagggcgtggagcggctgaaacgcatggccatcagcggggacgattgcgttgtgaagcctattgacgatagattcgctaacgcccttctggctctcaatgacatgggcaaggtccggaaagatatcccgcagtggcaaccctctaagggatggcacgactggcaacaggtgcctttttgttcccatcacttccacgaactgatcatgaaagatggccgcaaacttgttgtgccctgcagacctcaggacgagctgattgggcgggcccgcatcagccaaggagctggctggtctctcagagaaacagcctgtctggggaaagcgtacgcccagatgtggtccctgatgtatttccatcggcgcgacctcagactggctagcaacgccatttgctctgccgtccccgtgcactgggtccctacgtcccggaccacatggagcatccatgctcaccatcagtggatgaccacagaggatatgcttaccgtgtggaatagagtttggattgaggacaacccctggatggaagataagacgccggtgaccacatgggagaatgtcccttacctgggaaagcgcgaagaccaatggtgtggctccctcatcgggctgaccagccgggccacatgggcgcagaacattcccaccgctatccaacaggtgagatctcttatcggcaatgaggagtttctggattacatgcctagcatgaaacgcttccggaaggaagaggaactcgagggagccatttggtga

SEQ ID NO: 20388 - RNA, 9873 nt, synthetic construct
  misc_feature 1..9873: note = derived and/or modified CDS sequence (opt5) from DENV-3__KF041257__SS-prME
  source 1..9873: mol_type = other RNA
accagcctgtgcctcatgatgatcctgcccgcggctcttgccttccacctgacatcccgggacggagaacctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacacgatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgaagtctacacacagatgtgtgaccaccggctgatgagcgctgccgttaaggatgagagagccgtgcacgctgacatggggtactggatcgagtcccagaaaaacggatcttggaaacttgaaaaagccagcctcattgaggtgaagacctgcacctggcctaagtcccatacactgtggtctaatggcgtcctggaaagcgatatgatcattcccaaatccctcgcggggcctatcagccagcacaactatcgccccggataccatacccaaacggctggcccttggcacctggggaaacttgagctggactttaattattgcgagggaacaaccgtggttattacagaaaactgtggcacccggggcccctctctcagaacaaccacggtgtccgggaaactgatccacgagtggtgctgtcgcagctgcaccctgccgcctcttcggtacatgggagaagatggctgttggtatgggatggagatcagacccatttctgaaaaggaggagaatatggtcaaatccctcgtgagcgccggatctggcaaggttgacaacttcacaatgggggtgctgtgcctggccatcctctttgaagaggtcatgcggggaaagttcggcaaaaagcatatgattgctggcgtgttctttaccttcgttctgcttctgagcgggcagatcacatggcgcgatatggcccacaccctcattatgatcggatccaatgcgagcgacagaatgggcatgggggtgacgtacctggctctgattgccacatttaaaatccagcccttccttgccctgggatttttcctccggaagctgacctctagagaaaacctcctgcttggcgtcgggctggctatggccacaaccctccaactgcctgaggatatcgaacagatggctaatggaattgccctgggccttatggcgctgaaactcatcacccagtttgagacatatcagctgtggacggccctcatttccctgacctgtagcaacacaatcttcacccttacagtggcttggcgcaccgccacgctgattctcgctggcgtgtccctgctgccggtctgccaatctagctccatgcggaagacagactggcttcccatgaccgttgccgccatgggggtgcctcccctgcctctctttatcttctctctgaaggataccctcaaaagacgcagctggcccctgaatgagggagtgatggctgtcggccttgtgtccatcctggcgtctagcctgctcagaaacgacgttcctatggccgggcccctggtggctggaggccttctgattgcctgttacgtcatcacagggacctccgccgatctcacagtggaaaaggctgccgacgttacgtgggaggaagaggcggaacagaccggagtgagccataacctgatgattacagtcgacgatgacggcaccatgcggatcaaagatgacgagacagagaatattctcaccgtgctgcttaagacggctctgctgatcgtctctggcatctttccgtactccattcctgccaccctcctggtgtggcacacatggcagaaacagacccaacgcagcggggttctttgggatgtgccctctcctcccgaaacacagaaggccgagctggaagagggagtctatagaatcaaacagcagggcattctcgggaagacccaagtgggagttggcgtgcagaaggagggggtcttccatacaatgtggcacgtgacgcggggagctgtgctgacccacaacggcaaacgcctcgaaccgaattgggcctccgttaagaaagacctgatcagctacggcgggggatggagactttctgcgcagtggcaaaagggcgaggaagtccaggtgattgctgtggagcctgggaaaaaccccaagaattttcagacaatgcctggaaccttccagaccacaacgggcgaaatcggggccattgccctggatttcaagcccggaacctccggcagccccatcatcaaccgggagggcaaagtcgtggggctgtatggaaatggcgttgtgacaaagaacgggggatacgtctccggcattgctcaaaccaatgccgagcctgacgggccgacacccgaactcgaggaagagatgtttaaaaagcgcaacctgaccatcatggatcttcatcctggcagcggaaaaacgagaaagtatctgcccgctattgtgcgggaagccatcaagcgcagactccggacactgattctcgcgcctaccagagttgtggccgctgagatggaggaagccctgaaaggccttcccatccgctaccagaccacagctaccaagtctgagcacacagggcgggaaatcgtcgacctgatgtgccatgccaccttcacgatgagactgctcagccctgtgcgcgttccgaattataacctgattatcatggatgaggcccactttacagaccccgcttccattgcggcccggggatacatctctaccagagtgggcatgggggaagctgccgccattttcatgacagctacccctcccggaacggccgatgcgtttcctcagagcaatgctcccatccaggacgaggagcgcgacatcccggaacggtcctggaactctggcaatgagtggattaccgatttcgccgggaaaacagtctggtttgtgcctagcatcaaggccggcaacgacattgctaactgtcttcgcaaaaatggaaagaaggtgatccaactgtccagaaaaaccttcgatacagaataccagaagaccaaactcaacgactgggattttgtcgttacaaccgacatttctgagatgggcgccaatttcaaggcggatcgggtgatcgaccccagacggtgcctgaaacccgtgattctgacggatgggcctgagcgcgtcatcctcgccggacccatgcctgtgacagctgccagcgctgcccagagacggggccgcgttgggagaaacccgcagaaggaaaatgaccaatatatctttaccggacagccccttaacaatgatgaggaccatgctcactggaccgaagccaagatgctgctggacaacattaatacacctgagggcatcattcccgccctcttcgaacctgagcgggagaaatccgccgctatcgatggggaatacagactgaagggcgagagccgcaaaaccttcgtggaacttatgcggagaggagacctgcccgtctggctcgcccacaaggtggcttctgagggcattaaatatacagatcgcaagtggtgctttgacgggcagcggaacaatcagatcctggaagagaacatggatgttgagatctggacgaaagaaggagagaagagaaagctgcgcccgcggtggctcgacgccagaacctactccgatcctcttgccctgaaagagttcaaggactttgctgcgggccgcaaaagcattgccctggatctcgtgacagagatcgggagagtcccctctcatctggctcaccggacccgcaatgcccttgacaacctggtgatgctccatacatccgaacacggaggcagagcctatcggcacgctgtcgaggagctgcctgaaaccatggagacgctgctccttctgggcctgatgattctcctgaccgggggagccatgcttttcctgatcagcggcaaggggattggaaaaacatccatcggcctcatctgtgtgattgcgtctagcgggatgctgtggatggccgaaatccccctgcaatggattgcttccgccatcgttctcgagtttttcatgatggtgcttctgattcctgagcccgaaaagcagcgcaccccgcaggataatcaactggcttacgtggtcatcggcattctcacactggccgcgatcatcgccgctaacgagatgggccttctggaaaccacgaagagagacctcggcatgagcaaagagcctggggttgtgtctcccacatcctatctggatgtggacctgcatcccgccagcgcttggaccctctacgccgtcgctacaaccgtgattacccctatgcttcggcacacaatcgaaaattctacggccaacgttagcctggcggccattgctaaccaggccgtggtcctgatgggactcgacaagggctggccgatctccaaaatggatctgggggtgccccttctggctctcggatgctactctcaggtcaatcctctgaccctgacagccgccgtgctccttctgattacccattatgcgatcatcggccccgggctgcaggctaaggccacaagagaggctcaaaaacgcaccgccgccggaattatgaagaaccctacggttgacggcatcattacaatcgatctcgaccccgtgatttacgatagcaagtttgagaaacagctgggccaggtcatgcttctggtgctctgtgctgttcagctgctgctcatgcggacctcctgggccctttgcgaagcgctgaccctggccacagggcctatcaccacactctgggagggatctccgggcaagttctggaatacgaccatcgctgtgagcatggccaacatttttagagggtcctatctggctggagccggccttgcgttcagcatcatgaaatctgtcgggacaggaaagcgcggcaccggctcccaaggggaaacactgcgggagaaatggaagaagaaactcaatcagctgagcagaaaggaatttgacctgtacaaaaagtccggaattaccgaggtggatcggacggaggccaaagaaggcctcaagcgcggggagaccacacaccatgctgtgtctagaggaagcgccaaacttcagtggttcgttgaacggaacatggtcatccccgagggccgcgtgattgacctggggtgtggaagaggcggctggtcctattactgcgctgggctgaagaaggtgaccgaagtccggggatatacaaaaggcgggcctggacacgaggagcccgttcctatgtctacctacggctggaatatcgtgaagctcatgagcgggaaagatgtgttttacctgcccccggaaaagtgtgacacacttctgtgcgatattggagagtccagcccttctcccaccgtcgaagagtcccgcacgatcagagtgctcaaaatggttgagccctggctgaagaacaatcagttctgtatcaaggtgctgaacccttatatgcccgccgtcattgaacacctcgagcggcttcaacgcaaacatggcggcatgctggtgagaaatcctctgagccggaactctacacacgaaatgtactggatctccaatgggaccggaaacattgttagctctgtgaatatggtcagcagactcctgcttaaccgcttcaccatgacacatcggagaccgacgatcgagaaggacgtggatctgggcgctgggacccgccacgtgaacgccgaacccgagacacctaatatggacgtcattggagagcggatcaaaagaatcaaggaagaacacaactccacctggcattatgacgatgaaaatccctacaaaacatgggcgtatcacggctcttacgaggttaaggccaccgggagcgcttccagcatgattaacggagtggtgaagctcctgacaaaaccttgggacgtcgtgcccatggttacccagatggccatgacggataccacaccgtttggccagcaacgcgtgttcaaggaaaaagtcgacacccggacacctagacccatgcctggcacccgcaaggtgatggagatcacggctgagtggctgtggcggacactcgggagaaataaacgcccccggctgtgcaccagagaagagtttacaaagaaggttcgcaccaacgccgccatgggagcggtgttcacggaagagaatcagtgggattccgctaaagccgccgtcgaagacgaggagttttggaaacttgtggatagagaacgggagctgcataaactcggcaagtgtgggtcttgcgtttataacatgatgggaaaacgcgaaaagaaactgggcgagttcgggaaggctaagggcagcagagccatttggtacatgtggcttggagctcggtacctggagtttgaagccctcggcttcctgaatgaggaccactggttttccagagaaaactcttatagcggggtggagggagaaggcctgcataaactcgggtacatcctgcgggatatttccaagatccctggaggcgcgatgtatgccgacgataccgctgggtgggacacacgcatcaccgaggacgatcttcacaatgaggagaagattacacagcagatggaccccgagcacagactgctcgccaacgctatcttcaagctgacctaccaaaataaagtcgtgaaggtccagcggccgacacctaccggcacggtgatggatattatctctcgcaaggaccagagaggaagcggccaggttgggacatatggacttaacacctttaccaatatggaagcccaactggtgcggcagatggagggcgaaggggtcctctccaaagcggatctggagaacccccatctgcccgagaagaaaattacacagtggctcgaaaccaagggagtggagcgcctgaaaagaatggccatcagcggcgacgattgcgtggttaagcctatcgacgatcggttcgctaacgcccttctggctctcaatgacatggggaaggtgcgcaaagatattccgcagtggcaaccctctaagggctggcacgactggcagcaggtccctttttgttcccatcacttccacgaactgatcatgaaagatggaagaaaacttgtggttccctgccggcctcaggacgagctgattggccgcgccagaatcagccaaggggctggatggtctctccgggaaacagcctgtctgggcaaagcgtacgcccagatgtggtccctgatgtatttccatcgcagagacctccggctggctagcaacgccatttgctctgccgtgcccgtccactgggtgcctacgtccagaaccacatggagcatccatgctcaccatcagtggatgaccacagaggatatgcttaccgtctggaatcgcgtgtggattgaggacaacccctggatggaagataagacgccggttaccacatgggagaatgtgccttacctggggaagcgggaagaccaatggtgtggatccctcatcggcctgaccagcagagccacatgggcgcagaacatccccaccgctattcagcaggtccgctctcttatcgggaatgaggagtttctggattacatgcctagcatgaaacggttcagaaaggaagaggaactcgagggcgccatttggtga

SEQ ID NO: 20389 - RNA, 9873 nt, synthetic construct
  misc_feature 1..9873: note = derived and/or modified CDS sequence (opt5) from DENV-3__KF041255__SS-prME
  source 1..9873: mol_type = other RNA
accagcctgtgcctcatgatgatcctgcccgcggctcttgccttccacctgacatcccggaatggagaacctcggatgattgtggggaagaatgaacgcggaaagtctctcctgtttaagacggcgagcggcatcaacatgtgtacccttattgctatggacctgggggagatgtgcgatgacacagtgacctacaaatgtccgcatatcacagaagttgagcccgaagatattgactgctggtgtaatctcacctccacatgggtgacctatggaacgtgcaaccaggccggcgagcaccggcgggataagcgctctgtggccctggctcctcatgtcgggatgggactggacaccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaatcgggattttgtcgaagggctcagcggagctacctgggtggacgtggtcctggagcacggcgggtgcgttaccacaatggccaagaacaaacccacgctggatattgagctccagaagaccgaagctacacaactggccacccttcgcaaactgtgtatcgagggaaagattacaaatatcaccacggactccagatgccctacacagggcgaagcggtgctcccggaggaacaggatcagaactatgtgtgtaaacacacctacgtcgaccggggctgggggaatggatgcggcctgttcgggaagggaagccttgtgacctgcgccaagtttcaatgtctggagcccattgagggcaaagttgtgcagtatgaaaacctcaagtacacagtcatcatcaccgtgcatacaggggatcagcaccaggttggaaatgagacgcaaggcgtgaccgctgaaattacacctcaggcctctaccacagaggctatcctgcccgaatatggcaccctggggctcgagtgctcccctcgcacgggactggacttcaacgagatgattcttctgaccatgaaaaataaggcctggatggtccatagacagtggtttttcgacctccccctgccgtggacaagcggcgccaccacagaaacccctacgtggaaccggaaagagcttctggtgacatttaagaatgctcacgcgaaaaagcaagaagtcgtggttctcgggtctcaggagggagccatgcacaccgctctgacaggcgccaccgaaatccagaactccgggggcaccagcattttcgccggacatctgaagtgtcgcctcaaaatggataagctggagcttaaaggcatgtcttacgctatgtgcacaaacacgtttgtgctgaagaaagaggtctccgaaacccagcacgggacaatcctcatcaaggtggagtacaagggagaagacgccccctgtaaaattcctttcagcaccgaggatggccaagggaaggcgcataatggaagactgatcacagctaaccccgttgtgaccaaaaaggaggaacccgtcaatattgaggccgaacctccgttcggcgagtccaacatcgtgattgggatcggcgacaatgccctgaaaatcaactggtataagaagggatctagcattggcaaaatgtttgaagctacggccagaggggctagacgcatggccatccttggagatacagcgtgggacttcggctccgtcgggggagttctcaatagcctgggcaagatggtccaccagatttttgggtctgcctacaccgctctgttctccggcgtgagctgggtgatgaaaatcggaattggcgtcctcctgacctggatcgggcttaactctaagaatacaagcatgtccttttcttgcattgccatcggaatcattaccctgtatctcggcgctgtggttcaggccgatatggggtgtgtgatcaactggaaaggaaaggagctgaagtgcggcagcgggattttcgtcacaaatgaggtgcatacgtggaccgaacagtacaaatttcaagcggactcccccaagcggctggccacagctatcgccggcgcttgggagaacggagtttgtggcattagaagcaccacacgcatggaaaatcttctctggaaacagatcgccaacgagctgaattatatcctgtgggaaaacaacattaagctcaccgtggtcgtgggggatacgatcggagttctggagcagggcaaacggacccttacacctcagcccatggagctgaagtactcttggaaaacctgggggaaggccaagattgtgacagctgaaacccaaaattccagcttcatcattgacggacctaacacacccgagtgcccgtctgcgtccagagcctggaatgtctgggaagtggaggattatggctttggcgtgttcaccacgaacatctggctcaaactgcgcgaagtctacacacagatgtgtgaccaccggctgatgagcgctgccgttaaggacgagagagccgtgcacgctgatatggggtactggatcgagtcccagaaaaatggatcttggaaacttgaaaaagccagcctcattgaggtgaagacctgcacctggcctaagtcccatacactgtggtctaacggcgtcctggaaagcgacatgatcattcccaaatccctcgcggggcctatcagccagcacaattatcgccccggataccatacccaaacggctggcccttggcacctggggaaacttgagctggattttaactattgcgagggaacaaccgtggttattacagaaaattgtggcacccggggcccctctctcagaacaaccacggtgtccgggaaactgatccacgagtggtgctgtcgcagctgcaccctgccgcctcttcggtacatgggagaagacggctgttggtatgggatggagatcagacccatttctgaaaaggaggagaacatggtcaaatccctcgtgagcgccggatctggcaaggttgataatttcacaatgggggtgctgtgcctggccatcctctttgaagaggtcatgcggggaaagttcggcaaaaagcatatgattgctggcgtgttctttaccttcgttctgcttctgagcgggcagatcacatggcgcgacatggcccacaccctcattatgatcggatccaacgcgagcgatagaatgggcatgggggtgacgtacctggctctgattgccacatttaaaatccagcccttccttgccctgggatttttcctccggaagctgacctctagagaaaatctcctgcttggcgtcgggctggctatggccacaaccctccaactgcctgaggacatcgaacagatggctaacggaattgccctgggccttatggcgctgaaactcatcacccagtttgagacatatcagctgtggacggccctcatttccctgacctgtagcaatacaatcttcacccttacagtggcttggcgcaccgccacgctgattctcgctggcgtgtccctgctgccggtctgccaatctagctccatgcggaagacagattggcttcccatgaccgttgccgccatgggggtgcctcccctgcctctctttatcttctctctgaaggacaccctcaaaagacgcagctggcccctgaacgagggagtgatggctgtcggccttgtgtccatcctggcgtctagcctgctcagaaacgatgttcctatggccgggcccctggtggctggaggccttctgattgcctgttacgtcatcacagggacctccgccgacctcacagtggaaaaggctgccgatgttacgtgggaggaagaggcggaacagaccggagtgagccataatctgatgattacagtcgacgacgatggcaccatgcggatcaaagacgatgagacagagaacattctcaccgtgctgcttaagacggctctgctgatcgtctctggcatctttccgtactccattcctgccaccctcctggtgtggcacacatggcagaaacagacccaacgcagcggggttctttgggacgtgccctctcctcccgaaacacagaaggccgagctggaagagggagtctatagaatcaaacagcagggcattctcgggaagacccaagtgggagttggcgtgcagaaggagggggtcttccatacaatgtggcacgtgacgcggggagctgtgctgacccacaatggcaaacgcctcgaaccgaactgggcctccgttaagaaagatctgatcagctacggcgggggatggagactttctgcgcagtggcaaaagggcgaggaagtccaggtgattgctgtggagcctgggaaaaatcccaagaactttcagacaatgcctggaaccttccagaccacaacgggcgaaatcggggccattgccctggacttcaagcccggaacctccggcagccccatcatcaatcgggagggcaaagtcgtggggctgtatggaaacggcgttgtgacaaagaatgggggatacgtctccggcattgctcaaaccaacgccgagcctgatgggccgacacccgaactcgaggaagagatgtttaaaaagcgcaatctgaccatcatggaccttcatcctggcagcggaaaaacgagaaagtatctgcccgctattgtgcgggaagccatcaagcgcagactccggacactgattctcgcgcctaccagagttgtggccgctgagatggaggaagccctgaaaggccttcccatccgctaccagaccacagctaccaagtctgagcacacagggcgggaaatcgtcgatctgatgtgccatgccaccttcacgatgagactgctcagccctgtgcgcgttccgaactataatctgattatcatggacgaggcccactttacagatcccgcttccattgcggcccggggatacatctctaccagagtgggcatgggggaagctgccgccattttcatgacagctacccctcccggaacggccgacgcgtttcctcagagcaacgctcccatccaggatgaggagcgcgacatcccggaacggtcctggaactctggcaacgagtggattaccgacttcgccgggaaaacagtctggtttgtgcctagcatcaaggccggcaacgatattgctaattgtcttcgcaaaaacggaaagaaggtgatccaactgtccagaaaaaccttcgacacagaataccagaagaccaaactcaatgattgggactttgtcgttacaaccgatatttctgagatgggcgccaacttcaaggcggaccgggtgatcgatcccagacggtgcctgaaacccgtgattctgacggacgggcctgagcgcgtcatcctcgccggacccatgcctgtgacagctgccagcgctgcccagagacggggccgcgttgggagaaatccgcagaaggaaaacgatcaatatatctttaccggacagccccttaataacgacgaggatcatgctcactggaccgaagccaagatgctgctggacaatattaacacacctgagggcatcattcccgccctcttcgaacctgagcgggagaaatccgccgctatcgacggggaatacagactgaagggcgagagccgcaaaaccttcgtggaacttatgcggagaggagatctgcccgtctggctcgcccacaaggtggcttctgagggcattaaatatacagaccgcaagtggtgctttgatgggcagcggaataaccagatcctggaagagaatatggacgttgagatctggacgaaagaaggagagaagagaaagctgcgcccgcggtggctcgatgccagaacctactccgaccctcttgccctgaaagagttcaaggattttgctgcgggccgcaaaagcattgccctggacctcgtgacagagatcgggagagtcccctctcatctggctcaccggacccgcaacgcccttgataatctggtgatgctccatacatccgaacacggaggcagagcctatcggcacgctgtcgaggagctgcctgaaaccatggagacgctgctccttctgggcctgatgattctcctgaccgggggagccatgcttttcctgatcagcggcaaggggattggaaaaacatccatcggcctcatctgtgtgattgcgtctagcgggatgctgtggatggccgaaatccccctgcaatggattgcttccgccatcgttctcgagtttttcatgatggtgcttctgattcctgagcccgaaaagcagcgcaccccgcaggacaaccaactggcttacgtggtcatcggcattctcacactggccgcgatcatcgccgctaatgagatgggccttctggaaaccacgaagagagatctcggcatgagcaaagagcctggggttgtgtctcccacatcctatctggacgtggatctgcatcccgccagcgcttggaccctctacgccgtcgctacaaccgtgattacccctatgcttcggcacacaatcgaaaactctacggccaacgttagcctggcggccattgctaatcaggccgtggtcctgatgggactcgacaagggctggccgatctccaaaatggacctgggggtgccccttctggctctcggatgctactctcaggtcaaccctctgaccctgacagccgccgtgctccttctgattacccattatgcgatcatcggccccgggctgcaggctaaggccacaagagaggctcaaaaacgcaccgccgccggaattatgaagaatcctacggttgatggcatcattacaatcgacctcgatcccgtgatttacgacagcaagtttgagaaacagctgggccaggtcatgcttctggtgctctgtgctgttcagctgctgctcatgcggacctcctgggccctttgcgaagcgctgaccctggccacagggcctatcaccacactctgggagggatctccgggcaagttctggaacacgaccatcgctgtgagcatggccaatatttttagagggtcctatctggctggagccggccttgcgttcagcatcatgaaatctgtcgggacaggaaagcgcggcaccggctcccaaggggaaacactgggagagaaatggaagaagaaactcaaccagctgagccggaaggaatttgatctgtacaaaaagtccggcattaccgaggtggacagaacggaggccaaagaagggctcaagcggggagagaccacacaccatgctgtgtctcgcggcagcgccaaacttcagtggttcgttgaaagaaatatggtcatccccgaggggcgggtgattgatctgggatgtggccgcggcgggtggtcctattactgcgctggactgaagaaggtgaccgaagtcagaggctatacaaaagggggacctggccacgaggagcccgttcctatgtctacctacgggtggaacatcgtgaagctcatgagcggaaaagacgtgttttacctgcccccggaaaagtgtgatacacttctgtgcgacattggcgagtccagcccttctcccaccgtcgaagagtcccggacgatccgcgtgctcaaaatggttgagccctggctgaagaataaccagttctgtatcaaggtgctgaatccttatatgcccgccgtcattgaacacctcgagagacttcaacggaaacatggcgggatgctggtgcgcaaccctctgagcagaaattctacacacgaaatgtactggatctccaacggaaccggcaatattgttagctctgtgaacatggtcagccggctcctgcttaacagattcaagatgacccatcgccggccgacaatcgagaaagatgtggacctgggggctggaacgagacacgtgaatgccgaacccgagacccctaacatggatgtcattggcgagcgcatcaagcggatcaaagaagaacacaattccacatggcattatgacgacgaaaacccctacaagacctgggcgtatcacgggtcttacgaggttaaggccacaggaagcgcttccagcatgattaatggcgtggtgaaactcctgaccaagccttgggatgtcgtgcccatggttacacagatggccatgaccgacacgaccccgtttggccagcaaagagtgttcaaagaaaaggtcgatacacgcacccctcggcccatgcctgggacaagaaaagtgatggagatcaccgctgagtggctgtggcgcacgctcggacggaacaagagaccccgcctgtgcacacgggaagagtttaccaagaaagttagaacaaatgccgccatgggcgcggtgttcaccgaagagaaccagtgggactccgctaaggccgccgtcgaagatgaggagttttggaaacttgtggaccgcgaaagagagctgcataagctcgggaaatgtggatcttgcgtttataatatgatgggcaagcgggagaagaagctgggggagttcggcaaggctaaaggaagccgcgccatttggtacatgtggcttggcgctagatacctggagtttgaagccctcgggttcctgaacgaggatcactggttttcccgggaaaattcttatagcggagtggagggcgaagggctgcataagctcggatacatcctgagagacatttccaaaatccctggcggggcgatgtatgccgatgacacggctggctgggatacccggatcacagaggacgaccttcacaacgaggaaaagattacccagcagatggatcccgagcaccgcctgctcgccaatgctatcttcaaactgacataccaaaacaaggtcgtgaaggtccagagaccgacccctacaggaaccgtgatggacattatctctcggaaagatcagcgcggcagcgggcaggttggaacgtatggccttaatacatttaccaacatggaagcccaactggtgagacagatggagggggaaggagtcctctccaaggcggacctggagaacccccatctgcccgagaaaaagattacccagtggctcgaaacaaaaggcgtggagcggctgaagcgcatggccatcagcggggatgactgcgtggttaagcctatcgatgacagattcgctaatgcccttctggctctcaacgatatgggcaaagtgcggaaggacattccgcagtggcaaccctctaaaggatggcacgattggcagcaggtccctttttgttcccatcacttccacgaactgatcatgaaggacggccgcaaacttgtggttccctgcagacctcaggatgagctgattgggcgggcccgcatcagccaaggagctggctggtctctcagagaaaccgcctgtctggggaaggcgtacgcccagatgtggtccctgatgtatttccatcggcgcgacctcagactggctagcaatgccatttgctctgccgtgcccgtccactgggtgcctacatcccggacgacctggagcatccatgctcaccatcagtggatgacaaccgaggacatgcttacagtctggaacagagtgtggattgaggataatccctggatggaagacaagaccccggttacgacctgggagaacgtgccttacctgggaaaacgcgaagatcaatggtgtggctccctcatcgggctgacaagccgggccacctgggcgcagaatatccccacagctattcagcaggtcagatctcttatcggcaacgaggagtttctggactacatgcctagcatgaagcgcttccggaaagaagaggaactcgagggagccatttggtga

SEQ ID NO: 20390 - RNA, 9873 nt, synthetic construct
  misc_feature 1..9873: note = derived and/or modified CDS sequence (opt5) from DENV-3__KF041256__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataagcccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacacgatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgaagtctacacacagatgtgtgaccaccggctgatgagcgctgccgttaaggatgagagagccgtgcacgctgacatggggtactggatcgagtcccagaaaaacggatcttggaaacttgaaaaagccagcctcattgaggtgaagacctgcacctggcctaagtcccatacactgtggtctaatggcgtcctggaaagcgatatgatcattcccaaatccctcgcggggcctatcagccagcacaactatcgccccggataccatacccaaacggctggcccttggcacctggggaaacttgagctggactttaattattgcgagggaacaaccgtggttattacagaaaactgtggcacccggggcccctctctcagaacaaccacggtgtccgggaaactgatccacgagtggtgctgtcgcagctgcaccctgccgcctcttcggtacatgggagaagatggctgttggtatgggatggagatcagacccatttctgaaaaggaggagaatatggtcaaatccctcgtgagcgccggatctggcaaggttgacaacttcacaatgggggtgctgtgcctggccatcctctttgaagaggtcatgcggggaaagttcggcaaaaagcatatgattgctggcgtgttctttaccttcgttctgcttctgagcgggcagatcacatggcgcgatatggcccacaccctcattatgatcggatccaatgcgagcgacagaatgggcatgggggtgacgtacctggctctgattgccacatttaaaatccagcccttccttgccctgggatttttcctccggaagctgacctctagagaaaacctcctgcttggcgtcgggctggctatggccacaaccctccaactgcctgaggatatcgaacagatggctaatggaattgccctgggccttatggcgctgaaactcatcacccagtttgagacatatcagctgtggacggccctcatttccctgacctgtagcaacacaatcttcacccttacagtggcttggcgcaccgccacgctgattctcgctggcgtgtccctgctgccggtctgccaatctagctccatgcggaagacagactggcttcccatgaccgttgccgccatgggggtgcctcccctgcctctctttatcttctctctgaaggataccctcaaaagacgcagctggcccctgaatgagggagtgatggctgtcggccttgtgtccatcctggcgtctagcctgctcagaaacgacgttcctatggccgggcccctggtggctggaggccttctgattgcctgttacgtcatcacagggacctccgccgatctcacagtggaaaaggctgccgacgttacgtgggaggaagaggcggaacagaccggagtgagccataacctgatgattacagtcgacgatgacggcaccatgcggatcaaagatgacgagacagagaatattctcaccgtgctgcttaagacggctctgctgatcgtctctggcatctttccgtactccattcctgccaccctcctggtgtggcacacatggcagaaacagacccaacgcagcggggttctttgggatgtgccctctcctcccgaaacacagaaggccgagctggaagagggagtctatagaatcaaacagcagggcattctcgggaagacccaagtgggagttggcgtgcagaaggagggggtcttccatacaatgtggcacgtgacgcggggagctgtgctgacccacaacggcaaacgcctcgaaccgaattgggcctccgttaagaaagacctgatcagctacggcgggggatggagactttctgcgcagtggcaaaagggcgaggaagtccaggtgattgctgtggagcctgggaaaaaccccaagaattttcagacaatgcctggaaccttccagaccacaacgggcgaaatcggggccattgccctggatttcaagcccggaacctccggcagccccatcatcaaccgggagggcaaagtcgtggggctgtatggaaatggcgttgtgacaaagaacgggggatacgtctccggcattgctcaaaccaatgccgagcctgacgggccgacacccgaactcgaggaagagatgtttaaaaagcgcaacctgaccatcatggatcttcatcctggcagcggaaaaacgagaaagtatctgcccgctattgtgcgggaagccatcaagcgcagactccggacactgattctcgcgcctaccagagttgtggccgctgagatggaggaagccctgaaaggccttcccatccgctaccagaccacagctaccaagtctgagcacacagggcgggaaatcgtcgacctgatgtgccatgccaccctgacgatgagactcctgagccctgtgcgcgttccgaattataaccttattatcatggatgaggcccacttcacagaccccgcttccattgcggcccggggatacatctctaccagagtgggcatgggggaagctgccgccatttttatgacagctacccctcccggaacggccgatgcgttccctcagagcaatgctcccatccaggacgaggagcgcgacatcccggaacggtcctggaactctggcaatgagtggattaccgattttgccgggaaaacagtctggttcgtgcctagcatcaaggccggcaacgacattgctaactgtctgcgcaaaaatggaaagaaggtgatccaactctccagaaaaacctttgatacagaataccagaagaccaaactgaacgactgggatttcgtcgttacaaccgacatttctgagatgggcgccaattttaaggcggatcgggtgatcgaccccagacggtgcctgaaacccgtgattctcacggatgggcctgagcgcgtcatccttgccggacccatgcctgtgacagctgccagcgctgcccagagacggggccgcgttgggagaaacccgcagaaggaaaatgaccaatatatcttcaccggacagcccctgaacaatgatgaggaccatgctcactggaccgaagccaagatgctgctcgacaacattaatacacctgagggcatcattcccgcgctgtttgaacctgagcgggagaaatccgccgctatcgatggggaatacagacttaagggcgagagccgcaaaaccttcgtggaactgatgcggagaggagacctccccgtctggctggcccacaaggtggcttctgagggcattaaatatacagatcgcaagtggtgcttcgacgggcagcggaacaatcagatcctggaagagaacatggatgttgagatctggacgaaagaaggagagaagagaaagctccgcccgcggtggcttgacgccagaacctactccgatcctctggccctgaaagaatttaaggacttcgctgcgggccgcaaaagcattgccctcgatctggtgacagagatcgggagagtcccctctcatcttgctcaccggacccgcaatgccctggacaacctcgtgatgctgcatacatccgaacacggaggcagagcctatcggcacgctgtcgaggagctgcctgaaaccatggagacgctccttctgctgggcctcatgattctgcttaccgggggagccatgctgtttctcatcagcggcaaggggattggaaaaacatccatcggcctgatctgtgtgattgcgtctagcgggatgctgtggatggccgaaatccccctccaatggattgcttccgccatcgttcttgagttctttatgatggtgctgctgattcctgagcccgaaaagcagcgcaccccgcaggataatcaactcgcttacgtggtcatcggcattctgacacttgccgcgatcatcgccgctaacgagatgggcctgctcgaaaccacgaagagagacctgggcatgagcaaagagcctggggttgtgtctcccacatcctatctggatgtggacctccatcccgccagcgcttggaccctttacgccgtcgctacaaccgtgattacccctatgctgcggcacacaatcgaaaattctacggccaacgttagcctggcggccattgctaaccaggccgtggtcctcatgggactggacaagggctggccgatctccaaaatggatcttggggtgcccctgctcgctctgggatgctactctcaggtcaatcctctgaccctcacagccgccgtgcttctgctgattacccattatgcgatcatcggccccgggctccaggctaaggccacaagagaggctcaaaaacgcaccgccgccggaattatgaagaaccctacggttgacggcatcattacaatcgatctggaccccgtgatttacgatagcaagttcgagaaacagcttggccaggtcatgctgctcgtgctgtgtgctgttcagctgctccttatgcggacctcctgggccctgtgcgaagcgctgaccctcgccacagggcctatcaccacactgtgggagggatctccgggcaagttttggaatacgaccatcgctgtgagcatggccaacattttcagagggtcctatcttgctggagccggcctggcgtttagcatcatgaaatctgtcgggacaggaaagcgcggcaccggctcccaaggggaaacactcggagagaaatggaagaagaaactgaatcagctgagccggaaggagttcgacctctacaaaaagtccggcattaccgaggtggatagaacggaggccaaagaagggcttaagcggggagagaccacacaccatgctgtgtctcgcggcagcgccaaactgcagtggtttgttgaaagaaacatggtcatccccgaggggcgggtgattgacctgggatgtggccgcggcgggtggtcctattactgcgctggactcaagaaggtgaccgaagtcagaggctatacaaaagggggacctggccacgagaagcccgttcctatgtctacctacgggtggaatatcgtgaaactgatgagcggaaaggatgtgttctaccttcccccggagaaatgtgacacactgctctgcgatattggcgaatccagcccttctcccaccgtcgaggaatcccggacgatccgcgtgctgaagatggttgagccctggctgaagaacaatcagttttgtatcaaagtgctcaacccttatatgcccgccgtcattgagcaccttgaaagactgcaacggaagcatggcgggatgctggtgcgcaatcctctcagcagaaactctacacacgagatgtactggatctccaatggaaccggcaacattgttagctctgtgaatatggtcagccggctgcttctgaacagattcaaaatgacccatcgccggccgacaatcgaaaaggacgtggatctcggggctggaacgagacacgtgaacgccgagcccgaaacccctaatatggacgtcattggcgagcgcatcaaacggatcaaggaggaacacaactccacatggcattatgacgatgagaatccctacaagacctgggcgtatcacgggtcttacgaagttaaagccacaggaagcgcttccagcatgattaacggcgtggtgaagctgctgaccaaaccttgggacgtcgtgcccatggttacacagatggccatgaccgatacgaccccgttcggccagcaaagagtgtttaaggagaaagtcgacacacgcacccctcggcccatgcctgggacaagaaaggtgatggaaatcaccgctgagtggctctggcgcacgctgggacggaataagagaccccgcctttgcacacgggaggagttcaccaaaaaggttagaacaaacgccgccatgggcgcggtgtttaccgaggaaaatcagtgggattccgctaaagccgccgtcgaggacgaagagttctggaagctggtggatcgcgagagagaactccataaactggggaagtgtggatcttgcgtttataacatgatgggcaaacgggagaagaaacttggggaatttggcaaagctaagggaagccgcgccatttggtacatgtggctgggcgctagatacctcgagttcgaggccctggggtttctgaatgaagaccactggttctcccgggagaactcttatagcggagtggaaggcgaggggctccataaactgggatacatccttagagatatttccaagatccctggcggggcgatgtatgccgacgatacggctggctgggacacccggatcacagaagacgatctgcacaatgaggagaaaattacccagcagatggaccccgaacaccgcctcctggccaacgctatctttaaacttacataccaaaataaggtcgtgaaagtccagagaccgacccctacaggaaccgtgatggatattatctctcggaaggaccagcgcggcagcgggcaggttggaacgtatggcctgaacacattcaccaatatggaggcccaactcgtgagacagatggaaggggagggagtcctgtccaaagcggatctggaaaacccccatctccccgagaagaaaattacccagtggctggagacaaagggcgtggaacggcttaagcgcatggccatcagcggggacgattgcgtggttaaacctatcgacgatagatttgctaacgccctgctcgctctgaatgacatgggcaaggtgcggaaagatattccgcagtggcaaccctctaagggatggcacgactggcagcaggtccctttctgttcccatcactttcacgagcttatcatgaaagatggccgcaagctggtggttccctgcagacctcaggacgaactcattgggcgggcccgcatcagccaaggagctggctggtctctgagagagaccgcctgtctggggaaggcgtacgcccagatgtggtccctcatgtatttccatcggcgcgacctgagacttgctagcaacgccatttgctctgccgtgcccatccactgggtccctacatcccggacgacctggagcattcatgctcaccatcagtggatgacaaccgaagatatgctgacagtgtggaatagagtctggatcgaggacaacccctggatggaggataaaaccccggtgacgacctgggaaaatgttccttacctcggaaagcgcgaggaccaatggtgtggctccctgatcgggcttacaagccgggccacctgggcgcagaacattcccacagctatccaacaggtgagatctctgattggcaatgaagagttcctcgattacatgcctagcatgaaacgctttcggaaggaggaagaactggaaggagccatctggtga

SEQ ID NO: 20391 - RNA, 9873 nt, synthetic construct
  misc_feature 1..9873: note = derived and/or modified CDS sequence (opt5) from DENV-3__KF041254__SS-prME
  source 1..9873: mol_type = other RNA
acaagcctgtgcctcatgatgatcctgcccgctgctcttgccttccacctgacatcccgggacggagaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgtggttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggagaacctgggggaaagccaagattgtcacagccgaaacccaaaactccagcttcatcattgatggacctaatacacccgagtgcccgtctgcttcccgcgcgtggaacgtgtgggaagtggaggactatggctttggcgtcttcaccacgaatatctggctcaagctgcgggaaatgtacacacagatgtgtgaccacagactgatgagcgccgctgttaaagatgagcgcgccgtgcacgccgacatggggtactggatcgagtcccagaagaacggatcttggaaacttgaaaaggctagcctcattgaggtgaaaacctgcacctggcctaagtcccatacactgtggtctaatggcgtcctggaaagcgatatgatcattcccaagtccctcgccgggcctatcagccagcacaactatcggcccggataccatacccaaacggcgggcccttggcacctggggaaacttgagctggactttaattattgcgagggaacaaccgtggttattacagaaaactgtggcaccagaggcccctctctccgcacaaccacggtgtccgggaagctgatccacgagtggtgctgtcggagctgcaccctgccgcctcttagatacatgggagaagatggctgttggtatgggatggagatccggcccatttctgaaaaagaggagaatatggtcaagtccctcgtgagcgctggatctggcaaagttgacaacttcacaatgggggtgctgtgcctggccatcctctttgaagaggtcatgcgcggaaagttcggcaagaaacatatgattgccggcgtgttctttaccttcgttctgcttctgagcgggcagatcacatggagagatatggctcacaccctcattatgatcggatccaatgccagcgaccggatgggcatgggggtgacgtacctggcgctgattgctacatttaagatccagcccttccttgccctgggatttttcctcagaaaactgacctctcgcgaaaacctcctgcttggcgtcgggctggccatggctacaaccctccaactgcctgaggatatcgaacagatggccaatggaattgctctgggccttatggccctgaagctcatcacccagtttgagacatatcagctgtggacggcgctcatttccctgacctgtagcaacacaatcttcacccttacagtggcctggcggaccgctacgctgattctcgccggcgtgtccctgctgccggtctgccaatctagctccatgagaaaaacagactggcttcccatgaccgttgctgccatgggggtgcctcccctgcctctctttatcttctctctgaaggataccctcaagcgcagaagctggcccctgaatgagggagtgatggccgtcggccttgtgtccatcctggcttctagcctgctccggaacgacgttcctatggcggggcccctggtggccggaggccttctgattgcttgttacgtcatcacagggacctccgccgatctcacagtggaaaaagccgctgacgttacgtgggaggaagaggccgaacagaccggagtgagccataacctgatgattacagtcgacgatgacggcaccatgcgcatcaaggatgacgagacagagaatattctcaccgtgctgcttaaaacggcgctgctgatcgtctctggcatctttccgtactccattcctgctaccctcctggtgtggcacacatggcagaagcagacccaaagaagcggggttctttgggatgtgccctctcctcccgaaacacagaaagccgagctggaagagggagtctatcggatcaagcagcagggcattctcgggaaaacccaagtgggagttggcgtgcagaaggagggggtcttccatacaatgtggcacgtgacgcgcggagccgtgctgacccacaacggcaagagactcgaaccgaattgggcttccgttaaaaaggacctgatcagctacggcgggggatggcggctttctgcccagtggcaaaaaggcgaggaagtccaggtgattgcggtggagcctgggaagaaccccaaaaattttcagacaatgcctggaaccttccagaccacaacgggcgaaatcggggctattgccctggatttcaagcccggaacctccggcagccccatcatcaaccgcgagggcaaggtcgtggggctgtatggaaatggcgttgtgaccaagaacgggggatacgtctccggcattgcccaaaccaatgctgagcctgacgggccgacacccgaactcgaggaagagatgtttaagaaaagaaacctgaccatcatggatcttcatcctggcagcggaaagacgcggaaatatctgcccgccattgtgcgcgaagctatcaagagacggctcagaacactgattctcgcccctacccgcgttgtggcggccgagatggaggaagctctgaagggccttcccatccggtaccagaccacagccaccaaatctgagcacacagggagagaaatcgtcgacctgatgtgccatgctaccttcacgatgcgcctgctcagccctgtgcgggttccgaattataacctgattatcatggatgaggcccactttacagaccccgcctccattgctgcgagaggatacatctctacccgcgtgggcatgggggaagccgctgccattttcatgacagccacccctcccggaacggctgatgcctttcctcagagcaatgcgcccatccaggacgaggagcgggacatcccggaaagatcctggaactctggcaatgagtggattaccgatttcgctgggaagacagtctggtttgtgcctagcatcaaagccggcaacgacattgccaactgtcttcgcaagaatggcaaaaaggtgatccaactgtcccggaagaccttcgatacagaataccagaaaaccaagctcaacgactgggattttgtcgttacaaccgacatttctgagatgggagctaatttcaaagccgatagagtgatcgacccccggcgctgcctgaagcccgtgattctgacggatgggcctgagagagtcatcctcgcgggacccatgcctgtgacagccgctagcgccgctcagcggcgcggcagagttgggcggaacccgcagaaagaaaatgaccaatatatctttaccggacagccccttaacaatgatgaggaccatgcccactggaccgaagctaagatgctgctggacaacattaatacacctgagggcatcattcccgccctcttcgaacctgagagagagaagtccgcggccatcgatggggaataccgcctgaaaggcgagagccggaagaccttcgtggaacttatgagacgcggagacctgcccgtctggctcgctcacaaagtggcctctgagggcattaagtatacagatcggaaatggtgctttgacgggcagagaaacaatcagatcctggaagagaacatggatgttgagatctggacgaaggaaggagagaaacgcaagctgcggccgagatggctcgacgctcgcacctactccgatcctcttgccctgaaggagttcaaagactttgccgctggcagaaagagcattgcgctggatctcgtgacagagatcgggcgggtcccctctcatctggcccaccgcaccagaaatgctcttgacaacctggtgatgctccatacatccgaacacggaggccgggcctatcgccacgccgtcgaggagctgcctgaaaccatggagacgctgctccttctgggcctgatgattctcctgaccgggggagctacacttttcctgatcagcggcaaagggattggaaagacctccatcggcctcatctgtgtgattgcctctagcgggatgctgtggatggcggaaatccccctgcaatggattgcctccgctatcgttctcgagtttttcatgatggtgcttctgattcctgagcccgaaaaacagagaacaccgcaggataatcaactggcctacgtggtcatcggcattctcaccctggctgccatcatcgcggccaacgagatgggccttctggaaacgacaaagcgggacctcggcatgagcaaggagcctggggttgtgtctcccacctcctatctggatgtggacctgcatcccgctagcgcctggacactctacgctgtcgccaccaccgtgattacacctatgcttagacacacgatcgaaaattctaccgctaacgttagcctggccgcgattgccaaccaggctgtggtcctgatgggactcgacaaaggctggccgatctccaagatggatctgggggtgccccttctggccctcggatgctactctcaggtcaatcctctgacactgaccgctgccgtgctccttctgattacacattatgccatcatcggccccgggctgcaggcgaaagctacccgcgaggcccaaaagcggacggctgccggaattatgaaaaaccctacagttgacggcatcattaccatcgatctcgaccccgtgatttacgatagcaagtttgagaagcagctgggccaggtcatgcttctggtgctctgtgccgttcagctgctgctcatgagaacctcctgggctctttgcgaagccctgacactggcgaccgggcctatcacaacgctctgggagggatctccgggcaaattctggaataccacaatcgccgtgagcatggctaacatttttcgcgggtcctatctggcccgggctggacttgccttcagcatcatgaagtctgtcggcaccgggaaaagaggaacaggctcccaaggcgaaaccctgggggagaagtggaaaaagaagctcaatcagctgagccggaaagaatttgacctgtacaagaaatccggaattacggaggtggatcgcaccgaggcgaaggaaggcctcaaaagaggggagacaacccaccatgccgtgtctcggggaagcgctaaacttcagtggttcgttgaacgcaacatggtcatccccgagggcagagtgattgacctggggtgtggacggggcggctggtcctattactgcgccgggctgaaaaaggtgacagaagtccgcggatataccaagggcgggcctggacacgaggagcccgttcctatgtctacatacggctggaatatcgtgaaactcatgagcgggaaggatgtgttttacctgcccccggaaaaatgtgacacccttctgtgcgatattggagagtccagcccttctcccacggtcgaagagtccagaacaatccgggtgctcaagatggttgagccctggctgaaaaacaatcagttctgtatcaaggtgctgaacccttatatgcccgctgtcattgaacacctcgagcgccttcaaagaaagcatggcggcatgctggtgcggaatcctctgagcagaaactctacccacgaaatgtactggatctccaatgggaccggaaacattgttagctctgtgaatatggtcagcaaactcctgcttaaccgcttcacaatgacgcatcggagaccgaccatcgagaaggacgtggatctgggcgccgggacacgccacgtgaacgctgaacccgagacccctaatatggacgtcattggagagcggatcaaaagaatcaaggaagaacacaactccacatggcattatgacgatgaaaatccctacaaaacctgggcctatcacggctcttacgaggttaaggcgacagggagcgcctccagcatgattaacggagtggtgaagctcctgaccaaaccttgggacgtcgtgcccatggttacgcagatggctatgaccgatacaaccccgtttggccagcaacgcgtgttcaaggaaaaagtcgacacacggacccctagacccatgcctggcacgcgcaaggtgatggagatcacagccgagtggctgtggcggaccctcgggagaaataaacgcccccggctgtgcacaagagaagagtttaccaagaaggttcgcacgaacgctgccatgggagccgtgttcaccgaagagaatcagtgggattccgcgaaagctgccgtcgaagacgaggagttttggaaacttgtggatagagaacgggagctgcataaactcggcaagtgtgggtcttgcgtttataacatgatgggaaaacgcgaaaagaaactgggcgagttcgggaaggccaagggcagcagagctatttggtacatgtggcttggagcccggtacctggagtttgaagctctcggcttcctgaatgaggaccactggttttccagagaaaactcttatagcggggtggagggagaaggcctgcataaactcgggtacatcctgcgggatatttccaagatccctggaggcgccatgtatgcggacgatacagccgggtgggacacccgcatcacagaggacgatcttcacaatgaggagaagattacccagcagatggaccccgagcacagactgctcgctaacgccatcttcaagctgacataccaaaataaagtcgtgaaggtccagcggccgacccctacgggcacagtgatggatattatctctcgcaaggaccagagaggaagcggccaggttgggacctatggacttaacacctttacaaatatggaagctcaactggtgcggcagatggagggcgaaggggtcctctccaaagccgatctggagaacccccatctgcccgagaagaaaattacccagtggctcgaaacaaagggagtggagcgcctgaaaagaatggcgatcagcggcgacgattgcgtggttaagcctatcgacgatcggttcgccaacgcccttctggccctcaatgacatggggaaggtgcgcaaagatattccgcagtggcaaccctctaagggctggcacgactggcagcaggtccctttttgttcccatcacttccacgaactgatcatgaaagatggaagaaaacttgtggttccctgccggcctcaggacgagctgattggccgcgctagaatcagccaaggggccggatggtctctccgggaaacggcttgtctgggcaaagcctacgcgcagatgtggtccctgatgtatttccatcgcagagacctccggctggccagcaacgctatttgctctgccgtgcccgtccactgggtgcctacctccagaacaacctggagcatccatgcccaccatcagtggatgacaaccgaggatatgcttacggtctggaatcgcgtgtggattgaggacaacccctggatggaagataagaccccggttacaacctgggagaatgtgccttacctggggaagcgggaagaccaatggtgtggatccctcatcggcctgacaagcagagctacctgggcccagaacatccccacggcgattcagcaggtccgctctcttatcgggaatgaggagtttctggattacatgcctagcatgaaacggttcagaaaggaagaggaactcgagggcgctatttggtga

SEQ ID NO: 20392 - RNA, 9873 nt, synthetic construct
  misc_feature 1..9873: note = derived and/or modified CDS sequence (opt5) from DENV-3__KX380841__SS-prME
  source 1..9873: mol_type = other RNA
accagcctgtgcctcatgatgatcctgcccgcggctcttgccttccacctgacatcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcattaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgttctgaagaaagaggtgtccgaaacccagcacgggacaatcctcattaaggtcgagtacaagggagaagatgccccctgtaaaatccctttcagcaccgaggacggccaagggaaggcgcataacggaagactgattacagctaatcccgtggttaccaaaaaggaggaacccgtgaacatcgaggccgaacctccgttcggcgagtccaatattgtcatcgggatcggcgataacgccctgaaaattaattggtataagaagggatctagcatcggcaaaatgtttgaagctacggccagaggggctagacgcatggccattcttggagacacagcgtgggatttcggctccgtcgggggagtgctcaacagcctgggcaagatggttcaccagatctttgggtctgcctacaccgctctgttctccggcgtcagctgggtgatgaaaattggaatcggcgtgctcctgacctggattgggcttaattctaagaacacaagcatgtccttttcttgcatcgccatcggaattatcaccctgtatctcggcgctgtcgtgcaggccgacatggggtgtgttattaattggaaaggaaaggagctgaagtgcggcagcgggatcttcgtgacaaacgaggtccatacgtggaccgaacagtacaaatttcaagcggattcccccaagcggctggccacagctattgccggcgcttgggagaatggagtgtgtggcatcagaagcaccacacgcatggaaaaccttctctggaaacagatcgccaatgagctgaactatattctgtgggaaaataacatcaagctcaccgttgtggtcggggacacgattggagtgctggagcagggcaaacggacccttacacctcagcccatggagctgaagtactcttggaaaacctgggggaaggccaagatcgttacagctgaaacccaaaactccagcttcattatcgatggacctaatacacccgagtgcccgtctgcgtccagagcctggaacgtgtgggaagtcgaggactatggctttggcgtgttcaccacgaatatctggctcaaactgcgcgaagtgtacacacagatgtgtgaccaccggctgatgagcgctgccgtcaaggatgagagagccgttcacgctgacatggggtactggattgagtcccagaaaaacggatcttggaaacttgaaaaagccagcctcatcgaggtgaagacctgcacctggcctaagtcccatacactgtggtctaatggcgtgctggaaagcgatatgattatccccaaatccctcgcggggcctattagccagcacaactatcgccccggataccatacccaaacggctggcccttggcacctggggaaacttgagctggactttaattattgcgagggaacaaccgtcgtgatcacagaaaactgtggcacccggggcccctctctcagaacaaccacggtttccgggaaactgatccacgagtggtgctgtcgcagctgcaccctgccgcctcttcggtacatgggagaagatggctgttggtatgggatggagattagacccatctctgaaaaggaggagaatatggtgaaatccctcgtcagcgccggatctggcaaggtggacaacttcacaatgggggttctgtgcctggccattctctttgaagaggtgatgcggggaaagttcggcaaaaagcatatgatcgctggcgtcttctttaccttcgtgctgcttctgagcgggcagattacatggcgcgatatggcccacaccctcatcatgattggatccaatgcgagcgacagaatgggcatgggggttacgtacctggctctgatcgccacatttaaaatccagcccttccttgccctgggatttttcctccggaagctgacctctagagaaaacctcctgcttggcgtggggctggctatggccacaaccctccaactgcctgaggatattgaacagatggctaatggaatcgccctgggccttatggcgctgaaactcattacccagtttgagacatatcagctgtggacggccctcatctccctgacctgtagcaacacaattttcacccttacagtcgcttggcgcaccgccacgctgatcctcgctggcgtgtccctgctgccggtgtgccaatctagctccatgcggaagacagactggcttcccatgaccgtcgccgccatgggggttcctcccctgcctctctttatcttctctctgaaggataccctcaaaagacgcagctggcccctgaatgagggagtgatggctgtgggccttgtctccattctggcgtctagcctgctcagaaacgacgtgcctatggccgggcccctggttgctggaggccttctgatcgcctgttacgtgattacagggacctccgccgatctcacagtcgaaaaggctgccgacgtgacgtgggaggaagaggcggaacagaccggagttagccataacctgatgatcacagtggacgatgacggcaccatgcggattaaagatgacgagacagagaatatcctcaccgtcctgcttaagacggctctgctgatcgtgtctggcatttttccgtactccatccctgccaccctcctggtctggcacacatggcagaaacagacccaacgcagcggggtgctttgggatgttccctctcctcccgaaacacagaaggccgagctggaagagggagtgtatagaattaaacagcagggcatcctcgggaagacccaagtcggagtgggcgttcagaaggacggggtgttccatacaatgtggcacgtcacgcggggagctgtgctgacccacaacggcaaacgcctcgagccgaattgggcctccgtgaagaaagatctgattagctacggcgggggatggagactttctgcgcagtggcaaaagggcgaagaggttcaggtcatcgctgtggaacctgggaaaaaccccaagaattttcagacaatgcctggaaccttccagaccacaacgggcgagattggggccatcgccctggacttcaagcccggaacctccggcagccccatcattaaccgggaaggcaaagtggtcgggctgtatggaaatggcgtggttacaaagaacgggggatacgtgtccggcatcgctcaaaccaatgccgagcctgatgggccgacacccgagctcgaagaggaaatgtttaaaaagcgcaacctgaccattatggaccttcatcctggcagcggaaaaacgagaaagtatctgcccgctatcgtccgggaggccattaagcgcagactccggacactgatcctcgcgcctaccagagtggttgccgctgaaatggaggaggccctgaaaggccttcccatccgctaccagaccacagctaccaagtctgaacacacagggcgggagattgtggatctgatgtgccatgccaccttcacgatgagactgctcagccctgtccgcgtgccgaattataacctgatcattatggacgaagcccactttacagatcccgcttccatcgcggcccggggatacatttctaccagagttggcatgggggaggctgccgccatcttcatgacagctacccctcccggaacggccgacgcgtttcctcagagcaatgctcccatccaggacgaggaacgcgatattccggagcggtcctggaactctggcaatgaatggatcaccgacttcgccgggaaaacagtgtggtttgtccctagcattaaggccggcaacgatatcgctaactgtcttcgcaaaaatggaaagaaggtgattcaactgtccagaaaaaccttcgacacagagtaccagaagaccaaactcaacgattgggactttgtggtcacaaccgatatctctgaaatgggcgccaatttcaaggcggaccgggttattgatcccagacggtgcctgaaacccgtgatcctgacggacgggcctgagcgcgtgatcctcgccggacccatgcctgtcacagctgccagcgctgcccagagacggggccgcgtggggagaaacccgcagaaggagaatgatcaatatatttttaccggacagccccttaacaatgacgaagaccatgctcactggaccgaggccaagatgctgctggataacatcaatacacctgaaggcattatccccgccctcttcgagcctgaacgggagaaatccgccgctattgacggggagtacagactgaagggcgaaagccgcaaaaccttcgttgagcttatgcggagaggagatctgcccgtgtggctcgcccacaaggtcgcttctgaaggcatcaaatatacagaccgcaagtggtgctttgatgggcagcggaacaatcagatcctggaggaaaacatggacgtggagatttggacgaaagagggagaaaagaagaaactgagaccgcgctggctcgatgcccggacctactccgaccctcttgccctgaaggagttcaaagattttgctgcgggcagaaagagcatcgccctggacctcgttacagaaattgggcgcgtgccctctcatctggctcacagaacccggaatgcccttgataacctggtcatgctccatacatccgagcacggaggccgcgcctatagacacgctgtggaagaactccctgagaccatggaaacgctgctccttctgggcctgatgatcctcctgaccgggggagccatgcttttcctgattagcggcaaagggatcggaaagacatccatcggcctcatttgtgtcatcgcgtctagcgggatgctgtggatggccgagattcccctgcaatggatcgcttccgccattgtgctcgaatttttcatgatggttcttctgatccctgagcccgagaagcagcggaccccgcaggacaatcaactggcttacgtggtgattggaatcctcacaatggccgcgatcattgccgctaacgaaatgggcctgcttgagaccacgaaacgcgatctgggcatgagcaaggaacctggggtcgtttctcccacatcctatctcgacgtggacctgcatcccgccagcgcttggaccctgtacgccgtggctacaaccgtcatcacccctatgctcagacacacaattgaaaattctacggccaacgtgagccttgcggccatcgctaaccaggccgttgtgctgatgggactggataaaggctggccgatttccaagatggacctcggggtccccctgcttgctctgggatgctactctcaggtgaatcctctcaccctgacagccgccgtcctgctccttgtgacccattatgcgatcatcggccccgggctgcaggctaaagccacacgggaagctcaaaagagaaccgccgccggaattatgaagaaccctacggttgatggcatcattacaatcgacctggatcccgtgatttacgacagcaaatttgagaagcagctcggccaggtcatgctgcttgtgctgtgtgctgttcagctcctgctgatgcgcacctcctgggccctctgcgaggcgcttaccctggccacagggcctatcaccacactgtgggaaggatctccgggcaaattctggaatacgaccatcgctgtgagcatggccaacatttttcgggggtcctatctcgctggagccggcctggcgttcagcatcatgaagtctgtcgggacaggaaaaagaggcaccggctcccaaggggagacacttggagaaaagtggaagaaaaagctgaatcagctcagccgcaaagagtttgatctgtacaagaaatccggcattaccgaagtggaccggacggaggccaaggaggggctgaaaagaggagaaaccacacaccatgctgtgtctcggggcagcgccaagctccagtggttcgttgagcgcaacatggtcatccccgaagggagagtgattgatcttggatgtggccggggcgggtggtcctattactgcgctggactgaagaaagtgaccgaggtccgcggctatacaaaagggggacctggccacgaggagcccgttcctatgtctacctacgggtggaatatcgtgaaactgatgagcggaaaggacgtgttttacctgcccccggagaaatgtgatacactgctttgcgacattggcgaatccagcccttctcccaccgtcgaggaatccagaacgatccgggtgctgaagatggttgagccctggctcaagaacaatcagttctgtatcaaagtgctgaacccttatatgcccgccgtcattgagcacctggaacgcctccaaagaaagcatggcgggatgcttgtgcggaatcctctgagccgcaactctacacacgagatgtactggatctccaatggaaccggcaacattgttagctctgtgaatatggtcagcagactgctcctgaaccggttcaccatgacacatagacgcccgacgatcgaaaaagatgtggaccttggggctggaacccggcacgtgaacgccgagcccgaaacacctaatatggacgtcattggcgagagaatcaagcgcatcaaagaggaacacaactccacctggcattatgatgacgagaatccctacaagacatgggcgtatcacgggtcttacgaagttaaggccaccggaagcgcttccagcatgattaacggcgtggtgaaactgctcacaaagccttgggatgtcgtgcccatggttacccagatggccatgacggacaccacaccgtttggccagcaacgggtgttcaaagagaaggtcgataccagaacacctcgccccatgcctgggacccggaaagtgatggaaatcacggctgagtggctgtggagaacactgggacgcaataagcggcccagactctgcacccgcgaggaatttacaaagaaagttcggaccaacgccgccatgggcgcggtgttcacggaggaaaatcagtgggactccgctaaggccgccgtcgaggatgaagagttttggaaactggtggacagagagcgcgaacttcataagctggggaaatgtggatcttgcgtttataacatgatgggcaagagagagaaaaagctcggggagttcggcaaggctaaaggaagccgggccatttggtacatgtggctgggcgctcgctaccttgagtttgaggccctggggttcctcaatgaagatcactggttttccagagagaactcttatagcggagtggaaggcgaggggctgcataagctgggatacatcctccgggacatttccaaaatccctggcggggcgatgtatgccgatgacaccgctggctgggacacaagaatcaccgaagatgacctgcacaatgaggagaagattacacagcagatggatcccgaacaccggcttctggccaacgctatcttcaaactcacctaccaaaataaggtcgtgaaggtccagcgcccgacacctaccggaacggtgatggacattatctctagaaaagatcagcggggcagcgggcaggttggaacatatggcctgaacacctttaccaatatggaggcccaacttgtgcgccagatggaaggggagggagtcctgtccaagacagacctcgaaaacccccatctgcccgagaaaaagattacccagtggctggagacaaaaggcgtggaaagactcaagcggatggcgatcagcggggatgactgcgtggttaagcctatcgatgaccgcttcgccaacgctctgcttgccctgaatgatatgggcaaagtgagaaaggacattccgcagtggcaaccctctaaaggatggcacgattggcagcaggtccctttttgttcccatcacttccacgagctcatcatgaaggacggccggaaactggtggttccctgccgccctcaggacgaacttattgggagagctcggatcagccaaggagccggctggtctctgcgcgagacggcttgtctcgggaaggcctacgcgcagatgtggtccctgatgtatttccatagacgggatctgcgcctcgccagcaacgctatttgctctgccgtgcccgtccactgggtgcctacctccagaacaacctggagcatccatgcccaccatcagtggatgacaaccgaagacatgctgacggtctggaatcgggtgtggattgaggataacccctggatggaggacaagaccccgatcacaacctgggaaaatgttccttaccttggaaaaagagaggatcaatggtgtggctccctgatcgggctcacaagccgcgctacctgggcccagaacattcccacggcgatccaacaggtgcggtctctgattggcaatgaagagtttcttgactacatgcctagcatgaagagattccgcaaagaggaagagtccgaaggagctatctggtga

SEQ ID NO: 20393 - RNA, 9873 nt, synthetic construct
  misc_feature 1..9873: note = derived and/or modified CDS sequence (opt5) from DENV-3__KX380842__SS-prME
  source 1..9873: mol_type = other RNA
accagcctgtgcctcatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcattaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgttctgaagaaagaggtgtccgaaacccagcacgggacaatcctcattaaggtcgagtacaagggagaagatgccccctgtaaaatccctttcagcaccgaggacggccaagggaaggcgcataacggaagactgattacagctaatcccgtggttaccaaaaaggaggaacccgtgaacatcgaggccgaacctccgttcggcgagtccaatattgtcatcgggatcggcgataacgccctgaaaattaattggtataagaagggatctagcatcggcaaaatgtttgaagctacggccagaggggctagacgcatggccattcttggagacacagcgtgggatttcggctccgtcggcggggtgctcaacagcctggggaagatggttcaccagatctttgggtctgcctacaccgctctgttctccggcgtcagctgggtgatgaaaattggaatcggcgtgctcctgacctggattgggcttaattctaagaacacaagcatgtccttttcttgcatcgccatcggaattatcaccctgtatctcggcgctgtcgtgcaggccgacatggggtgtgttattaattggaaaggaaaggagctgaagtgcggcagcgggatcttcgtgacaaacgaggtccatacgtggaccgaacagtacaaatttcaagcggattcccccaagcggctggccacagctattgtgggcgcctgggagaatggagtttgtggcatcagaagcaccacacgcatggaaaaccttctctggaaacagatcgctaatgagctgaactatattctgtgggaaaataacatcaagctcaccgtggtcgtgggggacacgattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgcttccagagcgtggaacgtctgggaagtggaggactatggctttggcgtgttcaccacgaatatctggctcaaactgcgcgaagtctacacacagatgtgtgaccaccggctgatgagcgccgctgttaaggatgagagagccgtgcacgccgacatggggtactggattgagtcccagaaaaacggatcttggaaacttgaaaaagctagcctcatcgaggtgaagacctgcacctggcctaagtcccatacactgtggtctaatggcgtcctggaaagcgatatgattatccccaaatccctcgccgggcctattagccagcacaactatcgccccggataccatacccaaacggcgggcccttggcacctggggaaacttgagctggactttaattattgcgagggaacaaccgtggttatcacagaaaactgtggcacccggggcccctctctcagaacaaccacggtgtccgggaaactgatccacgagtggtgctgtcgcagctgcaccctgccgcctcttcggtacatgggagaagatggctgttggtatgggatggagattagacccatctctgaaaaggaggagaatatggtcaaatccctcgtgagcgctggatctggcaaggttgacaacttcacaatgggggtgctgtgcctggccattctctttgaagaggtcatgcggggaaagttcggcaaaaagcatatgatcgccggcgtgttctttaccttcgttctgcttctgagcgggcagattacatggcgcgatatggctcacaccctcatcatgattggatccaatgccagcgacagaatgggcatgggggtgacgtacctggcgctgatcgctacatttaaaatccagcccttccttgccctgggatttttcctccggaagctgacctctagagaaaacctcctgcttggcgtcgggctggccatggctacaaccctccaactgcctgaggatattgaacagatggccaatggaatcgctctgggccttatggccctgaaactcattacccagtttgagacatatcagctgtggacggcgctcatctccctgacctgtagcaacacaattttcacccttacagtggcctggcgcaccgctacgctgatcctcgccggcgtgtccctgctgccggtctgccaatctagctccatgcggaagacagactggcttcccatgaccgttgctgccatgggggtgcctcccctgcctctctttatcttctctctgaaggataccctcaaaagacgcagctggcccctgaatgagggagtgatggccgtcggccttgtgtccatgctggcttctagcctgctcagaaacgacgttcctatggcggggcccctggtggccggaggccttctgattgcttgttacgtcatcacagggacctccgccgatctcacagtggaaaaggccgctgacgttacgtgggaggaagaggccgaacagaccggagtgagccataacctgatgattacagtcgacgatgacggcaccatgcggatcaaagatgacgagacagagaatattctcaccgtgctgcttaagacggcgctgctgatcgtctctggcatctttccgtactccattcctgctaccctcctggtgtggcacacatggcagaaacagacccaacgcagcggggttctttgggatgtgccctctcctcccgaaacacagaaggccgagctggaagagggagtctatagaatcaaacagcagggcattctcgggaagacccaagtgggagttggcgtgcagaaggacggggtcttccatacaatgtggcacgtgacgcggggagccgtgctgacccacaacggcaaacgcctcgagccgaattgggcttccgttaagaaagatctgatcagctacggcgggggatggagactttctgcccagtggcaaaagggcgaagaggtccaggtgattgcggtggaacctgggaaaaaccccaagaattttcagacaatgcctggaaccttccagaccacaacgggcgagatcggggctattgccctggacttcaagcccggaacctccggcagccccatcatcaaccgggaaggcaaagtcgtggggctgtatggaaatggcgttgtgacaaagaacgggggatacgtctccggcattgcccaaaccaatgctgagcctgatgggccgacacccgagctcgaagaggaaatgtttaaaaagcgcaacctgaccatcatggaccttcatcctggcagcggaaaaacgagaaagtatctgcccgccattgtgcgggaggctatcaagcgcagactccggacactgattctcgcccctaccagagttgtggcggccgaaatggaggaggctctgaaaggccttcccatccgctaccagaccacagccaccaagtctgaacacacagggcgggagatcgtcgatctgatgtgccatgctaccttcacgatgagactgctcagccctgtgcgcgttccgaattataacctgattatcatggacgaagcccactttacagatcccgcctccattgctgcgcggggatacatctctaccagagtgggcatgggggaggccgctgccattttcatgacagccacccctcccggaacggctgacgcctttcctcagagcaatgcgcccatccaggacgaggaacgcgatatcccggagcggtcctggaactctggcaatgaatggattaccgacttcgctgggaaaacagtctggtttgtgcctagcatcaaggccggcaacgatattgccaactgtcttcgcaaaaatggaaagaaggtgatccaactgtccagaaaaaccttcgacacagagtaccagaagaccaaactcaacgattgggactttgtcgttacaaccgatatttctgaaatgggcgctaatttcaaggccgaccgggtgatcgatcccagacggtgcctgaaacccgtgattctgacggacgggcctgagcgcgtcatcctcgcgggacccatgcctgtgacagccgctagcgccgctcagagacggggccgcgttgggagaaacccgcagaaggagaatgatcaatatatctttaccggacagccccttaacaatgacgaagaccatgcccactggaccgaggctaagatgctgctggataacattaatacacctgaaggcatcattcccgccctcttcgagcctgaacgggagaaatccgcggccatcgacggggagtacagactgaagggcgaaagccgcaaaaccttcgtggagcttatgcggagaggagatctgcccgtctggctcgctcacaaggtggcctctgaaggcattaaatatacagaccgcaagtggtgctttgatgggcagcggaacaatcagatcctggaggaaaacatggacgttgagatctggacgaaagagggagaaaagaagaaactgagaccgcgctggctcgatgctcggacctactccgaccctcttgccctgaaggagttcaaagattttgccgctggcagaaagagcattgcgctggacctcgtgacagaaatcgggcgcgtcccctctcatctggcccacagaacccggaatgctcttgataacctggtgatgctccatacatccgagcacggaggccgcgcctatagacacgccgtcgaagaactccctgagaccatggaaacgctgctccttctgggcctgatgattctcctgaccgggggagctatgcttttcctgatcagcggcaaagggattggaaagacatccatcggcctcatctgtgtgattgcctctagcgggatgctgtggatggcggagatccccctgcaatggattgcctccgctatcgttctcgaatttttcatgatggtgcttctgattcctgagcccgagaagcagcggaccccgcaggacaatcaactggcctacgtggtcatcggcattctcacaatggctgccatcatcgcggccaacgaaatgggcctgcttgagaccacgaaacgcgatctgggcatgagcaaggaacctggggttgtgtctcccacatcctatctcgacgtggacctgcatcccgctagcgcctggaccctgtacgctgtcgccacaaccgtgattacccctatgctcagacacacaatcgaaaattctacggctaacgttagccttgccgcgattgccaaccaggctgtggtcctgatgggactggataaaggctggccgatctccaagatggacctcggggtgcccctgcttgccctgggatgctactctcaggtcaatcctctcaccctgacagctgccgtgctgctccttgttacccattatgccattatcggccccgggctgcaggcgaaagctacacgggaagcccaaaagagaaccgctgccggaatcatgaagaaccctacggtggatggcattatcacaattgacctggatcccgtcatctacgacagcaaatttgagaagcagctcggccaggtgatgctgcttgttctgtgtgccgtgcagctcctgctgatgcgcacctcctgggctctctgcgaggcccttaccctggcgacagggcctattaccacactgtgggaaggatctccgggcaaattctggaatacgaccatcgccgtcagcatggctaacatctttcgggggtcctatctcgccggagctggcctggccttcagcattatgaagtctgtggggacaggaaaaagaggcaccggctcccaaggggagacacttggagaaaagtggaagaaaaagctgaatcagctcagccgcaaagagtttgatctgtacaagaaatccggcatcaccgaagtggaccggacggaggcgaaggaggggctgaaaagaggagaaaccacacaccatgccgtttctcggggcagcgctaagctccagtggttcgtcgagcgcaacatggtgattcccgaagggagagtgatcgatcttggatgtggccggggcgggtggtcctattactgcgccggactgaagaaagtcaccgaggttcgcggctatacaaaagggggacctggccacgaggagcccgtgcctatgtctacctacgggtggaatattgtgaaactgatgagcggaaaggacgtcttttacctgcccccggagaaatgtgatacactgctttgcgacatcggcgaatccagcccttctcccaccgtggaggaatccagaacgattcgggttctgaagatggtggagccctggctcaagaacaatcagttctgtatcaaagtcctgaacccttatatgcccgctgtgatcgagcacctggaacgcctccaaagaaagcatggcgggatgcttgttcggaatcctctgagccgcaactctacacacgagatgtactggatttccaatggaaccggcaacatcgtgagctctgtcaatatggtgagcagactgctcctgaaccggttcaccatgacacatagacgcccgacgattgaaaaagatgtggaccttggggccggaacccggcacgtcaacgctgagcccgaaacacctaatatggacgttatcggcgagagaattaagcgcatcaaagaggaacacaactccacctggcattatgatgacgagaatccctacaagacatgggcctatcacgggtcttacgaagtgaaggcgaccggaagcgcctccagcatgatcaacggcgtggtcaaactgctcacaaagccttgggatgtggttcccatggtgacccagatggctatgacggacaccacaccgtttggccagcaacgggtcttcaaagagaaggtggataccagaacacctcgccccatgcctgggacccggaaagttatggaaattacggccgagtggctgtggagaacactgggacgcaataagcggcccagactctgcacccgcgaggaatttacaaagaaagtgcggaccaacgctgccatgggcgccgtcttcacggaggaaaatcagtgggactccgcgaaggctgccgtggaggatgaagagttttggaaactggttgacagagagcgcgaacttcataagctggggaaatgtggatcttgcgtgtataacatgatgggcaagagagagaaaaagctcggggagttcggcaaggccaaaggaagccgggctatctggtacatgtggctgggcgcccgctaccttgagtttgaggctctggggttcctcaatgaagatcactggttttccagagagaactcttatagcggagtcgaaggcgaggggctgcataagctgggatacattctccgggacatctccaaaattcctggcggggccatgtatgcggatgacaccgccggctgggacacaagaatcaccgaagatgacctgcacaatgaggagaagatcacacagcagatggatcccgaacaccggcttctggctaacgccattttcaaactcacctaccaaaataaggtggtcaaggtgcagcgcccgacacctaccggaacggttatggacatcatttctagaaaagatcagcggggcagcggacaggtgggaacatatggcctgaacacctttaccaatatggaggctcaacttgtccgccagatggaaggggagggagtgctgtccaagacagacctcgaaaacccccatctgcccgagaaaaagatcacccagtggctggagacaaaaggcgtggaaagactcaagcggatggccattagcggggatgactgcgttgtgaagcctatcgatgaccgcttcgcgaacgccctgcttgctctgaatgatatgggcaaagtcagaaaggacatcccgcagtggcaaccctctaaaggatggcacgattggcaacaggtgcctttttgttcccatcacttccacgagctcattatgaaggacggccggaaactggttgtgccctgccgccctcaggacgaacttatcgggagagcccggattagccaaggagctggctggtctctgcgcgagacggcctgtctcgggaaggcttacgcccagatgtggtccctgatgtatttccatagacgggatctgcgcctcgcgagcaacgccatctgctctgctattcccgtccactgggtgcctacctccagaacaacctggagcatccatgcccaccatcagtggatgacaaccgaagacatgctgacggtctggaatcgggtgtggattgaggataacccctggatggaggacaagaccccgatcacaacctgggaaaatgttccttaccttggaaaaagagaggatcaatggtgtggctccctgatcgggctcacaagccgcgccacctgggctcagaacattcccacggccatccaacaggtgcggtctctgattggcaatgaagagtttcttgactacatgcctagcatgaagagattccgcaaagaggaagagtccgaaggagcgatctggtga

SEQ ID NO: 20394 - RNA, 9873 nt, synthetic construct
  misc_feature 1..9873: note = derived and/or modified CDS sequence (opt5) from DENV-3__KX380839__SS-prME
  source 1..9873: mol_type = other RNA
accagcctgtgcctcatgatgatgctgcccgccacccttgctttccacctgacgtcccgggacggcgaacctcggatgattgtggggaagaacgaacgcggaaagtctctcctgtttaagaccgccagcggcattaatatgtgtacacttatcgcgatggatctgggggagatgtgcgacgataccattacatacaaatgtcccctcatcaccgaagtggagcccgaagacattgattgctggtgtaacctgacatccacctgggttacgtatggaacctgcaatcaggctggcgagcatagacgggacaagcgctctgtggccctggcccctcacgtggggatgggactcgatacaagagctcaaacctggatgagcgccgagggcgcttggcggcaggtcgaaaaagtggagacatgggccttccgccatcccggctttaccatcctggcgcttttcctggcccactacatcgggacgtccctcacacagaaggttgtgatttttatcctgcttatgctggtcaccccttctatgacaatgagatgtgtgggagttggcaaccgggacttcgtggaagggctcagcggagctacctgggtcgatgtggtgctggagcatggcgggtgcgtcaccacaatggccaagaataaacccacgctggacattgagctccagaagaccgaagctacacaactggccacccttcgcaaactgtgtatcgagggaaagattacaaacgttaccacggattccagatgccctacacagggcgaagcgaccctcccggaggaacaggaccagaattatgtgtgtaaacacacctacgtggatcggggctgggggaacggatgcggcctgtttgggaagggaagccttgtcacatgcgccaagttccaatgtctggagctcaccgagggcaaagtggttcagcacgaaaatctgaagtatacagtgatcattacggtccataccggggaccagcaccaggtgggaaacgagacacaaggcgttaccgctgaaatcacaccccaggcctctaccgtggaggctatctttcgctcctacggcacgctggggctcgaatgcagccctagaaccggactggacttcaatgagatgattcttctgacaatgaaaaacaaggcctggatggtccatcggcagtggtttttcgatctccccctgccttggacctctggcgccacaaccgagacgcccacatggaataaaaaggaacttctggtgacctttaaaaacgctcacgcgaagaagcaagaggtcgtggttctcgggtcccaggaaggagccatgcacacagctctgaccggcgccaccgagatccagacaagcgggggcacgtctattttcgccggacatctgaaatgtcgcctcaagatggacaaactggaacttaagggcatgtcctatgctatgtgcagcaatgccttcgtgctgaaaaaggaggtctccgagacccagcacgggacaatcctcattaaggtggaatacaaaggagaggatgcgccgtgtaagatccctttttctaccgaagacggccaagggaaagctcataacggaagactgatcacagccaaccccgttgtgaccaagaaagaggagcctgtcaatattgaagccgagccgcccttcggcgaaagcaacatcattatcgggattggcgataaggctctgaagatcaattggtacaaaaagggatccagcatcggcaaaatgtttgaggccacggctagaggggccagacgcatggcgattcttggagacacagcctgggatttcggctctgtcggcggggtgctcaactccctggggaagatggttcaccagatctttgggagcgcttataccgccctgttctctggcgtcagctggattatgaaaatcggaattggcgtgctcctgacctggatcgggcttaattccaagaacacatctatgagcttttcctgcattgtgatcggaatcattaccctgtacctcggcgctgtcgtgcaggccgacatggggtgtgttatcaattggaagggaaaagaactgaagtgcggcagcgggattttcgtgacaaacgaggtccatacgtggaccgagcagtataaatttcaagcggattctcctaagcggctggccacagctatcgccggcgcttgggaaaatggagtgtgtggcattagatccaccacacgcatggagaaccttctctggaaacagatcgccaatgaactgaactacatcctgtgggagaataacattaagctcaccgttgtggtcggggacatcattggaatcctggaacagggcaaacggacgcttaccccgcagcccatggagctgaagtatagctggaagacatgggggaaagccaagattgtgaccgctgagacacaaaattcttccttcatcatcgatggacctaacacccccgaatgccctaacgcgagcagagcctggaatgtttgggaggtggaagactacggctttggcgtcttcacaaccaacatttggctcaaactgcgcgagatgtatacgcagctgtgtgaccaccggcttatgtccgctgccgtgaaggatgaaagagccgtgcacgctgacatggggtactggatcgagtctcagaaaaatggaagctggaagctcgagaaggcctccctgattgaagtcaaaacatgcacctggcccaagtctcataccctgtggagcaacggcgttctcgagtccgatatgatcattccgaaaagcctggcggggcctatctctcagcacaattaccgccccggatatcatacacaaaccgctggcccttggcaccttgggaagctggaactcgactttaactactgcgagggaacgacagtggtgatcaccgagaattgtggcacacggggcccctccctgagaaccacaaccgtcagcgggaaactgattcacgaatggtgctgtcgctcttgcacgcttcctcccctccggtatatgggagaggatggctgttggtacgggatggaaatcagaccgattaacgagaaggaagagaatatggtgaagtccctggttagcgccggatctggcaaagtggacaacttcaccatgggggtcctgtgcctcgccatcctgttcgaggaagtgatgcggggaaagtttggcaaaaagcatatgattgctggcgttcttttcacatttgtgctgctcctgagcgggcagatcacctggcgcgatatggccagaacactgattatgatcggatccaatgcgagcgaccggatgggcatgggggtcacctatcttgctctgatcgccacgttcaaaattcagccttttctcgccctgggattctttctcagaaagctgacatctcgcgagaaccttctgctcggcgtggggctggctatggccaccacactgcaacttcccgaagatatcgagcagatggctaatggaattgccctgggcctcatggcgctgaagctcatcacccagttcgaaacctaccagctgtgggccgctcttgtttccctgatgtgtagcaacacaatttttacgctcaccgtggcctggcggacagctaccctgatcctggccggcatctcccttctgcccatgtgccaatctagctccatgagaaaaacagactggctccctatgaccgtcgccgctatgggggtgccgcccctgcctctcttcatcttttctctgaaggatacgcttaaacgcagaagctggcccctgaatgagggagtgatggcggtcggcctggtttccatcctcgcctctagcctgcttcggaacgacgtgcctatggctgggcccctggtggccggaggcctcctgattgcctgttatgtcatcacagggacctccgctgatctcaccgtggagaaggccgcggacgttacatgggaagaggaagctgagcagaccggagtgagccacaacctgatgattacagtcgacgatgacggcacgatgcgcatcaaagatgacgaaaccgagaatatccttacagtgctgctgaagaccgccctcctgattgtttctggcatcttcccttactccattcccgccacacttctggtgtggcatacctggcagaaacagacgcaaagaagcggggtcctctgggatgtgccgtctcctcccgagacccagaaggctgaactggaggaaggagtctaccggatcaagcagcagggcatttttgggaaaacacaagtgggagttggcgtgcagaaggagggggtcttccacaccatgtggcatgtgacacgcggagccgttctcacccacaacggcaaaagactggagcctaattgggcgtccgtgaagaaagaccttatcagctatggcgggggatggcggctgtctgctcagtggcaaaagggcgaagaggtccaggtgattgccgtggaacccgggaagaacccgaaaaatttccagacaatgcctggaatctttcagacgaccacaggcgagatcggggccattgctctggatttcaagcccggaacctccggcagccctatcattaaccgcgaaggcaaagttgtcgggctctacggaaatggcgtggtgaccaagaacgggggatatgtctccggcatcgcccaaacaaatgctgagcccgacgggcccacgcctgagctggaagaggaaatgtttaaaaagagaaaccttaccattatggatctgcacccgggcagcggaaagacacggaaatacctccccgccatcgtgcgcgaggcgatcaagagacggctgagaaccctcattctggcccctacacgcgttgtggctgccgaaatggaggaggctcttaaaggcctgcccatccggtatcagaccacggccacaaagtctgaacataccgggaaagagattgtcgacctgatgtgccacgccaccttcacaatgagactcctgagccctgtgcgcgttcccaattacaaccttatcattatggatgaagctcattttaccgaccctgcgtccatcgccgctcggggatatatctctacaagagtgggcatgggggaggccgccgctattttcatgaccgccacgccgcccggaacagcggaggcttttcctcagagcaatgcccccatccaggatgaggagcgcgacattcctgaacggtcctggaactctggcaatgactggatcaccgatttcgccgggaagacagtctggtttgtgcccagcattaaggctggcaacgacatcgccaactgtctgcgcaaaaatggaaagaaagttattcaactctccagaaagaccttcgatacggagtaccagaaaaccaagctgaacgactgggattttgtggtcacaaccgacatctctgaaatgggcgcgaatttcaaggccgatcgggtgatcgacccgagacggtgcctgaaacctgtgattctcacagatgggcccgagcgcgtcatccttgctggacccatgcctgttaccgtggccagcgctgcccagagacggggccgcgtggggagaaacccccagaaggagaatgaccaatacattttcacaggacagcctctgaacaatgatgaagaccacgctcattggaccgaggccaaaatgctgctcgacaacatcaatacgccggaaggcattatccccgcgctgtttgagcctgaacgggagaagtccgccgctatcgatggggagtatagacttaaaggcgaaagccgcaagacattcgtcgagctgatgcggagaggagacctccccgtgtggctggcccacaaagttgcttctgaaggcattaagtacaccgatcgcaagtggtgctttgacggggagcggaacaatcagatcctggaagagaacatggatgtggagatttggaccaaagaaggagagaagaaaaagctcagacctcgctggcttgacgcccggacatattccgatcccctggccctgaaagagttcaaggactttgctgcgggcagaaagagcatcgccctcgatctggtcaccgagattgggcgcgtgccgcctcaccttgctcatagaacacggaatgccctggacaacctcgttatgctgcacacgtctgaatacggaggccgcgcctatagacatgctgtggaggagctgcccgaaaccatggagacactccttctgctgggcctcatgatcctgcttaccgggggagtcatgctgttcctcatctccggcaaaggggtgggaaagacaagcattggcctgatctgtgtcgtggcctcctctgggatgctgtggatggcggatattcctctccagtggatcgccagcgctattgttcttgaatttttcatgatggtgctgctgatccccgagcctgagaaacaacggacaccccaggacaatcagctcgcctacgtggtcattggaatcctgacgcttgctgccatcgttgcggccaacgaaatgggcctgctcgagaccacaaagcgcgatctgggcatgtccaaagaaccgggggtggtgagccctacctcttatctggacgtcgacctccaccccgcttccgcctggacactttacgctgtggccaccacggttattacacccatgctgagacacaccatcgagaatagcacagctaacgtgtctctggccgcgattgccaaccaagctgtcgtgctcatgggactggataagggctggcctatcagcaagatggaccttggggtcccgctgctcgccctgggatgctactcccaggtgaatcccctgaccctcaccgctgccgttcttctgctggtgacacattatgccattatcggccctgggctccaggcgaaagctacgcgggaagcccagaagagaaccgctgccggaatcatgaaaaaccccacagtcgatggcattatgaccatcgacctggatcctgtgatttacgactctaagtttgagaaacaacttggccaggttatgctgctcgtgctgtgtgccgtccagctgctccttatgcgcacaagctgggctttctgcgaggccctgaccctggcgacggggcccatcacaaccctctgggaaggatcccctggcaagttttggaataccacaattgccgtgtctatggctaacatcttccgggggagctatctggccggagctggccttgccttttccatcatgaaaagcgtggggaccggaaaaagaggcacaggctctcagggggagacgctgggagaaaagtggaaaaagaaactcaatcaactgtcccgcaaggagttcgatctgtacaaaaagagcggcattaccgaagttgaccggacagaggcgaaggaggggctcaaaagaggagaaatcacccaccatgccgtctcccggggctctgctaaacttcagtggttcgtggagcgcaacatggtgattccggaagggagagtcatcgatctgggatgtggccggggcgggtggagctattactgcgccggactgaaaaaggttacagaggtgcgcggctataccaaagggggacccggccacgaagaacctgtgcccatgtccacgtacgggtggaatattgtcaagctcatctctggaaaggacgtgttttacctgcctcccgagaaatgtgatacccttctgtgcgacattggcgaaagctccccgagccctacagttgaggaatctagaaccatccgggtgctcaagatggtcgagccctggctgaaaaacaatcagttctgtatcaaggtgctgaacccctatatgcctgctgttattgagcatctcgaacgccttcagagaaaacacggcgggatgctggtgcggaatcccctgtcccgcaacagcacacacgagatgtactggatctctaatggaaccggcaacattgtctccagcgtgaatatgatctctagactcctgcttaaccggtttacaatgacctatagacgccctacgattgaaaaggatgtggacctgggggccggaacacggcatgtcaacgctgagccggaaacccccaatatggacgttatcggcgagagaatccgccggattaaggaggaacacagctccacctggcattacgatgacgagaacccttataaaacatgggcctaccacgggtcttatgaagtgaaggcgacgggaagcgcctccagcatgatcaatggcgtggtcaaactcctgaccaagccctgggatgtggttcctacagtgacccaaatggctatgacagacaccacacccttcggccagcagagagtctttaaagagaaggtggatacccgcacgccgaagcctatgcccgggacccggaaagttatggaaattacagccgagtggctgtggagaaccctcggacgcaacaagcggcctagactgtgcacacgcgaggagttcaccaaaaaggtgcggacgaatgctgccatgggcgccgtctttacagaggaaaaccaatgggactccgcgagagctgccgtggaggatgaagagttctggaaacttgttgaccgcgagagagaactgcacaagctcgggaaatgtggatcttgcgtgtacaatatgatgggcaagcgggagaagaaactgggggaatttggcaaggccaaaggaagccgcgctatctggtacatgtggcttggcgccagatatctggagttcgaggctctcgggtttctgaacgaagatcattggttctcccgggaaaattcttacagcggagtcgaaggcgaggggctgcacaagctcggatatattctgagagacatctccaaaatccccggcggggccatgtacgcggatgacaccgccggctgggacacacggattaccgaagatgaccttcataacgaggagaagatcacgcagcagatggatcctgaacaccgccagctggctaatgccatttttaagctcacctatcaaaacaaagtggtcaaggtgcagagacccacaccgaaaggaaccgttatggacatcatttctcggaaggatcagcgcggcagcggacaggtgggaacatacggcctgaataccttcacaaacatggaggctcaacttatcagacagatggaaggggagggagtcctgtccaaaaccgacctcgaaaatcctcatctgctggagaagaagatcacgcagtggctcgagacaaaaggcgtggaacggctgaagcgcatggccattagcggggatgactgcgtggttaaacccatcgatgacagattcgcgaacgcccttctggctctcaacgatatgggcaaggtgcggaaagacattccccagtggcaaccttctaagggatggcacgattggcagcaggtcccgttttgttcccaccatttccacgagctgatcatgaaggacggccgcaaacttgtggttccctgcagacctcaggacgaactgattgggcgggcccgcatcagccaaggagctggctggtctctcaaggagaccgcctgtctggggaaggcttatgcccagatgtgggcgctgatgtactttcatagacgggatctccgcctggcctccaatgctatttgcagcgccgtgcccgtccactgggtgcctacctctagaacaacctggtccatccacgcccatcaccagtggatgacaacggaagacatgcttaccgtctggaaccgggtgtggatcgaggataatccctggatggaggacaagacacctgttaccacatgggaagatgtgccctacctgggaaaaagagaggaccaatggtgtggcagcctcattgggctgacctcccgcgctacgtgggcccagaacatccttaccgcgattcagcaggtccggagcctgatcggcaatgaagagttcctcgattatatgccgtctatgaagagatttcgcaaggaggaagagagcgaaggagctatttggtga

SEQ ID NO: 20395 - RNA, 9873 nt, synthetic construct
  misc_feature 1..9873: note = derived and/or modified CDS sequence (opt5) from DENV-3__KX380840__SS-prME
  source 1..9873: mol_type = other RNA
accagcctctgcctcatgatgatgctgcccgccacccttgctttccacctgacgtcccgggacggcgagcctcggatgattgtggggaagaacgaacgcggaaagtctctcctgtttaagaccgccagcggcattaatatgtgtacacttatcgcgatggatctgggggagatgtgcgacgataccattacatacaaatgtcccctcatcaccgaagtggagcccgaagacattgattgctggtgtaacctgacatccacctgggttacgtatggaacctgcaatcaggctggcgagcatagacgggacaagcgctctgtggccctggcccctcacgtggggatgggactcgatacaagagctcaaacctggatgagcgccgagggcgcttggcggcaggtcgaaaaagtggagacatgggccttccgccatcccggctttaccatcctggcgcttttcctggcccactacatcgggacgtccctcacacagaaggttgtgatttttatcctgcttatgctggtcaccccttctatgacaatgagatgtgtgggagttggcaaccgggacttcgtggaagggctcagcggagctacctgggtcgatgtggtgctggagcatggcgggtgcgtcaccacaatggccaagaataaacccacgctggacattgagctccagaagaccgaagctacacaactggccacccttcgcaaactgtgtatcgagggaaagattacaaacgttaccacggattccagatgccctacacagggcgaagcgaccctcccggaggaacaggaccagaattatgtgtgtaaacacacctacgtggatcggggctgggggaacggatgcggcctgtttgggaagggaagccttgtcacatgcgccaagttccaatgtctggagctcaccgagggcaaagtggttcagcacgaaaatctgaagtatacagtgatcattacggtccataccggggaccagcaccaggtgggaaacgagacacaaggcgttaccgctgaaatcacaccccaggcctctaccgtggaggctatctttcgctcctacggcacgctggggctcgaatgcagccctagaaccggactggacttcaatgagatgattcttctgacaatgaaaaacaaggcctggatggtccatcggcagtggtttttcgatctccccctgccttggacctctggcgccacaaccgagacgcccacatggaataaaaaggaacttctggtgacctttaaaaacgctcacgcgaagaagcaagaggtcgtggttctcgggtcccaggaaggagccatgcacacagctctgaccggcgccaccgagatccagacaagcgggggcacgtctattttcgccggacatctgaaatgtcgcctcaagatggacaaactggaacttaagggcatgtcctatgctatgtgcagcaatgccttcgtgctgaaaaaggaggtctccgagacccagcacgggacaatcctcattaaggtggaatacaaaggagaggatgcgccgtgtaagatccctttttctaccgaagacggccaagggaaagctcataacggaagactgatcacagccaaccccgttgtgaccaagaaagaggagcctgtcaatattgaagccgagccgcccttcggcgaaagcaacatcattatcgggattggcgataaggctctgaagatcaattggtacaaaaagggatccagcatcggcaaaatgtttgaggccacggctagaggggccagacgcatggcgattcttggagacacagcctgggatttcggctctgtcggcggggtgctcaactccctggggaagatggttcaccagatctttgggagcgcttataccgccctgttctctggcgtcagctggattatgaaaatcggaattggcgtgctcctgacctggatcgggcttaattccaagaacacatctatgagcttttcctgcattgtgatcggaatcattaccctgtacctcggcgctgtcgtgcaggccgacatggggtgtgttatcaattggaagggaaaagaactgaagtgcggcagcgggattttcgtgacaaacgaggtccatacgtggaccgagcagtataaatttcaagcggattctcctaagcggctggccacagctatcgccggcgcttgggaaaatggagtgtgtggcattagatccaccacacgcatggagaaccttctctggaaacagatcgccaatgaactgaactacatcctgtgggagaataacattaagctcaccgttgtggtcggggacatcattggaatcctggaacagggcaaacggacgcttaccccgcagcccatggagctgaagtatagctggaagacatgggggaaagccaagattgtgaccgctgagacacaaaattcttccttcatcatcgatggacctaacacccccgaatgccctaacgcgctcagagcctggaatgtttgggaggtggaagactacggctttggcgtcttcacaaccaacatttggctgaaactgcgcgagatgtatacgcagctttgtgaccaccggctcatgagcgctgccgtgaaggatgaaagagccgtgcacgctgacatggggtactggatcgagtcccagaaaaatggatcttggaagctggagaaggccagcctgattgaagtcaaaacatgcacctggcccaagtcccataccctctggtctaacggcgttctggagagcgatatgatcattccgaaatcccttgcggggcctatcagccagcacaattaccgccccggatatcatacacaaaccgctggcccttggcacctggggaagctcgaactggactttaactactgcgagggaacgacagtggtgatcaccgagaattgtggcacacggggcccctctctgagaaccacaaccgtctccgggaaacttattcacgaatggtgctgtcgcagctgcacgctccctcccctgcggtatatgggagaggatggctgttggtacgggatggaaatcagaccgattaacgagaaggaagagaatatggtgaagtctctggtttccgccggaagcggcaaagtggacaacttcaccatgggggtcctctgcctggccatccttttcgaggaagtgatgcggggaaagtttggcaaaaagcatatgattgctggcgttctgttcacatttgtgctcctgctgtctgggcagatcacctggcgcgatatggccagaacacttattatgatcggaagcaatgcgtccgaccggatgggcatgggggtcacctatctggctctcatcgccacgttcaaaattcagccttttctggccctcggattctttctgagaaaacttacaagccgcgagaacctgctcctgggcgtggggctggctatggccaccacacttcaactgcccgaagatatcgagcagatggctaatggaattgccctcggcctgatggcgctcaagctgatcacccagttcgaaacctaccagctttgggccgctctggtttctctcatgtgttccaacacaatttttacgctgaccgtggcctggcggacagctaccctgatccttgccggcatcagcctgctccccatgtgccaatcctctagcatgagaaaaacagactggctgcctatgaccgtcgccgctatgggggtgccgcccctccctctgttcatcttttcccttaaggatacgctgaaacgcagatcttggcccctgaatgagggagtgatggcggtcggcctcgttagcatcctggcctcctctcttctgcggaacgacgtgcctatggctgggcccctcgtggccggaggcctgctcattgcctgttatgtcatcacagggaccagcgctgatctgaccgtggagaaggccgcggacgttacatgggaagaggaagctgagcagaccggagtgtcccacaaccttatgattacagtcgacgatgacggcacgatgcgcatcaaagatgacgaaaccgagaatatcctgacagtgctgctcaagaccgccctgcttattgttagcggcatcttcccttactctattcccgccacactgctcgtgtggcatacctggcagaaacagacgcaaagatccggggtcctgtgggatgtgccgagccctcccgagacccagaaggctgaactcgaggaaggagtctaccggatcaagcagcagggcatttttgggaaaacacaagtgggagttggcgtgcagaaggagggggtcttccacaccatgtggcatgtgacacgcggagccgttctgacccacaacggcaaaagacttgagcctaattgggcgtctgtgaagaaagacctgatctcctatggcgggggatggcggctgagcgctcagtggcaaaagggcgaagaggtccaggtgattgccgtggaacccgggaagaacccgaaaaatttccagacaatgcctggaatctttcagacgaccacaggcgagatcggggccattgctctcgatttcaagcccggaacctctggctcccctatcattaaccgcgaaggcaaagttgtcgggctgtacggaaatggcgtggtgaccaagaacgggggatatgtcagcggcatcgcccaaacaaatgctgagcccgacgggcccacgcctgagcttgaagaggaaatgtttaaaaagagaaacctgaccattatggatctccacccgggctccggaaagacacggaaatacctgcccgccatcgtgcgcgaggcgatcaagagacggctcagaaccctgattcttgcccctacacgcgttgtggctgccgaaatggaggaggctctgaaaggcctgcccatccggtatcagaccacggccacaaagagcgaacataccgggaaagagattgtcgacctcatgtgccacgccaccttcacaatgagactgctttctcctgtgcgcgttcccaattacaacctgatcattatggatgaagctcattttaccgaccctgcgagcatcgccgctcggggatatatctccacaagagtgggcatgggggaggccgccgctattttcatgaccgccacgccgcccggaacagcggaggcttttcctcagtctaatgcccccatccaggatgaggagcgcgacattcctgaacggagctggaactccggcaatgactggatcaccgatttcgccgggaagacagtctggtttgtgccctctattaaggctggcaacgacatcgccaactgtctccgcaaaaatggaaagaaagttattcaactgagcagaaagaccttcgatacggagtaccagaaaaccaagctgaacgactgggattttgtggtcacaaccgacatctccgaaatgggcgcgaatttcaaggccgatcgggtgatcgacccgagacggtgcctcaaacctgtgattcttacagatgggcccgagcgcgtcatcctggctggacccatgcctgttaccgtggcctctgctgcccagagacggggccgcgtggggagaaacccccagaaggagaatgaccaatacattttcacaggacagcctctgaacaatgatgaagaccacgctcattggaccgaggccaaaatgctcctggacaacatcaatacgccggaaggcattatccccgcgctttttgagcctgaacgggaaaagagcgccgctatcgatggggagtatagactgaaaggcgaatcccgcaagacattcgtcgagctcatgcggagaggagacctgcccgtgtggctggcccacaaagttgctagcgaaggcattaagtacaccgatcgcaagtggtgctttgacggggagcggaacaatcagatcctcgaagagaacatggatgtggagatttggaccaaagaaggagagaagaagaaacttagacctcgctggctggacgcccggacatattctgatcccctggccctcaaagagttcaaagactttgctgcgggcagaaagtccatcgccctggatcttgtcaccgagattgggcgcgtgccgcctcacctggctcatagaacacggaatgccctcgacaacctggttatgctgcacacgagcgaatacggaggccgcgcctatagacatgctgtggaggagctccccgaaaccatggagacacttctgctgctcggcctgatgatccttctgaccgggggagtcatgctgttcctgatctctggcaaaggggtgggaaagacatccattggcctgatctgtgtcgtggccagctccgggatgctctggatggcggatattcctcttcagtggatcgcctctgctattgttctggaatttttcatgatggtgctgctcatccccgagcctgagaaacaacggacaccccaggacaatcagctggcctacgtggtcattggaatccttacgctggctgccatcgttgcggccaacgaaatgggcctcctggagaccacaaagcgcgatctgggcatgagcaaagaaccgggggtggtgtcccctaccagctatctcgacgtcgaccttcaccccgcttctgcctggacactgtacgctgtggccaccacggttattacacccatgctgagacacaccatcgaaaattccacagctaacgtgagcctcgccgcgattgccaaccaagctgtcgtgctgatgggacttgataagggctggcctatctctaagatggacctgggggtcccgctcctggccctgggatgctacagccaggtgaatcccctcacccttaccgctgccgttctgctgctcgtgacacattatgccattatcggccctgggctgcaggcgaaagctacgcgggaagcccagaagagaaccgctgccggaatcatgaaaaaccccacagtcgatggcattatgaccatcgaccttgatcctgtgatttacgactccaagtttgagaaacaactgggccaggttatgctcctggtgctgtgtgccgtccagctccttctgatgcgcacatcttgggctttctgcgaggccctgaccctcgcgacggggcccatcacaaccctgtgggaaggaagccctggcaagttttggaataccacaattgccgtgtccatggctaacatcttccgggggtcttatcttgccggagctggcctggcctttagcatcatgaagtccgtggggaccggaaaaagaggcacaggcagccagggggagacgctcggagaaaagtggaaaaagaaactgaatcaactgtctcgcaaggagttcgatctctacaaaaagtccggcattaccgaagttgaccggacagaggcgaaggaggggcttaaaagaggagaaatcacccaccatgccgtcagccggggctccgctaagctgcagtggttcgtggagcgcaacatggtgattccggaagggagagtcatcgatctgggatgtggccggggcgggtggtcttattactgcgccggactcaaaaaggttacagaggtgcgcggctataccaaagggggacccggccacgaggaacctgtgcccatgagcacgtacgggtggaatattgtcaagctgatctccggaaaggacgtgttttaccttcctcccgagaaatgtgataccctgctctgcgacattggcgaatctagcccgtcccctacagttgaggaaagcagaaccatccgggtgctgaagatggtcgagccctggctgaaaaacaatcagttctgtatcaaggtgctcaacccctatatgcctgctgttattgagcatcttgaacgcctgcagagaaaacacggcgggatgctggtgcggaatcccctctctcgcaactccacacacgagatgtactggatcagcaatggaaccggcaacattgtctcttccgtgaatatgatcagcagactgcttctgaaccggtttacaatgacctatagacgccctacgattgaaaaggatgtggacctcggggccggaacacggcatgtcaacgctgagccggaaacccccaatatggacgttatcggcgagagaatccgccggattaaggaggaacactctagcacctggcattacgatgacgagaacccttataaaacatgggcctaccacgggtcctatgaagtgaaggcgacgggatctgccagctccatgatcaatggcgtggtcaaactgctgaccaagccctgggatgtggttcctacagtgacccaaatggctatgacagacaccacacccttcggccagcagagagtctttaaagagaaggtggatacccgcacgccgaagcctatgcccgggacccggaaagttatggaaattacagccgagtggctctggagaaccctgggacgcaacaagcggcctagactttgcacacgcgaggagttcaccaaaaaggtgcggacgaatgctgccatgggcgccgtctttacagaggaaaaccaatgggacagcgcgagagctgccgtggaggatgaagagttctggaaactggttgaccgcgagagagaactccacaagctggggaaatgtggatcctgcgtgtacaatatgatgggcaagcgggagaagaaacttggggaatttggcaaggccaaaggatctcgcgctatctggtacatgtggctgggcgccagatatctcgagttcgaggctctggggtttctgaacgaagatcattggttcagccgggaaaattcctactctggagtcgaaggcgaggggctccacaagctgggatatattcttagagacatcagcaaaatccccggcggggccatgtacgcggatgacaccgccggctgggacacacggattaccgaagatgacctgcataacgaggagaagatcacgcagcagatggatcctgaacaccgccagctcgctaatgccatttttaagctgacctatcaaaacaaagtggtcaaggtgcagagacccacaccgaaaggaaccgttatggacatcatttcccggaaggatcagcgcggctctggacaggtgggaacatacggccttaataccttcacaaacatggaggctcaactgatcagacagatggaaggggagggagtcctcagcaaaaccgacctggaaaatcctcatctgctcgagaagaagatcacgcagtggctggagacaaaaggcgtggaacggcttaagcgcatggccatttccggggatgactgcgtggttaaacccatcgatgacagattcgcgaacgccctgctcgctctgaacgatatgggcaaggtgcggaaagacattccccagtggcaacctagcaagggatggcacgattggcagcaggtcccgttttgttctcaccatttccacgagcttatcatgaaggacggccgcaaactggtggttccctgcagacctcaggacgaactcattgggcgggcccgcatctcccaaggagctggctggagcctgaaggagaccgcctgtctggggaaggcttatgcccagatgtgggcgctcatgtactttcatagacgggatctgcgccttgcctctaatgctatttgctccgccgtgcccgtccactgggtgcctaccagcagaacaacctggtctatccacgcccatcaccagtggatgacaacggaagacatgctgaccgtctggaaccgggtgtggatcgaggataatccctggatggaggacaagacacctgttaccacatgggaagatgtgccctacctcggaaaaagagaggaccaatggtgtggctccctgattgggcttaccagccgcgctacgtgggcccagaacatcctgaccgcgattcagcaggtccggtccctcatcggcaatgaagagttcctggattatatgccgagcatgaagagatttcgcaaggaggaagagtctgaaggagctatttggtga

SEQ ID NO: 20396 - RNA, 9873 nt, synthetic construct
  misc_feature 1..9873: note = derived and/or modified CDS sequence (opt5) from DENV-3__JF808121__SS-prME
  source 1..9873: mol_type = other RNA
accagcctgtgcctcatgatgatcctgcccgccgctcttgccttccacctgacctccagagacggagaacctcggatgattgtggggaagaacgaacgcggaaagtctctcctgtttaagacggcgtccggcaccaatatgtgtacccttatcgctatggatctgggggaaatgtgcgacgataccgtgacctacaaatgtccgcacattaccgaagttgaacccgaagacatcgattgctggtgtaacctcacctccacctgggtgacgtatggaacctgcaatcaggccggcgaaagacggcgcgacaagagatctgtggccctggctcctcacgtcgggatgggactggatacacggacccagacatggatgagcgccgagggcgcttggcgccaggtggaaaaagttgagacctgggccctcagacatcccggcttcacgattctggcgctttttctggcccactacatcgggacatccctcacccagaaggtggtcatcttcattctgcttatgctggtgacaccttctatgaccatgcggtgtgttggagtgggcaaccgcgactttgtcgaagggctcagcggagctacctgggtggatgtggtcctggagcatggcgggtgcgttacaacgatggccaagaataaacccaccctggacatcgagctccagaagacagaagctacccagctggccacacttagaaaactgtgtattgagggaaagatcaccaacattacgacagattcccggtgccctacccagggcgaagcggtgctcccggaggaacaggaccagaattatgtgtgtaaacacacctacgtcgatcgcggctgggggaacggatgcggcctgttcgggaagggaagccttgtgacatgcgccaagtttcaatgtctggagctcatcgagggcaaagttgtgcagtatgaaaatctgaagtacaccgtcattatcacagtgcacacgggggaccagcatcaggttggaaacgagacccaaggcgtgacagctgaaatcacaccccaggcctctacaaccgaggctattctgcctgaatatggcacgctcgggctggagtgctcccccagaaccggacttgacttcaatgagatgatcctgctcacaatgaaaaacaaggcctggatggtccaccggcagtggtttttcgatctgcctcttccctggaccagcggcgccacaaccgaaacgccgacatggaatcgcaaagagctgctcgtgacctttaagaacgctcatgcgaaaaagcaagaagtcgtggttctggggtctcaggagggagccatgcacacagctctgaccggcgccaccgaaattcaaaattccgggggcacaagcatcttctctggacacctcaagtgtagactgaaaatggacaaacttgagctgaaaggcatgtcctacgccatgtgcacgaacacctttgtgctcaagaaagaggtcagcgaaacacagcatgggaccattctgatcaaggtggagtacaagggagaagatgctccttgtaaaatccccttctccacagaggacggccaagggaaggcccacaacggacggctgattaccgcgaatcctgttgtgacgaaaaaggaggaacccgtcaacatcgaggctgaaccccctttcggcgagtctaatattgtgatcgggacaggcgataacgcccttaaaattaattggtataagaagggaagctccatcggcaaaatgtttgaagccaccgctagaggggcccgccggatggctatcctcggagacaccgcctgggatttcggcagcgtcgggggagttctgaactctctgggcaagatggtccatcagatttttgggtccgcgtacacagccctcttcagcggcgtgtcttgggtgatgaaaatcggaattggcgtcctgcttacctggatcgggctgaatagcaagaacacatccatgtcttttagctgcattgctatcggaattatcacgctctatctgggcgccgtggttcaggctgacatggggtgtgtgatcaattggaaaggaaaggagctgaagtgcggctccgggattttcgtcaccaacgaggtgcacacatggaccgaacagtacaaatttcaagccgatagcccgaagagacttgcgacagccatcgctggcgcctgggagaatggagtttgtggcattcgctctaccacgcggatggaaaacctcctgtggaaacagatcgctaatgagctgaactatattctctgggaaaataacatcaagctgaccgtggtcgtgggggacatcattggagttcttgagcagggcaaaagaacactgacaccccagcctatggagctcaagtactcctggaaaacatgggggaaggccaagatcgtgaccgccgaaacacaaaacagctctttcattatcgatggacccaatacccctgagtgcccctccgctagccgcgcgtggaacgtctgggaagtggaggactatggctttggcgtgttcacgacaaatatttggctgaaactgcgggaagtctacacccagctttgtgaccatagactcatgtccgccgctgttaaggatgagcgcgccgtgcacgccgacatggggtactggatcgagtctcagaaaaacggaagctggaagctggaaaaggcttccctgatcgaggtgaagacctgcacatggccgaagtctcacaccctctggagcaatggcgtcctggaatccgatatgattatccctaaaagccttgccgggcccatttctcagcataaccaccggcctggatatcatacgcaaacagcgggcccctggcacctggggaagctcgagctggactttaattactgcgagggaaccacagtggttatcaccgaaaactgtggcacaagaggcccttccctgcgcaccacgaccgtgagcgggaaacttattcacgagtggtgctgtcggtcttgcacactgcccccgctgagatatatgggagaagatggctgttggtacgggatggagatccggcctatctccgaaaaggaggagaatatggtcaaaagcctggtgtctgctggaagcggcaaggttgacaacttcaccatgggggtgctctgcctggccattctttttgaagaggtcatgcgcggaaagttcggcaaaaagcatatgatcgccggcgtgttctttacattcgttctgctcctgtccgggcagattacctggagagatatggctcacacgctgacaatgatcggaagcaatgcctctgaccggatgggcatgggggtgacctatcttgcgctgattgctacatttaaaatccagcccttcctcgccctgggatttttcctcagaaagctgacctcccgcgaaaaccttctgctcggcgtcgggctggccatggctaccacactgcaacttcccgaggatattgaacagatggccaatggaatcgctctgggcctcatggccctgaaactcatcacgcagtttgagacctaccagctgtggattgcgcttatcagcctgacatgttccaacaccatgttcacactcaccgtggcctggcggacggctacactgattctggccggcgtgtctcttctgcctgtctgccaaagctcctctatgagaaagaccgactggctcccgatggctgttgccgccatgggggtgccccctctgcccctctttatcttcagcctgaaggatacccttaaacgcagatcctggcctctgaatgagggagtgatggctgtcggcctggtgtctattctcgcgagctccctgcttcggaacgacgttcccatggccgggcctctggtggctggaggcctcctgatcgcctgttatgtcatcacagggaccagcgccgatctcacagtggaaaaggctgccgacattacgtgggaggaagaggcggaacagaccggagtttctcataacctgatgatcacagtggacgatgacggcaccatgcgcattaaagatgacgagacagagaatatccttaccgtcctgctgaagacggctctcctgattgtgtccggcgtctttccctacagcatcccggccacccttctggtgtggcacacatggcagaaacagacccaaagatctggggttctctgggatgtgccttctccccctgaaacacagaaggccgagctggaagagggagtctaccggatcaaacagcagggcattttcgggaagacccaagtgggagttggcgtgcagaaggagggggtctttcatacaatgtggcacgtgacgcgcggagctgtgctcacctataacggcaaaagactggaacccaattgggccagcgttaagaaagaccttatcagctacggcgggggatggcggctgtccgcgcagtggcaaaagggcgaggaagtccaggtgattgctgtggagccggggaaaaaccctaagaatttccagacaatgcccggaaccttccagaccacaacgggcgaaatcggggccattgccctggattttaagcctggaaccagcggctcccccatcattaaccgcgagggcaaagtcgtggggctctatggaaatggcgttgtgacaaagaacgggggatacgtcagcggcatcgctcaaaccaatgccgagcccgacgggcctacaccggaactggaggaagagatgttcaaaaagagaaaccttaccatcatggatctgcaccccggctctggaaaaacgcggaagtatctccctgctattgtgcgcgaagccatcaagagacggctgagaacactcattctggcgcccacccgcgttgtggccgctgagatggaggaagcccttaaaggcctgcctatccggtaccagaccacagctaccaagagcgagcatacagggagagaaattgtcgacctgatgtgccacgccacctttacgatgcgcctcctgtcccccgtgcgggttcctaattataaccttatcatcatggatgaggcccatttcacagacccggcttctattgcggccagaggatacatcagcacccgcgtgggcatgggggaagctgccgccatttttatgacagctacaccccctggaacggccgatgcgttcccccagtccaatgctcctatccaggacgaggagcgggacattcccgaaagatcttggaacagcggcaatgagtggatcaccgattttgccgggaaaacagtctggttcgtgccgtccatcaaggccggcaacgacattgctaactgtctgcgcaaaaatggaaagaaggtgatccaactctctcggaaaacctttgatacagaataccagaagaccaaactgaacgactgggatttcgtcgttacaaccgacattagcgagatgggcgccaattttaaggcggatagagtgatcgaccctcggcgctgcctgaaacccgtgattctcacggatgggcccgagagagtcatccttgccggacctatgcccgtgacagctgcctccgctgcccagcggcgcggcagagttgggcggaaccctcagaaggaaaatgaccaatatattttcaccggacagccgctgaacaatgatgaggaccacgctcattggaccgaagccaagatgctgctcgacaacatcaatacacccgagggcatcattcctgcgctgttcgaacccgagagagagaaaagcgccgctatcgatggggaataccgccttaagggcgagtctcggaaaacctttgtggaactgatgagacgcggagacctccctgtctggctggcccacaaggtggcttccgagggcattaaatatacagatcggaagtggtgcttcgacgggcagagaaacaatcagatcctggaagagaacatggatgttgagatttggacgaaagaaggagagaagaagaaactccgcccccggtggcttgacgccagaacctacagcgatccgctggccctgaaggaatttaaagacttcgctgcgggccgcaagtctatcgccctcgatctggtgacagagatcgggagagtcccttcccaccttgctcatcggacccgcaatgccctggacaacctcgtgatgctgcacacaagcgaacatggaggcagagcctatcggcacgctgtcgaggagctgcccgaaaccatggagacgctccttctgctgggcctcatgattctgcttaccgggggagccatgctgtttctcatctccggcaaagggattggaaagacatctatcggcctgatttgtgtgatcgcgagctccgggatgctgtggatggccgaaatccctctccaatggattgctagcgccatcgttcttgagttctttatgatggtgctgctgattcccgagcctgaaaagcagcgcacaccccaggataatcaactcgcttacgtggtcatcggcattctcacacttgccgcgatcattgccgctaacgagatgggactgctcgaaaccacgaaaagagacctgggcatgtctaaggagccgggggttgtgtcccctacaagctatctggatgtggacctccaccccgcctctgcttggaccctttacgccgtcgctacaaccgtgatcacccccatgctgcggcatacaatcgaaaatagcacggccaacgtttccctggcggccattgctaaccaggccgtggtcctcatgggactggacaaaggctggcctatctctaagatggatcttggggtgccgctgctcgctctgggatgctacagccaggtcaatcccctgaccctcacagccgccgtgcttctgctgattacccactatgcgatcattggccctgggctccaggctaaagccacaagagaggctcaaaagcgcaccgccgccggaatcatgaagaaccccacggttgacggcatcatgacaattgatctggaccctgtgatctacgattccaaattcgagaagcagcttggccaggtcatgctgctcgtgctgtgtgctgttcagctgctccttatgcggacctcttgggccctgtgcgaagcgctgaccctcgccacagggcccattaccacactgtgggagggaagccctggcaaattttggaatacgaccatcgctgtgtccatggccaacattttcagagggagctatcttgctggagccggcctggcgttttctatcatgaagtccgtcgggacaggaaaacgcggcaccggcagccaaggggaaacactcggagagaagtggaagaaaaagctgaatcagctgtcccggaaagagttcgacctctacaagaaatctggcatcaccgaggtggatagaacggaggccaaggaagggcttaaacggggagagattacccatcacgctgtgagccgcggctccgccaagctgcagtggtttgttgaaagaaacatggtcatcccggaggggcgggtgattgacctgggatgtggccgcggcgggtggtcttattactgcgctggactcaagaaagtgacagaagtcagaggctataccaaagggggacccggccatgaggagcctgttcccatgagcacatacgggtggaatatcgtgaaactgatgtccggaaaggatgtgttctaccttcctcccgaaaaatgtgacaccctgctctgcgatattggcgagagctctccgtcccctacagtcgaagagagccggaccatccgcgtgctgaagatggttgagccctggctgaagaacaatcagttctgtattaaagtgctcaacccctatatgcctacggtcatcgaacaccttgagagactgcaacggaagcacggcgggatgctggtgcgcaatcccctctctagaaactccacacatgaaatgtactggatcagcaatggaaccggcaacattgttgcctctgtgaatatggtcagccggctgcttctgaacagatttaccatgaaacaccgccggcctacaatcgagaaggacgtggatctcggggctggaacgagacatgtgaacgccgaaccggagacccccaatatggacgtcattggcgagcgcatcaaacggattaaggaagaacacaactccacatggcactatgacgatgaaaatccttacaagacctgggcgtatcatgggtcttacgaggttaaagccacaggaagcgcttccagcatgatcaacggcgtggtgaagctgctgaccaaaccctgggacgtcgtgcctatggttacacagatggccatgaccgatacgacccccttcggccagcaaagagtgtttaaggaaaaagtcgacacacgcaccccgcggtccatgcctgggacaagacgcgtgatgggaatcaccgctgagtggctctggaagacgctgggccggaataagaaacccagactttgccctcgcgaggagttcacaaagaaagttcggaccaacgccgccatgggggcggtgtttacagaggaaaatcagtgggattctgctaaggccgccgtcgaggacgaagatttctggaaactggtggacagagagcgcgagctccacaagctgggaaaatgtggcagctgcgtttataacatgatggggaagagagaaaagaaacttggcgagtttggaaaggctaaaggctcccgggccatttggtacatgtggctgggggctcgctacctcgagttcgaggccctgggatttctgaatgaggatcattggttctctagagaaaacagctattccggcgtggagggggaaggactccacaagctgggctacatccttcgggacatttctaaaatccccgggggcgcgatgtatgccgatgacaccgctggatgggacacgagaattaccgaggatgacctgcataatgaagagaagatcacacagcagatggatcctgagcaccggcaactcgccaacgctatctttaagctgacctaccagaataaagtcgtgaaggtccagcgccccacaccgaccggcacagtgatggacattatcagcagaaaagatcagcgggggtccggacaagttggcacctatgggcttaacacgttcacaaatatggaagcccagctgattcgccagatggagggagaaggcgtgctcagcaaggcggacctggagaaccctcatctgcccgagaagaagatcacccagtggctcgagaccaagggggtcgagagactgaaacggatggccatttctggcgatgactgcgtggtgaagcccatcgatgaccgctttgctaacgcccttctggctctcaatgatatgggaaaagttagaaaggacatccctcaatggcagccgtccaaaggctggcatgattggcaacaggtgcccttctgtagccaccatttccacgaactgattatgaaggacgggcggaaacttgtcgtgccttgccgcccccaagacgagctgatcggcagagcccggatttctcagggctccgggtggagcctccgcgaaacagcttgtctgggaaaagcctacgcgcagatgtggtctctgatgtattttcacagacgggatctccgcctggcctccaacgctatctgcagcgccgttcctgtgcattgggtccccacctccagaatgacatggagcattcacgcccatcaccaatggatgacgaccgaggacatgcttacagtgtggaatcgggtctggatcgaagataacccttggatggaggacaagacccccgtgacaacctgggagaatgttccgtacctgggcaaaagagaagatcagtggtgtgggtctctcattggcctgacgagccgcgctacctgggcccagaacatccctacagcgatccagcaagtgcggtcccttattggaaatgaggagttcctggactacatgccctctatgaagagatttcgcaaagaggaggaaagcgagggcgctatctggtga

SEQ ID NO: 20397 - RNA, 9873 nt, synthetic construct
  misc_feature 1..9873: note = derived and/or modified CDS sequence (opt5) from DENV-3__JF808120__SS-prME
  source 1..9873: mol_type = other RNA
acaagcctctgcctcatgatgattctgcccgccgctcttgccttccacctgacgtccagagacggagagcctcggatgattgtggggaagaatgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaggttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataagcccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagctcattgagggcaaagttgtgcagtatgaaaatctgaagtacacagtcatcatcaccgtgcacacaggggaccagcatcaggttggaaacgagacgcaaggcgtgaccgctgaaattacaccccaggcctctaccacagaggctatcctgcctgaatatggcaccctcgggctggagtgctcccccagaacgggacttgacttcaatgagatgattctgctcaccatgaaaaacaaggcctggatggtccaccggcagtggtttttcgatctgcctcttccctggacaagcggcgccaccacagaaaccccgacgtggaatcgcaaagagctgctcgtgacatttaagaacgctcatgcgaaaaagcaagaagtcgtggttctggggtctcaggagggagccatgcacaccgctctgacaggcgccaccgaaatccagaatagcgggggcaccagcattttcgccggacacctcaagtgtagactgaaaatggacaaacttgagctgaaaggcatgtcttacgctatgtgcacaaacacgtttgtgctcaagaaagaggtctccgaaacccagcatgggacaatcctgatcaaggtggagtacaagggagaagatgccccttgtaaaattcccttcagcaccgaggacggccaagggaaggcgcacaacggacggctgatcacagctaatcctgttgtgaccaaaaaggaggaacccgtcaacattgaggccgaaccccctttcggcgagtccaatatcgtgattgggacgggcgataacgcccttaaaatcaattggtataagaagggatctagcatcggcaaaatgtttgaagctacagccagaggggctcgccggatggccattctcggagacaccgcgtgggatttcggctccgtcgggggagttctgaacagcctgggcaagatggtccatcagatctttgggtctgcctacaccgctctcttctccggcgtgagctgggtgatgaaaattggaatcggcgtcctgcttacatggattgggctcaattctaagaacaccagcatgtccttttcttgcatcgccattggaatcatcacactctatctgggcgctgtggttcaggccgacatggggtgtgtgattaattggaaaggaaaggagctgaagtgcggcagcgggatcttcgtcacgaacgaggtgcacacctggacagaacagtacaaatttcaagcggattccccgaagagacttgccaccgctattgccggcgcttgggagaatggagtttgtggcatccgcagcacaacccggatggaaaacctcctgtggaaacagattgccaatgagctgaactatatcctctgggaaaataacatcaagctgacggtggtcgtgggggacattatcggagttcttaaacagggcaagagaaccctgacaccccagcctatggagctcaaatactcttggaagacctgggggaaggccaaaattgtgacagctgagacccaaaactccagcttcatcattgatggacccaatacacctgaatgcccctctgcgtcccgcgcctggaacgtctgggaggtggaagactatggctttggcgtgttcaccacgaatatctggctgaagctgcgggaggtctacacacagctttgtgaccatagactcatgagcgctgccgttaaagatgaacgcgccgtgcacgctgacatggggtactggatcgagtcccagaagaacggatcttggaaactggagaaggccagcctgattgaagtgaagacctgcacctggccgaaatcccacacactctggtctaatggcgtcctggagagcgatatgatcattcctaagtcccttgcggggcccatcagccagcataaccaccggcctggatatcatacccaaacggctggcccctggcacctggggaaactcgaactggactttaattactgcgagggaacaaccgtggttattacagagaactgtggcaccagaggcccttctctgcgcacaaccacggtgtccgggaaacttatccacgaatggtgctgtcggagctgcaccctgcccccgctgagatatatgggagaggatggctgttggtacgggatggaaatccggcctatttctgagaaagaagagaatatggtcaagtccctggtgagcgccggatctggcaaggttgacaacttcacaatgggggtgctctgcctggccatcctttttgaggaagtcatgcgcggaaaattcggcaagaaacatatgattgctggcgtgttctttaccttcgttctgctcctgagcgggcagatcacatggagagatatggcccacaccctgattatgatcggatccaatgcgagcgaccggatgggcatgggggtgacgtatcttgctctgattgccacatttaagatccagcccttcctcgccctgggatttttcctcagaaaactgacctctcgcgagaaccttctgctcggcgtcgggctggctatggccacaaccctgcaacttcccgaagatatcgagcagatggctaatggaattgccctgggcctcatggcgctgaagctcatcacccagtttgaaacataccagctgtggacggcccttatttccctgacctgtagcaacacaatgttcaccctcacagtggcttggcggaccgccacgctgatcctggctggcgtgtcccttctgcctgtctgccaatctagctccatgagaaagacagactggctcccgatggccgttgccgctatgggggtgccccctctgcccctctttattttcaatctgaaagatacccttaagcgcagatcttggcctctgaacgagggagtgatggcggtcggcctggtgagcatcctcgcctcctctctgcttcggaacgacgttcccatggctgggcctctggtggccggaggcctcctgatcgcctgttatgtcattaccgggacaagcgctgatctcaccgtggagaaagccgcggacatcacatgggaagaggaagctgagcagacgggagtttcccataatctgatgattaccgtggacgatgacggcacaatgcgcatcaaggatgacgaaaccgagaacattcttacagtcctgctgaaaaccgccctcctgatcgtgagcggcgtctttccctactctatcccggccacgcttctggtgtggcacacctggcagaagcagacacaaagatccggggttctctgggatgtgccttctccccctgagacccagaaagctgaactggaggaaggagtctaccggattaagcagcagggcatcctcgggaagacacaagtgggagttggcgtgcagaaagagggggtcttccataccatgtggcacgtgacacgcggagccgtgctgacgtataatggcaagagacttgagcccaactgggcgtccgttaaaaaggacctgatttcctacggcgggggatggcggctgagcgctcagtggcaaaaaggcgaagaggtccaggtgatcgccgtggaaccggggaagaatcctaagaactttcagaccatgcccggaacattccagaccaccacaggcgagattggggccatcgctctcgatttcaaacctggaacgtctggctcccccattatcaatcgcgaaggcaaggtcgtggggctgtatggaaacggcgttgtgaccaaaaatgggggatacgtcagcggcatcgcccaaacaaacgctgagcccgacgggcctaccccggagcttgaagaggaaatgtttaagaaaagaaatctgacaattatggatctccaccccggctccggaaagacccggaagtatctgcctgccatcgtgcgcgaggcgattaaaagacggctcagaacgctgatccttgcccccacacgcgttgtggctgccgaaatggaggaggctctgaagggcctgcctattcggtaccagaccaccgccacaaaaagcgaacataccgggagagagatcatcgacctcatgtgccacgccacattcaccatgcgcctgctttctcccgtccgggtgcctaactataatctgattatcatggatgaagctcattttacggacccggcgagcattgccgctagaggatacatctccacacgcgttggcatgggggaggccgccgctattttcatgaccgccacaccccctggaaccgcggatgcttttccccagtctaacgcccctatccaggacgaggaacgggacatccccgagagaagctggaactccggcaacgaatggattacggatttcgccgggaagaccgtgtggtttgtcccgtctatcaaagctggcaacgacattgccaattgtctccgcaagaacggaaagaaagtgatccaactgagccggaagacattcgataccgagtaccagaaaacaaagctgaatgactgggattttgtggtcaccacagacatttccgaaatgggcgcgaacttcaaagccgatagagttatcgaccctcggcgctgcctcaagcccgtgattcttaccgatgggcccgagagagtgatcctggctggacctatgcccgtcacggccgcttctgccgctcagcggcgcggcagagtggggcggaatcctcagaaggagaacgaccaatatatctttacaggacagccgctgaataacgatgaagaccacgcccattggaccgaggcgaaaatgctcctggacaatattaacacccccgaaggcatcattcctgcccttttcgagcccgaaagagaaaagagcgctgccatcgatggggagtaccgcctgaaaggcgaatcccggaagacattcgttgagctcatgagacgcggagacctgcctgtgtggctggctcacaaagtcgccagcgaaggcattaagtataccgatcggaaatggtgctttgacgggcagagaaataaccagatcctcgaggaaaatatggatgtggagatctggacaaaggagggagaaaagaagaaacttcgcccccggtggctggacgccagaacgtactctgatccgctggctctcaaagagttcaaagactttgcggccggccgcaaatccattgctctggatcttgttaccgaaatcgggagagtgcctagccacctggcccatcggacacgcaacgccctcgacaatctggtcatgctgcacacctctgagcatggaggcagagcttatcggcacgccgtggaggaactccccgagacaatggaaacccttctgctgctcggcctgatgattcttctgacagggggagcgatgctgttcctgatctccggcaaggggattggaaagaccagcatcggcctgatctgtgtcattgcctcctctgggatgctctggatggctgagatccctcttcaatggattgccagcgctatcgtgctggaatttttcatgatggttctgctcattcccgagcctgagaaacagcgcacaccccaggataaccaactggcctacgtggtgatcggcattcttaccctggcggccatcatcgctgccaatgaaatgggcctcctggagacaaccaagagagacctgggcatgtccaaagaaccgggggtcgttagccctacgtcttatctcgatgtggaccttcaccccgcttccgcctggacactgtacgctgtggccaccacagtcattacccccatgctgcggcataccatcgagaacagcacagcgaacgtgtctctcgccgctattgccaatcaggctgttgtgctgatgggacttgacaagggctggcctatcagcaaaatggatctgggggtcccgctcctggccctgggatgctactcccaggtgaaccccctcacgcttaccgccgcggtcctgctgctcattacacactatgctatcatcggccctgggctgcaggccaaggctaccagagaagcccaaaagcgcacagccgctggaattatgaaaaatcccaccgtggacggcatcatgacgattgatcttgaccctgttatctacgattctaagtttgagaaacagctgggccaggtgatgctcctggtcctgtgtgccgtgcagctccttctgatgcggacaagctgggcgctgtgcgaggccctcaccctggctaccgggcccattacaaccctttgggaaggatcccctggcaagttctggaacacaacgatcgccgtttctatggctaatatctttagagggagctatctggccggagcgggcctcgccttctccattatgaaaagcgtggggaccggaaagcgcggcacaggctctcaaggggagaccctgggagaaaagtggaaaaagaaactgaaccagctctcccggaaggagtttgacctttacaaaaagagcggcatcacagaagtcgatagaaccgaggctaaagaggggctgaagcggggagaaattacgcatcacgccgtgtcccgcggctctgctaagctgcagtggttcgtggagagaaatatggttatcccggaagggcgggtcattgacctcggatgtggccgcggcgggtggagctattactgcgccggactgaaaaaggtgaccgaggtgagaggctatacaaaagggggacccggccatgaggaacctgtccccatgaccacatacgggtggaacatcgttaaacttatgtccggaaaagatgtgttttacctgcctcccgagaagtgtgacaccctcctgtgcgatattggcgaatctagcccgtcccctacagtggaggaaagccggaccatccgcgtcctgaagatggtggagccctggctcaaaaataaccagttctgtatcaaggttcttaatccctatatgcctacggtgattgagcacctggaaagactgcaacggaaacacggcgggatgctcgtccgcaaccccctgtctagaaattccacacatgagatgtactggatcagcaacggaaccggcaatattgtggcttctgttaacatggtgtcccggcttctgctcaacagattcaccatgacacaccgccggcctacgatcgaaaaggacgtcgatctgggggccggaaccagacatgtgaatgcggagccggaaacacccaacatggacgtgattggcgagcgcatcaaacggatcaaggaggaacacaatagcacctggcactatgacgatgagaacccttacaagacatgggcctatcatgggtcttacgaagtcaaagctaccggaagcgcctcctctatgattaatggcgttgtgaagctgctcacaaaaccctgggacgtggtccctatggtgacccagatggctatgacggataccacaccctttggccagcaaagagttttcaaggagaaagtggacacccgcacaccgcggagcatgcctgggaccagacgcgtcatgggaatcacggccgaatggctgtggcggacacttggcagaaacaagaagccccgcctgtgcacccgggaggagtttaccaagaaggtgagaaccaatgccgcgatgggggctgttttcacggaagagaaccagtgggattccgccaaagccgctgtggaagacgaggatttttggaagctcgtcgaccgcgaaagagagctgcacaaacttggaaagtgtggcagctgcgtgtataatatgatggggaaacgggagaagaagctgggcgagttcggaaaagccaagggctcccgcgctatttggtacatgtggctcggggccagatacctggagtttgaagcgctgggattcctcaacgaggatcattggttttctcgggagaatagctattccggcgttgaaggggagggactgcacaaacttggctacatcctgagagacatttctaagatccctgggggcgccatgtatgctgatgacaccgccggatgggacacacggatcaccgaagatgacctccataacgaggagaaaatcacacagcagatggatcccgaacaccgccaactggctaatgccatcttcaaacttacctaccagaacaaggtggtcaaagtgcagagacctacacccaccggcacggtcatggacattatcagccggaaggatcagcgcgggtccggacaagtgggcacatatgggctgaatacctttaccaacatggaggcgcagctcattagacagatggaaggagagggcgttctgtctaaagccgacctggaaaacccgcacctccctgagaagaaaatcacacagtggctggaaaccaagggggtggagcggcttaagcgcatggctatcagcggcgatgactgcgtcgtgaaacccattgatgacagattcgccaatgctctgctcgccctgaacgatatgggaaaggtgcggaaagacatcccccaatggcagccttccaagggctggcatgattggcagcaggttccgttttgtagccaccatttccacgagcttattatgaaagacgggcgcaagctggtggtcccctgcagacctcaagacgaactcatcggacgggctcgcatttctcagggctccgggtggagcctgagagagacagcctgtctgggaaaggcgtacgcccagatgtggtctctcatgtatttccaccggcgcgatctgagacttgcttccaatgccatctgcagcgccgtgcccgttcattgggtgcctacgtctcggaccacatggtccattcacgctcatcaccaatggatgaccacagaagacatgctgaccgtctggaacagagtgtggatcgaggataatccctggatggaagacaaaacgcctgtcaccacatgggagaacgtgccctacctcggcaagcgcgaggatcagtggtgtgggagcctgatcggccttacctcccgggccacatgggcgcagaatattccgaccgctatccagcaagttagaagcctgattggaaacgaagagtttctcgactacatgccttctatgaaacgcttccggaaggaagaggagagcgaaggcgccatctggtga

SEQ ID NO: 20398 - RNA, 9873 nt, synthetic construct
  misc_feature 1..9873: note = derived and/or modified CDS sequence (opt5) from DENV-3__JF808119__SS-prME
  source 1..9873: mol_type = other RNA
accagcctgtgcctcatgatgatcctgcccacagctcttgctttccacctgacgtcccgggacggcgagcctcggatgattgtggggaagaacgaacgcggaaagtctctcctgtttaagaccgccagcggcatcaatatgtgtacacttattgcgatggatctgggggagatgtgcgacgataccgtgacatacaagtgtccgcatatcaccgaagttgagcccgaagacattgattgctggtgtaacctcacatccacctgggtgacgtatggaacctgcaatcaggctggcgagcacagacgggacaagcgctctgtggccctggcccctcatgtggggatgggactggatacaagaacccagacatggatgagcgctgagggcgcctggagacaggtggaaaaagttgagacctgggctctccgccaccccggcttcacgatcctggccctttttctggcgcattacatcgggacatccctcacccagaaggtggtcattttcatcctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacattgagctccagaagacagaagccacccagctggctacacttcgcaaactgtgtatcgagggaaagattaccaacatcacgacagattccagatgccctacccagggcgaagccgtgctcccggaggaacaggaccagaattatgtgtgtaaacacacctacgtcgatcggggctgggggaacggatgcggcctgttcgggaagggaagccttgtgacatgcgcgaagtttcaatgtctggagcccattgagggcaaagttgtgcagtatgaaaatctcaagtacaccgtcatcatcacagtgcatacgggggaccagcaccaggttggaaacgagacccaaggcgtgacagccgaaattacccctcaggcttctacaaccgaggccatcctgcccgaatatggcacgctggggctcgagtgctcccctcgcaccggactggacttcaatgagatgattcttctgacaatgaaaaacaaggcttggatggtccatagacagtggtttttcgatctccccctgccgtggaccagcggcgccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgctccctgtaaaattcctttcagcacagaggacggccaagggaaggcccataacggaagactgatcaccgcgaatcccgttgtgacgaaaaaggatgagcccgtcaacattgaagctgagcctccgttcggcgaatccaatatcgtgattgggatcggcgacaacgccctgaaaatcaattggtataagaagggatctagcattggcaaaatgtttgaggccacagctagaggggcgagacgcatggctatccttggagataccgcctgggacttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgatatggggtgtgtgatcaattggaaaggaaaggaactgaagtgcggcagcgggattttcgtcacgaacgaggtgcatacctggacagagcagtacaaatttcaagccgactcccccaagcggctggcgaccgccatcgctggcgcctgggaaaatggagtttgtggcattagaagcacaacccgcatggagaaccttctctggaaacaggtggctaatgaactgaactatatcctgtgggagaataacatcaagctcacggtcgtggttggggatattatcggagtgctggaacagggcaaacggacccttacacctcagcccatggagctgaagtactcttggaaaacctgggggaaggccaagattgtcacagccgagacccaaaactccagcttcatcattgacggacctaatacacccgaatgcccgtctgcttccagagcgtggaacgtgtgggaggtggaagactatggctttggcgtcttcaccacgaatatctggctcaaactgcgcgaggtttacacacagctgtgtgatcaccggcttatgagcgccgctgtgaaggacgaaagagccgtgcacgccgatatggggtactggatcgagtcccagaaaaacggatcttggaagctcgagaaagctagcctgattgaagtcaagacctgcacctggcctaagtcccatacactgtggtctaatggcgtgctcgagagcgacatgatcattcccaaatccctggccgggcctatcagccagcacaaccatcgccccggatatcacacccaaacggcgggcccttggcaccttgggaagctggaactcgattttaattactgcgagggaacaaccgttgtgattacagagaactgtggcacccggggcccctctctgagaacaaccacggtctccgggaaactgatccatgaatggtgctgtcgcagctgcacccttccgcctctccggtatatgggagaggacggctgttggtacgggatggaaatcagacccatttctgagaaggaagagaatatggtgaaatccctggttagcgctggatctggcaaggtggataacttcacaatgggggtcctgtgcctcgccatcctgtttgaggaagtgatgcggggaaagttcggcaaaaagcacatgattgccggcgttttctttatgttcgtgcttctgctcagcgggcagatcacctggcgcgacatggctcatacactgattatgatcggatccaatgccagcgatagaatgggcatgggggtcacctatctggcgcttattgctacgtttaaaatccagcccttcctggccctcggatttttcctgcggaagctcacatctagagagaacctgcttctgggcgtggggctcgccatggctaccacactgcaactgcctgaagacatcgagcagatggccaatggaattgctcttggcctgatggccctcaaactgatcacccagtttgaaacctaccagctctggacagcgctgatttcccttacgtgtagcaacaccatgttcacactgaccgtggcctggcgcacagctaccctcatcctggccggcgtctccctgcttccggtttgccaatctagctccatgcggaagacggattggctgcccatggctgtggccgccatgggggtgcctcccctccctctgtttattttctctctcaaggacacactgaaaagacgcagctggccccttaatgagggagtcatggctgtgggcctggtttccatcctggcgtctagcctcctgagaaacgatgtgcctatggccgggccccttgtcgctggaggcctgctcatcgcctgttatgtgattaccgggacctccgccgacctgacagttgagaaggctgccgacatcacctgggaagaggaagcggagcagacaggagtgagccacaacctcatgattacggtcgatgacgatggcaccatgcggatcaaagacgatgaaacagagaatattctgaccgtgcttctgaagacagctctgctcatcgtctctggcgtgtttccgtactccatccctgccaccctgcttgtttggcatacgtggcagaaacagacccaacgcagcggggtgctgtgggacgtcccctctcctcccgagacacagaaggccgaactcgaggaaggagtgtacagaattaaacagcagggcatcttcgggaagacccaagttggagtgggcgtccagaaggagggggtgtttcacacaatgtggcacgtgacccggggagctgttctgacatataacggcaaacgcctcgagccgaattgggcctccgtcaagaaagatctgattagctacggcgggggatggagactttctgcgcagtggcaaaagggcgaagaggtccaggtgatcgctgtcgaacctgggaaaaaccccaagaatttccagacgatgcctggaaccttccagacaaccaccggcgagattggggccatcgccctggactttaagcccggaacatccggcagccccattatcaaccgggaaggcaaagtggttgggctgtatggaaatggcgtggtcacgaagaacgggggatacgtgtccggcatcgctcaaaccaatgccgagcctgatgggccgacacccgagctcgaagaggaaatgttcaaaaagcgcaacctgaccattatggaccttcatcctggcagcggaaaaacaagaaagtatctgcccgctatcgttcgggaggccattaagcgcagactccggaccctgatcctcgcgcctacgagagtggtcgccgctgaaatggaggaggccctgaaaggccttcccattcgctaccagacaaccgctaccaagtctgaacacacagggcgggagatcgtggatctgatgtgccatgccacctttacaatgagactgctcagccctgttcgcgtgccgaattataacctgatcattatggacgaagcccacttcaccgatcccgcttccatcgcggcccggggatacatttctacgagagtcggcatgggggaggctgccgccatctttatgacagctacccctcccggaacagccgacgcgttccctcagagcaatgctcccattcaggacgaggaacgcgatatcccggagcggtcctggaactctggcaatgaatggatcaccgactttgccgggaaaacggtgtggttcgtgcctagcattaaggccggcaacgatatcgctaactgtcttcgcaaaaatggaaagaaggtcattcaactgtccagaaaaacctttgacacagagtaccagaagaccaaactcaacgattgggacttcgttgtgacaaccgatatctctgaaatgggcgccaattttaaggcggaccgggtgattgatcccagacggtgcctgaaacccgtcatcctgacagacgggcctgagcgcgtgattctcgccggacccatgcctgttaccgctgccagcgctgcccagagacggggccgcgtggggagaaacccgcagaaggagaatgatcaatatatcttcacgggacagccccttaacaatgacgaagaccatgctcactggacagaggccaagatgctgctggataacatcaatacccctgaaggcattatccccgccctcttcgagcctgaacgggagaaatccgccgctattgacggggagtacagactgaagggcgaaagccgcaaaacctttgtcgagcttatgcggagaggagatctgcccgtgtggctcgcccacaaggttgcttctgaaggcatcaaatatacagaccgcaagtggtgcttcgatgggcagcggaacaatcagattctggaggaaaacatggacgtggagatctggaccaaagagggagaaaagaagaaactgagaccgcgctggctcgatgcccggacatactccgaccctcttgccctgaaggagtttaaagatttcgctgcgggcagaaagagcatcgccctggacctcgtcacggaaattgggcgcgtgccctctcatctggctcacagaacccggaatgcccttgataacctggtcatgctccatacatccgagcacggaggccgcgcctatagacacgctgtggaagaactgcctgagaccatggaaacactgctccttctgggcctgatgatcctcctgaccgggggagccatgctttttctgattagcggcaaagggatcggaaagacgtccattggcctcatctgtgttatcgcgtctagcgggatgctgtggatggccgagattcccctgcaatggatcgcttccgccattgtgctcgagttctttatgatggtgcttctgatccctgagcccgagaagcagcggaccccgcaggacaatcaactggcttacgtcgttattggaatcctcacactggccgcgattatcgccgctaacgaaatgggccttctggagaccacaaaacgcgatctcggcatgagcaaggaacctggggtggtgtctcccacctcctatctggacgtcgacctgcatcccgccagcgcttggacgctctacgccgtggctacaaccgttatcacacctatgcttagacacaccattgaaaattctaccgccaacgtgagcctggcggccatcgctaaccaggccgtcgtgctgatgggactcgataaaggctggccgatttccaagatggacctgggggtcccccttctggctctcggatgctactctcaggtgaatcctctgacactgacggccgccgttctccttctgatcacccattatgcgattatcggccccgggctgcaggctaaagccacacgggaagctcaaaagagaaccgccgccggaatcatgaagaaccctacagtggatggcattatgaccatcgacctcgatcccgtcatttacgacagcaaattcgagaagcagctgggccaggtgatgcttctggttctctgtgctgtgcagctgctgctcatgcgcacgtcctgggccctttgcgaggcgctgacactggccaccgggcctatcaccacactctgggaaggatctccgggcaaattttggaataccacaattgctgtcagcatggccaacatcttccgggggtcctatctggctggagccggccttgcgtttagcatcatgaagtctgtggggacgggaaaaagaggcaccggctcccaaggggagacactgggagaaaagtggaagaaaaagctcaatcagctgagccgcaaagagttcgatctgtacaagaaatccggcattaccgaagtggaccggacagaggccaaggaggggctcaaaagaggagaaaccacgcaccatgctgtttctcggggcagcgccaaacttcagtggtttgtcgagcgcaacatggtgatccccgaagggagagtgattgatctgggatgtggccggggcgggtggtcctattactgcgctggactgaagaaagtcaccgaggttcgcggctatacaaaagggggacctggccacgaggaacccgtgcctatgtctacctacgggtggaatatcattaaactcatgagcggaaaggacgtgttctacctgcccccggagaaatgtgatacacttctgtgcgacatcggcgaatccagcccttctcccaccgtcgaggaatccagaacaattcgggtgctcaagatggttgagccctggctgaagaacaatcagttctgtatcaaaatcctgaacccttatatgcccaccgtgattgagcacctcgaacgccttcaaagaaagcatggcgggatgctggtccggaatcctctgagccgcaactctacgcacgagatgtactggatctccaatggaacaggcaacattgtggccagcgttaatatggtgtctagactcctgcttaaccggtttaccatgacccatagacgcccgacaatcgaaaaagatgtcgacctgggggctggaacgcggcacgtgaacgccgagcccgaaacccctaatatggacgtgattggcgagagaatcaagcgcatcaaagaggaacacaacagcacatggcattatgatgacgagaatccctacaagacctgggcgtatcacgggtcctacgaagtcaaggccacaggatctgctagctccatgattaacggcgttgtgaaactcctgaccaagccttgggatgtggtccccatggtgacacagatggccatgaccgacacgaccccgttcggccagcaacgggtttttaaagagaaggtggatacaagaacccctcgcagcatgcccgggacacggagagtcatgggaatcaccgctgaatggctgtggcgcacgctcggccggaataaaaagcctagactgtgcacacgcgaggagttcaccaagaaagtgcggacaaacgccgccatgggggcggtttttaccgaagagaatcagtgggactccgctaaggccgccgtggaagatgaggacttctggaaacttgtcgatagagaacgcgagctgcataagctcggaaaatgtggctcttgcgtgtataacatgatggggaagagagagaaaaagctgggcgaatttggaaaggctaaaggcagccgggccatttggtacatgtggcttggggctcgctacctggagttcgaagccctcggatttctgaatgaggaccactggttctccagagagaactcttatagcggcgttgaaggggagggactgcataagctcggctacatcctgcgggatatttccaaaatccccgggggcgcgatgtatgccgacgacacggctggatgggataccagaatcacagaagacgatcttcacaatgaggaaaagattacccagcagatggaccctgagcaccggcaactggccaacgctatctttaaactcacataccagaataaggtggtcaaggtgcagcgccccaccccgacaggcaccgtcatggatattatctctagaaaagaccagcgggggagcggacaagtgggcacgtatgggctgaacacattcaccaatatggaggcccagcttattcgccagatggaaggagagggcgttctgtccaaggcggatctcgaaaaccctcatctgcccgagaaaaagatcacccagtggctggaaacaaaaggggtggagagactcaagcggatggccatcagcggcgaggactgcgtcctgaagcccattgatgaccgctttgataacgcccttctggccctcaatgacatgggaaaagtgagaaaggatatccctcaatggcagccgtctaaaggctggcacgactggcaacaggtgcccttctgttcccatcacttccacgaactgattatgaaggacgggcggaaacttgttgtgccttgccgcccccaagatgagctgatcggacgggctcggattagccagggcgccgggtggtctctccgcgaaaccgcttgtctgggaaaggcctacgcgcagatgtggtccctgatgtattttcatagacgggacctccgcctggccagcaacgctatctgctctgccgtccctgtgcactgggttcccacatccagaacgacctggagcattcatgcccttcaccaatggatgacaaccgaggatatgatcacagtgtggaatcgggtctggatcgaagacaacccttggatggaggataagacccccgtgacgacctgggaggacgtcccgtacctgggcaaaagagaagatcagtggtgtgggtccctcattggcctgacaagccgcgctacctgggcccagaatatccctacagcgattcagcaagtgcggtctcttatcggaaacgaggagttcctggactacatgcccagcatgaagagatttcgcaaagaggaggaatccgagggcgctatttggtga

SEQ ID NO: 20399 - RNA, 9873 nt, synthetic construct
  misc_feature 1..9873: note = derived and/or modified CDS sequence (opt5) from DENV-3__JF808118__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccatccttagaaaactgtgtattgagggaaagatcaccaacattacaaccgattcccggtgccctacgcagggcgaagcggtgctcccggaggaacaggaccagaattatgtgtgtaaacacacatacgtcgatcgcggctgggggaacggatgcggcctgttcgggaagggaagccttgtgacctgcgccaagtttcaatgtctggagcccatcgagggcaaagttgtgcagtatgaaaatctcaagtacaccgtcatcattacagtgcacaccggggaccagcatcaggttggaaacgagacacaaggcgtgacggctgaaatcacccctcaggcctctacaaccgaggctattctgcccgaatatggcacactggggctcgagtgctcccctagaaccggactggacttcaatgagatgatccttctgacgatgaaaaacaaggcctggatggtccaccggcagtggtttttcgatctccccctgccgtggaccagcggcgccacaaccgaaacacctacctggaatcgcaaagagcttctggtgacgtttaagaacgctcatgcgaaaaagcaagaagtcgtggttctcgggtctcaggagggagccatgcacacagctctgaccggcgccacagaaattcagaattccgggggcaccagcatcttcgccggacacctgaagtgtagactcaaaatggacaagctggagcttaaaggcatgtcttacgctatgtgcaccaacacatttgtgctgaagaaagaggtctccgaaacgcagcatgggaccatcctcattaaggtggagtacaagggagaagatgccccctgtaaaatccctttcagcacagaggacggccaagggaaggcgcacaacggacggctgattaccgctaatcccgttgtgacaaaaaaggaggaacccgtcaacatcgaggccgaacctccgttcggcgagtccaatattgtgatcgggatcggcgataacgccctgaaaattaattggtataagaagggatctagcatcggcaaaatgtttgaagctaccgccagaggggctcgccggatggccattcttggagacacggcgtgggatttcggctccgtggggggagttctcaacagcctgggcaagatggtccatcagatctttgggtctgcctacacagctctgttctccggcgtgagctgggtgatgaaaattggaatcggcgtcctcctgacctggattgggcttaattctaagaacaccagcatgtccttttcttgcatcgccatcggaattatcacactgtatctcggcgctgtggttcaggccgacatggggtgtgtgattaattggaaaggaaaggagctgaagtgcggcagcgggatcttcgtcaccaacgaggtgcacacatggacggaacagtacaaatttcaagcggattcccccaagagactggccaccgctattgccggcgcttgggagaatggagtttgtggcatccgcagcacaacccggatggaaaaccttctctggaaacagatcgccaatgagctgaactatattctgtgggaaaataacatcaagctcacagtggtcgtgggggacattatcggagttctggagcagggcaaaagaacccttacgcctcagcccatggagctgaagtactcttggaaaacctgggggaaggccaagattgtgacagctgaaacccaaaactccagcttcatcatcgatggacctaatacacccgagtgcccgtctgcgtcccgcgcctggaacgtctgggaagtggaggactatggctttggcgtgttcaccacaaatatttggctcaaactgcgggaagtctacacccagctgtgtgaccatagacttatgagcgctgccgttaaggatgagcgcgccgtgcacgctgacatggggtactggatcgagtcccagaaaaacggatcttggaagctcgaaaaagccagcctgattgaggtgaagacgtgcacatggcctaagtcccacaccctgtggtctaatggcgtcctcgaaagcgatatgatcattcccaaatccctggcggggcctatcagccagcataaccaccggcccggatatcatacccaaacagctggcccttggcaccttgggaagctggagctcgactttaattactgcgagggaaccacggtggttatcacagaaaactgtggcaccagaggcccctctctgcgcacaaccacagtgtccgggaaactgattcacgagtggtgctgtcggagctgcacccttccgcctctcagatatatgggagaagatggctgttggtacgggatggagatccggcccatttctgaaaaggaggagaatatggtcaaatccctggtgagcgccggatctggcaaggttgacaacttcacgatgggggtgctgtgcctcgccatcctgtttgaagaggtcatgcgcggaaagttcggcaaaaagcatatgattgctggcgtgttctttaccttcgttcttctgctcagcgggcagatcacatggagagatatggcccacaccctgattatgatcggatccaatgcgagcgaccggatgggcatgggggtgacatatctggctcttatcgccacctttaaaattcagcccttcctggccctcggatttttcctgagaaagctcacgtctcgcgaaaacctgcttctgggcgtcgggctcgctatggccacaaccctgcaactgcctgaggatatcgaacagatggctaatggaattgcccttggcctgatggcgctcaaactgatcacacagtttgagacctaccagctctggaccgccctgatttcccttacatgtagcaacacgatgttcaccctgacagtggcttggcggaccgccacactcatcctggctggcgtgtccctgcttccggtctgccaatctagctccatgagaaagaccgactggctgcccatggccgttgccgctatgggggtgcctcccctccctctgtttatcttctctctcaaggatacgctgaaacgcagaagctggccccttaatgagggagtgatggcggtcggcctggtgtccattctggcctctagcctcctgcggaacgacgttcctatggctgggccccttgtggccggaggcctgctcatcgcctgttatgtcattacagggacctccgctgatctgaccgtggaaaaggccgcggacatcacatgggaggaagaggctgaacagaccggagttagccataacctcatgattacagtggacgatgacggcacgatgcgcatcaaagatgacgagaccgagaatatcctgacagtccttctgaagaccgccctgctcattgtgtctggcgtctttccgtactccatccctgccacactgcttgtgtggcacacctggcagaaacagacgcaaagaagcggggttctgtgggatgtgccctctcctcccgaaacccagaaggctgagctcgaagagggagtctaccggattaaacagcagggcatcttcgggaagacacaagtgggagttggcgtgcagaaggagggggtctttcataccatgtggcacgtgacacgcggagccgtgctgacctataacggcaaaagactcgaaccgaattgggcgtccgttaagaaagacctgattagctacggcgggggatggcggctttctgctcagtggcaaaagggcgaggaagtccaggtgatcgccgtggagcctgggaaaaaccccaagaatttccagacaatgcctggaacgttccagaccacaaccggcgaaattggggccatcgctctggattttaagcccggaacctccggcagccccatcattaaccgcgagggcaaagtcgtggggctgtatggaaatggcgttgtgacaaagaacgggggatacgtctccggcatcgcccaaacgaatgctgagcctgacgggccgacccccgaactcgaggaagagatgttcaaaaagagaaacctgacaattatggatcttcaccctggcagcggaaaaacccggaagtatctgcccgccatcgtgcgcgaagcgattaagagacggctcagaacactgatcctcgcccctacccgcgttgtggctgccgagatggaggaagctctgaaaggccttcccatccggtaccagacgacagccaccaagtctgagcataccgggagagaaattgtcgacctgatgtgccacgccacatttaccatgcgcctgctcagccctgtgcgggttccgaattataacctgatcattatggatgaggctcatttcacagaccccgcgtccatcgccgctagaggatacatttctacccgcgtgggcatgggggaagccgccgctatctttatgacggccacacctcccggaaccgcggatgctttccctcagagcaatgcccccatccaggacgaggagcgggacattccggaaagatcctggaactctggcaatgagtggatcacagattttgccgggaaaaccgtctggttcgtgcctagcattaaggctggcaacgacatcgccaactgtcttcgcaaaaatggaaagaaggtgattcaactgtcccggaaaacgtttgataccgaataccagaagacaaaactcaacgactgggatttcgtcgttaccacagacatctctgagatgggcgcgaattttaaggccgatagagtgattgacccccggcgctgcctgaaacccgtgatcctgaccgatgggcctgagagagtcatcctcgctggacccatgcctgtgacagccgctagcgccgctcagcggcgcggcagagttgggcggaacccgcagaaggaaaatgaccaatatattttcaccggacagccccttaacaatgatgaggaccacgcccattggacggaagcgaagatgctgctggacaacatcaatacacctgagggcattatccccgccctcttcgaacctgagagagagaaatccgctgccattgatggggaataccgcctgaagggcgagagccggaaaacctttgtggaacttatgagacgcggagacctgcccgtctggctcgctcacaaggtggcctctgagggcatcaaatataccgatcggaagtggtgcttcgacgggcagagaaacaatcagatcctggaagagaacatggatgttgagatttggacaaaagaaggagagaagaagaaactgcgcccgcggtggctcgacgccagaacctactccgatcctcttgctctgaaggaatttaaagacttcgcggccggccgcaagagcatcgctctggatctcgtgacagagattgggagagtcccctctcacctggcccatcggacgcgcaatgcccttgacaacctggtgatgctccacacctccgaacatggaggcagagcttatcggcacgccgtcgaggagctgcctgaaacaatggagaccctgctccttctgggcctgatgatcctcctgacagggggagcgatgctttttctgattagcggcaaagggatcggaaagacctccatcggcctcatttgtgtgatcgcctctagcgggatgctgtggatggctgaaattcccctgcaatggatcgcctccgctattgttctcgagttctttatgatggtgcttctgatccctgagcccgaaaagcagcgcacgccgcaggataatcaactggcctacgtggtcattggaatcctcaccctggcggccatcattgctgccaacgagatgggccttctggaaacaaccaaaagagacctcggcatgagcaaggagcctggggttgtgtctcccacatcctatctggatgtggacctgcaccccgctagcgcctggaccctctacgctgtcgccacgacagtgatcacccctatgcttcggcatacaattgaaaattctaccgcgaacgttagcctggccgctatcgccaaccaggctgtggtcctgatgggactcgacaaaggctggccgatttccaagatggatctgggggtgccccttctggccctcggatgctactctcaggtcaatcctctgaccctgacagccgcggtgctccttctgatcacgcactatgctatcattggccccgggctgcaggccaaagctaccagagaggcccaaaagcgcacagccgctggaatcatgaagaaccctaccgttgacggcattatgacaatcgatctcgaccccgtgatttacgatagcaaattcgagaagcagctgggccaggtcatgcttctggtgctctgtgccgttcagctgctgctcatgcggacctcctgggcgctttgcgaagccctgacgctggctacagggcctatcaccaccctctgggagggatctccgggcaaattttggaatacaaccatcgccgtgagcatggctaacattttcagagggtcctatctggccggagcgggccttgcctttagcatcatgaagtctgtcgggacaggaaaacgcggcacgggctcccaaggggaaaccctgggagagaagtggaagaaaaagctcaatcagctgagccggaaagaattcgacctgtacaagaaatccggcattacagaggtggatagaaccgaggctaaggaagggctcaaacggggagagacaacccatcacgccgtgtctcgcggcagcgctaagcttcagtggtttgttgaaagaaacatggtcatccccgaggggcgggtgattgacctgggatgtggccgcggcgggtggtcctattactgcgccggactgaagaaagtgacggaagtcagaggctataccaaggggggacctggccatgaggagcccgttcctatgtctacatacgggtggaatatcgtgaaactcatgagcggaaaggatgtgttctacctgcccccggaaaaatgtgacacccttctgtgcgatattggcgagtccagcccttctcccacagtcgaagagtcccggaccatccgcgtgctcaagatggttgagccctggctgaagaacaatcagttctgtatcaaagtgctgaacccttatatgcccacagtcattgaacacctcgagagacttcaacggaagcacggcgggatgctggtgcgcaatcctctgagcagaaactctacccatgaaatgtactggatctccaatggaacgggcaacattgttgctagcgtgaatatggtctctcggctcctgcttaacagatttacaatgacccaccgccggccgaccatcgagaaagacgtggatctgggggccggaacaagacatgtgaacgcggaacccgagacgcctaatatggacgtcattggcgagcgcatcaagcggatcaaagaagagcacaacagcacctggcactatgacgatgaaaatccctacaagacatgggcctatcatgggtcctacgaggttaaggctaccggatctgccagctccatgattaacggcgtggtgaaactcctgacaaagccttgggacgtcgtgcccatggttacccagatggctatgacagataccacgccgttcggccagcaaagagtgtttaaagaaaaggtcgacacccgcacacctcggagcatgcccgggaccagacgcgtgatgggaatcacagccgagtggctgtggcggaccctcggcagaaataaaaagcctcgcctgtgcacgcgggaggaattcacaaagaaagttagaaccaacgccgcgatgggggctgtgtttacagaggaaaatcagtgggattccgccaaggccgctgtcgaggacgaagatttctggaaacttgtggaccgcgagagagagctgcacaagctcggaaaatgtggctcttgcgtttataacatgatggggaagcgggaaaaaaagctgggcgagtttggaaaggccaaaggcagccgcgctatttggtacatgtggcttggggccagatacctggaattcgaggcgctcggatttctgaatgaggatcattggttctcccgggaaaactcttatagcggcgtggagggggaaggactgcacaagctcggctacatcctgagagacatttccaaaatccccgggggcgccatgtatgctgatgacaccgccggatgggacacgcggatcaccgaggatgaccttcataatgaagagaagattacacagcagatggatcctgagcaccgccaactggctaacgccatctttaaactcacctaccagaataaggtcgtgaaggtccagagacccacaccgaccggcacagtgatggacattatctctcggaaagatcagcgcgggagcggacaagttggcacctatgggctgaacacgttcacaaatatggaagcgcagcttattagacagatggagggagaaggcgtgctgtccaaggccgacctcgagaaccctcacctgcccgaaaaaaagatcacccagtggctggagaccaaaggggtcgagcggctcaagcgcatggctatcagcggcgatgactgcgtggtgaagcccattgatgacagatttgccaacgctctgcttgccctgaatgatatgggaaaagttcggaaggacatccctcaatggcagccgtctaaaggctggcatgattggcagcaggtgcccttctgttcccaccatttccacgaactcattatgaaggacgggcgcaaactggtcgtgccttgcagaccccaagacgagcttatcggacgggctcgcattagccagggcgccgggtggtctctgagagaaacagcgtgtctcggaaaggcctacgctcagatgtggtccctgatgtattttcaccggcgcgatctgagactcgccagcaacgccatctgctctgctgttcctgtgcattgggtccccacctcccggacaacgtggagcattcacgcccatcaccaatggatgaccacagaggacatgctgaccgtgtggaatagagtctggatcgaagataacccttggatggaggacaagacacccgtgaccacgtgggagaatgttccgtaccttggcaaacgcgaagatcagtggtgtgggtccctgatcggcctcaccagccgggcgacatgggctcagaacattcctaccgccatccagcaagtgagatctctgattggaaatgaggaattccttgactacatgcccagcatgaagcgctttcggaaagaggaggaatccgagggcgccatctggtga

SEQ ID NO: 20400 - RNA, 9873 nt, synthetic construct
  misc_feature 1..9873: note = derived and/or modified CDS sequence (opt5) from DENV-3__JF808127__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctctcacaatgcggtgtgttggagtgggcaaccgcgactttgtcgaagggctgagcggagctacctgggtggatgtggtcctggagcatggcgggtgcgttaccacaatggccaagaataaacccacgctcgacattgagctgcagaagaccgaagctacacaacttgccaccctgagaaaactctgtatcgagggaaagattacaaacatcaccacggattcccggtgccctacacagggcgaagcggtgctgccggaggaacaggaccagaattatgtgtgtaaacacacctacgtcgatcgcggctgggggaacggatgcggccttttcgggaagggaagcctggtgacctgcgccaagtttcaatgtctcgagcccattgagggcaaagttgtgcagtatgaaaatctgaagtacacagtcatcatcaccgtgcacacaggggaccagcatcaggttggaaacgagacgcaaggcgtgaccgctgaaattacacctcaggcctctaccacagaggctatcctgcccgaatatggcaccctcgggctggagtgctcccctagaacgggacttgacttcaatgagatgattctgctcaccatgaaaaacaaggcctggatggtccaccggcagtggtttttcgatctgccccttccgtggacaagcggcgccaccacagaaacccctacgtggaatcgcaaagagctgctcgtgacatttaagaacgctcatgcgaaaaagcaagaagtcgtggttctggggtctcaggagggagccatgcacaccgctctgacaggcgccaccgaaatccagaattccgggggcaccagcattttcgccggacacctcaagtgtagactgaaaatggacaagcttgagctgaaaggcatgtcttacgctatgtgcacaaacacgtttgtgctcaagaaagaggtctccgaaacccagcatgggacaatcctgatcaaggtggagtacaagggagaagatgccccctgtaaaattcctttcagcaccgaggacggccaagggaaggcgcacaacggacggctgatcacagctaatcccgttgtgaccaaaaaggaggaacccgtcaacattgaggccgaacctccgttcggcgagtccaatatcgtgattgggacgggcgataacgcccttaaaatcaattggtataagaagggatctagcatcggcaaaatgtttgaagctacagccagaggggctcgccggatggccattctcggagacaccgcgtgggatttcggctccgtggggggagttctgaacagcctgggcaagatggtccatcagatctttgggtctgcctacaccgctctcttctccggcgtgagctgggtgatgaaaattggaatcggcgtcctgcttacatggattgggctgaattctaagaacaccagcatgtccttttcttgcatcgccattggaatcatcacactctatctgggcgctgtggttcaggccgacatggggtgtgtgattaattggaaaggaaaggagctgaagtgcggcagcgggatcttcgtcacgaacgaggtgcacacctggacagaacagtacaaatttcaagcggattcccccaagagacttgccaccgctattgccggcgcttgggagaatggagtttgtggcatccgcagcacaacccggatggaaaacctcctgtggaaacagattgccaatgagctgaactatatcctctgggaaaataacatcaagctgacggtggtcgtgggggacattatcggagttcttgagcagggcaaaagaaccctgacacctcagcccatggagctcaagtactcttggaaaacctgggggaaggccaagattgtgacagctgaaacccaaaactccagcttcatcattgatggacctaatacacccgagtgcccgtctgcgtcccgcgcctggaacgtctgggaagtggaggactatggctttggcgtgttcaccacgaatatctggctgaaactgcgggaagtctacacacagctttgtgaccatagactcatgagcgctgccgttaaggatgagcgcgccgtgcacgctgacatggggtactggatcgagtcccagaaaaacggatcttggaagctggaaaaagccagcctgattgaggtgaagacctgcacctggcctaagtcccacacactctggtctaatggcgtcctggaaagcgatatgatcattcccaaatcccttgcggggcctatcagccagcataaccaccggcccggatatcatacccaaacggctggcccttggcacctggggaagctcgagctggactttaattactgcgagggaacaaccgtggttattacagaaaactgtggcaccagaggcccctctctgcgcacaaccacggtgtccgggaaacttatccacgagtggtgctgtcggagctgcaccctcccgcctctgagatatatgggagaagatggctgttggtacgggatggagatccggcccatttctgaaaaggaggagaatatggtcaaatccctggtgagcgccggatctggcaaggttgacaacttcacaatgggggtgctctgcctggccatcctttttgaagaggtcatgcgcggaaagttcggcaaaaagcatatgattgctggcgtgttctttaccttcgttctgctcctgagcgggcagatcacatggagagatatggcccacaccctgattatgatcggatccaatgcgagcgaccggatgggcatgggggtgacgtatcttgctctgattgccacatttaaaatccagcccttcctcgccctgggatttttcctcagaaagctgacctctcgcgaaaaccttctgctcggcgtcgggctggctatggccacaaccctgcaacttcctgaggatatcgaacagatggctaatggaattgccctgggcctcatggcgctgaaactcatcacccagtttgagacataccagctgtggacggcccttatttccctgacctgtagcaacacaatgttcaccctcacagtggcttggcggaccgccacgctgatcctggctggcgtgtcccttctgccggtctgccaatctagctccatgagaaagacagactggctccccatggccgttgccgctatgggggtgcctcccctgcctctctttattttctctctgaaggatacccttaaacgcagaagctggcccctgaatgagggagtgatggcggtcggcctggtgtccatcctcgcctctagcctgcttcggaacgacgttcctatggctgggcccctggtggccggaggcctcctgatcgcctgttatgtcattaccgggacatccgctgatctcaccgtggaaaaggccgcggacatcacatgggaggaagaggctgaacagacgggagttagccataacctgatgattaccgtggacgatgacggcacaatgcgcatcaaagatgacgagaccgagaatattcttacagtcctgctgaagaccgccctcctgatcgtgtctggcgtctttccgtactccatccctgccacgcttctggtgtggcacacctggcagaaacagacacaaagaagcggggttctctgggatgtgccctctcctcccgaaacccagaaggctgagctggaagagggagtctaccggattaaacagcagggcatcttcgggaagacacaagtgggagttggcgtgcagaaggagggggtctttcataccatgtggcacgtgacacgcggagccgtgctcacgtataacggcaaaagactggaaccgaattgggcgtccgttaagaaagaccttattagctacggcgggggatggcggctgtctgctcagtggcaaaagggcgaggaagtccaggtgatcgccgtggagcctgggaaaaaccccaagaatttccagaccatgcctggaacattccagaccaccacaggcgaaattggggccatcgctctggattttaagcccggaacgtccggcagccccattatcaaccgcgagggcaaagtcgtggggctctatggaaatggcgttgtgaccaagaacgggggatacgtctccggcatcgcccaaacaaatgctgagcctgacgggccgacccccgaactggaggaagagatgttcaaaaagagaaaccttacaattatggatctgcaccctggcagcggaaaaacccggaagtatctccccgccatcgtgcgcgaagcgattaagagacggctgagaacgctcatcctggcccctacacgcgttgtggctgccgagatggaggaagctcttaaaggcctgcccattcggtaccagaccaccgccacaaagtctgagcataccgggagagaaatcgtcgacctgatgtgccacgccacatttaccatgcgcctcctgagccctgtgcgggttccgaattataaccttatcattatggatgaggctcatttcacggaccccgcgtccatcgccgctagaggatacatttctacacgcgtgggcatgggggaagccgccgctatctttatgaccgccacacctcccggaaccgcggatgctttccctcagagcaatgcccccattcaggacgaggagcgggacatcccggaaagatcctggaactctggcaatgagtggatcacggattttgccgggaaaaccgtctggttcgtgcctagcattaaggctggcaacgacatcgccaactgtctgcgcaaaaatggaaagaaggtgattcaactctcccggaaaacatttgataccgaataccagaagacaaaactgaacgactgggatttcgtcgttaccacagacatctctgagatgggcgcgaattttaaggccgatagagtgattgacccccggcgctgcctgaaacccgtgatcctcaccgatgggcctgagagagtcattcttgctgaacccatgcctgtgacggccgctagcgccgctcagcggcgcggaagagttggccggaacccgcagaaggagaatgaccaatatatcttcacagggcagcccctgaacaatgatgaagaccacgcccattggaccgaggcgaagatgctgctcgacaacatcaatacccctgaaggaattatccccgccctgttcgagcctgagagagaaaaatccgctgccattgatggcgagtaccgccttaagggggaaagccggaaaacatttgtggagctgatgagacgcggcgacctccccgtctggctggctcacaaggtggcctctgaaggaatcaaatataccgatcggaagtggtgcttcgacggccagagaaacaatcagattctggaggagaacatggatgttgaaatctggacaaaagagggggaaaagaagaaactccgcccgcggtggcttgacgccagaacgtactccgatcctctggctctgaaggagtttaaagacttcgcggccggacgcaagagcatcgctctcgatctggtgaccgaaattggcagagtcccctctcaccttgcccatcggacacgcaatgccctggacaacctcgtgatgctgcacacctccgagcatgggggaagagcttatcggcacgccgtcgaggaactgcctgagacaatggaaaccctccttctgctgggcctcatgatcctgcttacgggcggggcgatgctgtttctcattagcggaaaaggcatcgggaagacctccattggactgatctgtgtgatcgcctctagcggcatgctgtggatggctgagattcccctccaatggatcgcctccgctattgttcttgagttctttatgatggtgctgctgatccctgaacccgagaagcagcgcacaccgcaggataatcaactcgcctacgtggtcattgggatcctgacccttgcggccattatcgctgccaacgaaatgggactgctcgagacaaccaaaagagacctgggcatgagcaaggaacctggcgttgtgtctcccacgtcctatctggatgtggacctccaccccgctagcgcctggacactttacgctgtcgccaccacagtgatcacccctatgctgcggcataccattgagaattctacagcgaacgttagcctggccgctatcgccaaccaggctgtggtcctcatggggctggacaaaggatggccgatttccaagatggatcttggcgtgcccctgctcgccctggggtgctactctcaggtcaatcctctgacgctcaccgccgcggtgcttctgctgatcacacactatgctattatcggacccggcctccaggccaaagctaccagagaggcccaaaagcgcacagccgctgggatcatgaagaaccctaccgttgacggaattatgacgatcgatctggaccccgtgatttacgatagcaaattcgaaaagcagcttggccaggtcatgctgctcgtgctgtgtgccgttcagctgctccttatgcggacatcctgggcgctgtgcgaggccctgaccctcgctaccggccctatcacaaccctgtgggaagggtctccgggaaaattttggaatacaacgattgccgtgagcatggctaacatcttcagaggctcctatcttgccggggcgggactggcctttagcatcatgaagtctgtcggcaccgggaaacgcggaacaggctcccaaggcgagaccctcggggaaaagtggaagaaaaagctgaatcagctgagccggaaagagttcgacctcaacaagaaatccggaattacagaggtggatagaaccgaagctaaggagggccttaaacggggggaaatcacgcatcacgccgtgtctcgcggaagcgctaagctgcagtggtttgttgagagaaatatggtcattcccgaaggccgggtgatcgacctggggtgtggacgcggcggctggtcctactattgcgccgggctcaagaaagtgaccgaggtcagaggatacacaaagggcgggcctggacatgaggaacccgttcctatgtctacctatggctggaacattgtgaaactgatgagcgggaaggatgtgttctaccttcccccggagaaatgtgacacactgctctgcgatatcggagaatccagcccttctcccaccgtcgaggagtcccggacaattcgcgtgctgaagatggttgaaccctggctgaagaataaccagttctgtatcaaagtgctcaatccttacatgcccaccgtcatcgagcaccttgaaagactgcaacggaagcacggcggcatgctggtgcgcaaccctctcagcagaaattctacgcatgagatgtattggatttccaacgggacaggaaatatcgttgctagcgtgaaaatggtctctcggctgcttctgaacagatttaccatgacccaccgccggccgacaattgaaaaggacgtggatctcggcgccgggacgagacatgtgaacgcggagcccgagacccctaatatggacgtcatcggagaacgcattaaacggatcaaggaggaacacaacagcacatggcactacgacgatgagaatccctataagacctgggcctaccatggctcctatgaagttaaagctacagggtctgccagctccatgatcaacggagtggtgaagctgctgaccaaaccttgggacgtcgtgcccatggttacacagatggctatgaccgatacgaccccgttcggccagcaaagagtgtttaaggagaaagtcgacacacgcacccctcggagcatgcccggcacaagacgcgtgatggggattaccgccgagtggctctggcggacgctgggaagaaataagaagcctaaactttgcacacgcgaagagttcaccaagaaagttcggacaaacgccgcgatgggcgctgtgtttaccgaagagaatcagtgggattccgccaaggccgctgtcgaagacgaggatttctggaaactggtggacagagagcgcgaactccacaagctggggaaatgtggatcttgcgtttacaacatgatgggcaagagagagaagaaacttggggaatttggcaaggccaaaggaagccgggctatctggtatatgtggctgggcgcccgctacctcgagttcgaggcgctggggtttctgaatgaagatcattggttctccagagagaactcttacagcggagtggaaggcgaggggctccacaagctgggatatattcttcgggacatctccaaaattcccggcggggccatgtacgctgatgacacggccggctgggacaccagaatcacagaagatgacctgcataatgaggagaagatcacccagcagatggatcctgaacaccggcaactcgctaacgccatttttaagctgacatatcagaataaagtcgtgaaggtccagcgccccaccccgacaggaaccgtgatggacatcatttctagaaaagatcagcggggcagcgggcaagttggaacgtacggccttaacacattcaccaatatggaggcgcagctgatccgccagatggaaggggagggagtgctctccaaggccgacctggaaaaccctcacctgcccgagaaaaagattacccagtggctcgagacaaagggcgtcgaaagactgaaacggatggctatcagcggggatgactgcgtggtgaagcccatcgatgaccgctttgccaacgctcttctggccctcaatgatatgggcaaagttagaaaggacattcctcaatggcagccgtctaaaggatggcatgattggcagcaggtgcccttctgttcccaccatttccacgagctgatcatgaaggacggccggaagcttgtcgtgccttgccgcccccaagacgaactgattgggagagctcggatcagccagggagccggctggtctctccgcgagaccgcgtgtctggggaaagcctatgctcagatgtggtccctgatgtactttcacagacgggatctccgcctggccagcaacgccatttgctctgctgttcctgtgcattgggtccccacatccagaacgacctggagcatccacgcccatcaccaatggatgacaaccgaagacatgcttacagtgtggaatcgggtctggattgaggataacccttggatggaggacaagacccccgtgacgacctgggaaaatgttccgtatctgggaaaaagagaggatcagtggtgtggctccctcatcgggctgacaagccgcgcgacctgggctcagaacatccctacagccattcagcaagtgcggtctcttatcggcaatgaagagttcctggactacatgcccagcatgaagagatttcgcaaagaggaagagtccgaaggagccatttggtga

SEQ ID NO: 20401 - RNA, 9873 nt, synthetic construct
  misc_feature 1..9873: note = derived and/or modified CDS sequence (opt5) from DENV-3__JF808124__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccttcgggctggagtgctcccctagaacgggactcgactttaatgagatgattctgcttaccatgaaaaacaaggcctggatggtccaccggcagtggttctttgatctgcccctcccgtggacaagcggcgccaccacagaaacccctacgtggaatcgcaaagagctgcttgtgacattcaagaacgctcatgcgaaaaagcaagaagtcgtggttctggggtctcaggagggagccatgcacaccgctctcacaggcgccaccgaaatccagaattccgggggcaccagcatttttgccggacacctgaagtgtagactgaaaatggacaagctcgagctgaaaggcatgtcttacgctatgtgcacaaacacgttcgtgcttaagaaagaggtctccgaaacccagcatgggacaatcctgatcaaggtggagtacaagggagaagatgccccctgtaaaattcctttcagcaccgaggacggccaagggaaggcgcacaacggacggctcatcacagctaatcccgttgtgaccaaaaaggaggaactggtcaacattgaggccgaacccccttttggcgagtccaatatcgtgattgggatcggcgataacgccctgaaaatcaattggtataagaagggatctagcattggcaaaatgttcgaagctacggccagaggggctcgccggatggccatccttggagacacagcgtgggattttggctccgtggggggagttctcaacagcctgggcaagatggtccatcagattttcgggtctgcctacaccgctctgttttccggcgtgagctgggtgatgaaaatcggaattggcgtcctcctgacctggatcgggcttaattctaagaacacaagcatgtccttctcttgcattgccatcggaatcattaccctgtatctcggcgctgtggttcaggccgacatggggtgtgtgatcaattggaaaggaaaggagctgaagtgcggcagcgggatttttgtcacaaacgaggtgcacacgtggaccgaacagtacaaattccaagcggattccccgaagagactggccacagctatcgccggcgcttgggagaatggagtttgtggcattcgcagcaccacacggatggaaaaccttctctggaaacaggtggccaatgagctgaactatatcctgtgggaaaataacatcaagctcaccgtcgtggttggggacattatcggagtgctggagcagggcaaaagaacgcttaccccccagcctatggagctgaagtactcttggaaaacatgggggaaggccaagattgtcaccgctgaaacacaaaactccagctttatcattgatggacccaatacccctgagtgcccctctgcgtcccgcgcctggaacgtgtgggaagtggaggactatggcttcggcgtctttacaaccaatatctggctcaaactgcgggaagtttacacgcagctgtgtgaccatagacttatgagcgctgccgtgaaggatgagcgcgccgtgcacgctgacatggggtactggatcgagtcccagaaaaacggatcttggaagctcgaaaaagccagcctgattgaggtcaagacatgcacctggccgaagtcccacaccctgtggtctaatggcgtgctcgaaagcgatatgatcattcctaaatccctggcggggcccatcagccagcataaccaccggcctggatatcatacacaaaccgctggcccctggcaccttgggaagctggagctcgacttcaattactgcgagggaacgacagttgtgattaccgaaaactgtggcacaagaggcccttctctgcgcaccacaaccgtctccgggaaactgatccacgagtggtgctgtcggagctgcacgcttcccccgctcagatatatgggagaagatggctgttggtacgggatggagatccggcctatttctgaaaaggaggagaatatggtgaaatccctggttagcgccggatctggcaaggtggacaactttaccatgggggtcctgtgcctcgccatcctgttcgaagaggtgatgcgcggaaagttcggcaaaaagcatatgattgctggcgttctttttacatgtgtgctgctcctgagcgggcagatcacctggagagatatggcccacacactgattatgatcggatccaatgcgagcgaccggatgggcatgggggtcacctatcttgctctgattgccacgttcaaaatccagccctttctcgccctgggattctttctcagaaagctgacatctcgcgaaaaccttctgctcggcgtggggctggctatggccaccacactgcaacttcccgaggatatcgaacagatgggaaatggcattgctctgggcctcatggccctgaaactcatcacccagttcgagacctaccagctgtggacagcgcttatttccctgacgtgcagcaacaccatgtttacactcaccgtggcctggcggacagctaccctgatcctggccggggtctcccttctgcctgtttgtcaatctagctccatgagaaagacggactggctcccgatggctgtggccgccatgggagtgccccctctgcccctcttcattttttctctgaaggatacacttaaacgcagaagctggcctctgaatgagggcgtcatggctgtggggctggtttccatcctcgcgtctagcctgcttcggaacgacgtgcccatggccggacctctggtcgctggcgggctcctgatcgcctgctatgtgattaccggaacctccgccgatctcacagttgaaaaggctgccgacatcacctgggaggaagaggcggaacagacaggcgtgagccataacctgatgattacggtcgacgatgacggcaccatgcgcatcaaagatgacgagacagagaatattcttaccgtgctgctgaagacagctctcctgatcctttctggggtcttcccctactccatcccggccaccctgctcgtgtggcacacgtggcagaaacagacccaaagaagcggagttctgtgggatgtgccttctccccctgaaacacagaaggccgagctcgaagagggcgtctaccggattaaacagcaggggatctttggaaagacccaagtgggcgttggggtgcagaaggagggagtcttccatacaatgtggcacgtgacccgcggcgctgtgctgacatataacggcaaaagacttgaacccaattgggcctccgttaagaaagacctgattagctacgggggaggctggcggctgtctgcgcagtggcaaaagggggaggaagtccaggtgatcgctgtggagccgggaaaaaaccctaagaattttcagacgatgcccggcaccttccagacaaccaccggggaaattggagccatcgccctcgatttcaagcctggcacatccggcagccccattatcaaccgcgaggggaaagtcgtgggactgtatggcaatggggttgtgacgaagaacggaggctacgtctccgggatcgctcaaaccaatgccgagcccgacggccctacaccggaacttgaggaagagatgtttaaaaagagaaacctgaccattatggatctccaccccggaagcggcaaaacacggaagtatctgcctgctatcgtgcgcgaagccattaagagacggctcagaaccctgatccttgcgcccacgcgcgttgtggccgctgagatggaggaagccctgaaagggctgcctattcggtaccagacaaccgctaccaagtctgagcatacaggaagagaaatcgtcgacctcatgtgtcacgccaccttcacaatgcgcctgcttagccccgtgcgggttcctaattataacctgatcattatggatgaggcccattttaccgacccggcttccatcggcgcgagagggtacatttctacgcgcgtgggaatgggcgaagccgctgccatcttcatgacagccaccccccctgggacagctgatgcctttccccagagcaatgcgcctattcaggacgaggagcgggacatccccgaaagatcctggaactctggcaatgagtggatcaccgatttcgctggaaaaacggtctggtttgtgccgagcattaaggccggcaacgacatcgccaactgcctccgcaaaaatgggaagaaggtgattcaactgtcccggaaaaccttcgatacagaataccagaagaccaaactgaacgactgggattttgtcgttacaaccgacatctctgagatgggagctaatttcaaggccgatagagtgattgaccctcggcgctgcctcaaacccgtgatccttacagatggccccgagagagtcattctggcggggcctatgcccgtgaccgccgctagcgccgctcagcggcgcggaagagttggccggaaccctcagaaggaaaatgaccaatatatctttacggggcagccgctgaacaatgatgaggaccacgcccattggacagaagctaagatgctcctggacaacatcaatacccccgagggcattatccctgcccttttcgaacccgagagagagaaatccgcggccattgatggagaataccgcctgaagggcgagagccggaaaaccttcgtggaactcatgagacgcggggacctgcctgtctggctggctcacaaggtggcctctgagggaatcatttatacagatcggaaatggtgttttgacggccagagaaacaatcagatcctcgaagagaacatggatgttgagatctggaccaaggaaggggagaaaaagaagcttcgcccccggtggctggacgctagaacatactccgatccgctggccctcaaagaattcaaggactttgccgctggacgcaaaagcattgcgctggatcttgtgacggagatcggcagagtcccttctcacctggcccatcggacccgcaatgctctcgacaacctggtgatgctgcacacatccgaacatggcgggagagcctatcggcacgccgtcgaggagctccccgaaaccatggagacacttctgctgctcggactgatgattcttctgaccggcggggctatgctcttcctgatcagcggaaagggcattgggaaaacgtccatcggactgatctgcgtgattgcctctagcggcatgtcctggatggcggaaatccctctccaatggattgccagcgctatcgttcttgagtttttcatgatggtgctgctgattcccgagcctgaaaagcagcgcaccccccaggataatcaactcgcctacgtggtcatcggcattctgacacttgctgccatcatcgcggccaacgagatggggctgctcgaaaccacaaagagagacctgggaatgtctaaagagccgggcgttgtgtcccctaccagctatctggatgtggacctccaccccgcttctgcctggacgctttacgctgtcgccacaaccgtgattacacccatgctgcggcataccatcgaaaatagcaccgctaacgtttccctggccgcgattgccaaccaggctgtggtcctcatggggctggacaagggatggcctatctctaaaatggatcttggcgtgccgctgctcgccctggggtgttacagccaggtcaatcccctgacactcacggctgccgtgcttctgctgattacccactatgccatcatcggacctggcctccaggcgaaggctacaagagaggcccaaaaacgcaccgctgccggcattatgaagaaccccacagttgacgggatcatgaccattgatctggaccctgtgatctacgattccaagtttgagaaacagcttggacaggtcatgctgctcgtgctgtgcgccgttcagctgctccttatgcggacgtcttgggctctgtgtgaagccctgacactcgcgaccggccccattaccacactgtgggaggggagccctggaaagttctggaataccacaatcgccgtgtccatggctaacatctttagaggcagctatcttgccggggctggactggccttctctattatgaaatccgtcggcacgggcaagcgcgggaccggaagccaaggcgaaacactcggggagaaatggaagaagaaactgaatcagctgtcccggaaggaatttgacctctacaaaaagtctggaatcaccgaggtggatagaacagaggcgaaagaaggccttaagcggggggagattacccatcacgccgtgagccgcggatccgctaaactgcagtggttcgttgaaagaaacatggtcatcccggagggccgggtgattgacctgggctgcgggcgcggaggctggtcttattactgtgccgggctcaagaaggtgacggaagtcagaggatataccaaaggcgggcccggacatgaggagcctgttcccatgagcacatacggctggaatatcgtgaagctgatgtccggcaaagatgtgttttaccttcctcccgaaaagtgcgacaccctgctctgtgatattggggagagctctccgtcccctacagtcgaagagagccggaccatccgcgtgctgaaaatggttgagccctggctgaagaacaatcagttctgcatcaaggtgctcaacccctatatgcctacagtcattgaacaccttgagagactgcaacggaaacacggaggcatgctggtgcgcaatcccctctctagaaactccacccatgaaatgtactggatcagcaatgggacgggaaacattgttgcttctgtgaatatggtcagccggctgcttctgaacagattcacaatgacccaccgccggcctaccatcgagaaggacgtggatctcggcgccgggacaagacatgtgaacgctgaaccggagacgcccaatatggacgtcattggagagcgcatcaaacggatcaaggaagagcacaactccacctggcactatgacgatgaaaatccttacaaaacatgggcctatcatggctcttacgaggttaaggcgaccggcagcgcctccagcatgattaacggggtggtgaagctgctgacaaaaccctgggacgtcgtgcctatggttacccagatggctatgacagataccacgccctttggacagcaaagagtgttcaaggaaaaagtcgacacccgcacaccgcggtccatgcctggcaccagacgcgtgatggggatcacagccgagtggctctggcggaccctgggaagaaataagaaaccccgcctttgtacgcgggaggaatttacaaagaaggttagaaccaacgctgccatgggcgccgtgttcacagaggaaaatcagtgggattctgcgaaagctgccgtcgaggacgaagatttttggaagctggtggaccgcgagagagagctccacaaactggggaagtgcggcagctgcgtttataacatgatgggaaaacgggaaaagaaacttggcgagttcgggaaggccaagggatcccgcgctatttggtacatgtggctgggcgccagatacctcgaatttgaggctctggggttcctgaatgaggatcattggttttctcgggaaaacagctattccggagtggagggcgaagggctccacaaactgggctacatccttagagacatttctaagatccctggaggcgccatgtatgcggatgacaccgccgggtgggacacgcggatcaccgaggatgacctgcataatgaagagaaaattacacagcagatggatcccgagcaccgccaactcgctaacgccatcttcaagctgacctaccagaataaagtcgtgaaggtccagagacctacacccaccggaacagtgatggacattatcagccggaaggatcagcgcggctccgggcaagttggaacctatggccttaacacgtttacaaatatggaagctcagctgattagacagatggagggggaaggcgtgctcagcaaagccgacctggagaacccgcacctgcctgaaaagaaaatcacccagtggctcgagaccaagggagtcgagcggctgaaacgcatggcgatctctggcgatgactgtgtggtgaagcccattgatgacagattcgccaacgctcttctggccctcaatgatatggggaaggttcggaaagacatcccccaatggcagccttccaagggatggcatgattggcagcaggtgccgttttgcagccaccatttccacgaactgattatgaaagacggccgcaagcttgtcgtgccctgtagacctcaagacgagctgatcgggcgggctcgcatttctcagggagccggctggtccctcagagaaacagcttgcctggggaaagcctacgcgcagatgtggagcctgatgtatttccaccggcgcgatctcagactggcctctaacgctatctgttccgccgttcccgtgcattgggtccctaccagccggacaacgtggtccattcacgcccatcaccaatggatgaccacagaggacatgcttaccgtgtggaatagagtctggatcgaagataacccctggatggaggacaagacacctgtgaccacgtgggagaatgttccctacctgggcaagcgcgaagatcagtggtgcggaagcctcatcggcctgacctctcgggctacatgggcccagaacattccgaccgcgatccagcaagtgagaagccttattgggaatgaggaatttctggactacatgccttccatgaaacgcttccggaaggaggaggaatctgagggagctatctggtga

SEQ ID NO: 20402 - RNA, 9873 nt, synthetic construct
  misc_feature 1..9873: note = derived and/or modified CDS sequence (opt5) from DENV-3__JF808126__SS-prME
  source 1..9873: mol_type = other RNA
accagcctgtgcctgatgatgattctgcccgctgctcttgccttccacctgacgtcccgggacggagagcctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcaccctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttctcgatctgccccttccgtggaccagcggcgccacaaccgaaacgcctacatggaatcggaaagagctgctcgtgaccttcaagaacgctcacgcgaaaaagcaagaagtcgtggttctggggtctcaggagggagccatgcacacagctctgaccggcgccaccgaaattcaaaattccgggggcacaagcatctttgccggacatctcaagtgtcgcctgaaaatggacaaacttgagctgaaaggcatgtcttacgctatgtgcacgaacaccttcgtgctcaagaaagaggtctccgaaacacagcacgggaccattctgatcaaggtggagtacaagggagaagatgccccctgtaaaatcccttttagcacagaggacggccaagggaaggcgcataacggaagactgattaccgctaatcccgttgtgacgaaaaaggaggaacccgtcaacatcgaggccgaacctccgttcggcgagtccaatattgtgatcgggattggcgataacgcccttaaaatcaattggtataagaagggatctagcatcggcaaaatgttcgaagctacagccagaggggctagacgcatggccattctcggagacaccgcgtgggattttggctccgtcgggggagttctgaacagcctgggcaagatggtccaccagatcttcgggtctgcctacaccgctctcttttccggcgtgagctgggtgatgaaaattggaatcggcgtcctgcttacatggattgggctcaattctaagaacaccagcatgtccttctcttgcatcgccattggaatcatcacactctatctgggcgctgtggttcaggccgacatggggtgtgtgattaattggaaaggaaaggagctgaagtgcggcagcgggatctttgtcacgaacgaggtgcatacctggacagaacagtacaaattccaagcggattcccccaagcggcttgccaccgctattgccggcgcttgggagaatggagtttgtggcatcagaagcacaacccgcatggaaaacctcctgtggaaacagattgccaatgagctgaactatatcctctgggaaaataacatcaagctgacggtggtcgtgggggacattatcggagttcttgagcagggcaaacggaccctgacacctcagcccatggagctcaagtactcttggaaaacctgggggaagtccaagattgtgacagccgaaacccaaaacagctcttttatcattgatggacctaatacacccgagtgcccgtccgctagcagagcgtggaacgtctgggaagtggaggactatggcttcggcgtgtttaccacgaatatctggctgaaactgcgcgaagtctacacacagctttgtgaccaccggctcatgtccgccgctgttaaggatgagagagccgtgcacgccgacatggggtactggatcgagtctcagaaaaacggaagctggaagctggaaaaggcttccctgattgaggtgaagacctgcacctggcctaagtctcatacactctggagcaatggcgtcctggaatccgatatgatcattcccaaaagccttgccgggcctatctctcagcacaaccatcgccccggatatcacacccaaacggcgggcccttggcacctggggaagctcgagctggacttcaattactgcgagggaacaaccgtggttattacagaaaactgtggcacccggggccccgctctgagaacaaccacggtgtccgggaaacttatccatgagtggtgctgtcgcagctgcaccctcccgcctctgcggtatatgggagaagatggctgttggtacgggatggagatcagacccatttctgaaaaggaggagaatatggtcaaatccctggtgagcgccggatctggcaaggttgacaactttacaatgggggtgctctgcctggccatccttttcgaagaggtcatgcggggaaagtttggcaaaaagcacatgattgctggcgtgttcttcacctttgttctgctcctgagcgggcagatcacatggcgcgatatggcccataccctgattatgatcggatccaatgcgagcgacagaatgggcatgggggtgacgtatcttgctctgattgccacattcaaaatccagccctttctcgccctgggattctttctccggaagctgacctctagagaaaaccttctgctcggcgtcgggctggctatggccacaaccctgcaacttcctgaggatatcgaacagatggctaatggaattgccctgggcctcatggcgctgaaactcatcacccagttcgagacataccagctgtggacggcccttatttccctgacctgtagcaacacaatgtttaccctcacagtggcttggcgcaccgccacgctgatcctggctggcgtgtcccttctgccggtctgccaatctagctccatgcggaagacagactggctccccatggccgttgccgctatgggggtgcctcccctgcctctcttcatcttttctctgaaggatacccttaaaagacgcagctgtcccctgaatgagggagtgatggcggtcggcctggtgtccatcctcgcctctagcctgcttagaaacgacgttcctatggctgggcccctggtggccggaggcctcctgatcgcctgctatgtcattaccgggacatccgctgatctcaccgtggaaaaggccgcggacatcacatgggaggaagaggctgaacagacgggagttagccacaacctgatgattaccgtggacgatgacggcacaatgcggatcaaagatgacgagaccgagaatattcttacagtcctgctgaagaccgccctcctgatcgtgtctggcgtcttcccgtactccatccctgccacgcttctggtgtggcatacctggcagaaacagacacaacgcagcggggttctctgggatgtgccctctcctcccgaaacccagaaggctgagctggaagagggagtctacagaattaaacagcagggcatctttgggaagacacaagtgggagttggcgtgcagaaggagggggtcttccacaccatgtggcacgtgacacggggagccgtgctcacgtataacggcaaacgcctggaaccgaattgggcgtccgttaagaaagaccttgtcagctacggcgggggatggagactgtctgctcagtggcaaaagggcgaggaagtccaggtgattgccgtcgagcctgggaaaaaccccaagaattttcagaccatgcctggaacattccagaccaccacaggcgaaatcggggccattgctctggatttcaagcccggaacgtccggcagccccatcattaaccgggagggcaaagtggttgggctctatggaaatggcgtggtcaccaagaacgggggatacgtgtccggcatcgcccaaacaaatgctgagcctgacgggccgacccccgaactggaggaagagatgtttaaaaagcgcaaccttacaatcatggatctgcatcctggcagcggaaaaaccagaaagtatctccccgccattgttcgggaagcgatcaagcgcagactgcggacgctcattctggcccctacaagagtggtcgctgccgagatggaggaagctcttaaaggcctgcccatccgctaccagaccaccgccacaaagtctgagcacaccgggcgggaaattgtggacctgatgtgtcatgccacattcaccatgagactcctgagccctgttcgcgtgcagaattataaccttatcatcatggatgaggctcactttacggacccggcgtccattgccgctcggggatacatctctacaagagtcggcatgggggaagccgccgctattttcatgaccgccacaccccctggaaccgcggatgcttttccccagagcaatgcccctatccaagacgaggagcgcgacattcccgaacggtcctggaactctggcaatgagtggatcacggatttcgccgggaaaaccgtgtggtttgtgccgagcatcaaggctggcaacgacattgccaactgcctgcgcaaaaatggaaagaaggtcatccagctctccagaaaaacattcgataccgaataccagaagacaaaactgaacgactgggattttgttgtgaccacagacatttctgagatgggcgcgaatttcaaggccgatcgggtgatcgaccctagacggtgcctgaaacccgtcattctcaccgatgggcccgagcgcgtgatccttgctggacctatgcccgttacggccgctagcgccgctcagagacggggccgcgtggggagaaaccctcaaaaggaaaatgaccagtatatttttacaggacagccgctgaacaatgatgaggaccatgcccactggaccgaagcgaagatgctgctcgacaacatcaatacccccgagggcatcattcctgccctgttcgaacccgagcgggagaaatccgctgccatcgatggggaatacagacttaagggcgagagccgcaaaacattcgtcgaactgatgcggagaggagacctccctgtgtggctggctcacaaggttgcctctgagggcattaaatataccgatcgccggtggtgttttgacgggcagagaaacaatcaaatcctggaagagaacatggatgtggagatttggacaaaggaaggagagaaaaagaagctccgcccccggtggcttgacgccagaacgtactccgatccgctggctctgaaagagttcaaggactttgcggccggccgcaaaagcatcgctctcgatctggtcaccgagatcgggagagtgccttctcatcttgcccaccggacacgcaatgccctggacaacctcgtcatgctgcatacctccgaacacggaggcagagcttatcggcacgccgtggaggagctgcccgaaacaatggagaccctccttctgctgggcctcatgattctgcttacagggggagcgatgctgttcctcatcagcggcaaggggattggaaaaacctccatcggcctgatttgcgttatcgcctctagcgggatgctgtggatggctgaaatccctctcccctggattgcctccgctatcgtgcttgagtttttcatgatggtgctgctgattcctgagcccgaaaagcagcgcacaccgcaggataatcaactcgcctacgtcgttatcggcattctgacccttgcggccatcattgctgccaacgagatgggcctgctcgaaacaaccaagagagacctgggcatgagcaaagagcctggggtggtgtctcccacgtcctatctggatgtcgacctccatcccgctagcgcctggacactttacgctgtggccaccacagttatcacccctatgctgcggcacaccatcgaaaattctacagcgaacgtgagcctggccgctattgccaaccaggctgtcgtgctcatgggactggacaagggctggccgatctccaaaatggatcttggggtccccctgctcgccctgggatgttactctcaggtgaatcctctgacgctcaccgccgcggttcttctgctgattacacattatgctatcattggccccgggctccaggccaaggctaccagagaggcccaaaaacgcacagccgctggaatcatgaagaaccctaccgtggacggcatcatgacgattgatctggaccccgtcatctacgatagcaagtttgagaaacagcttggccaggtgatgctgctcgttctgtgcgccgtgcagctgctccttatgcggacatcctgggcgctgtgtgaagccctgaccctcgctaccgggcctattacaaccctgtgggagggatctccgggcaagttctggaatacaacgatcgccgtcagcatggctaacatttttagagggtcctatcttgccggagcgggcctggccttcagcatcatgaaatctgtggggaccggaaagcgcggcacaggctcccaaggggaaaccctcggagagaaatggaagaagaaactgaatcagctgagccggaaggaatttgacctctacaaaaagtccggcatcacagaggtggatagaaccgaggctaaagaagggcttaagcggggagagattacgcaccatgccgtttctcgcggcagcgctaaactgcagtggttcgtcgaaagaaacatggtgatccccgaggggcgggtgattgacctgggatgcggccgcggcgggtggtcctattactgtgccggactcaagaaggtcaccgaagttagaggctatacaaaagggggacctggccacgaggagcccgtgcctatgtctacctacgggtggaatatcgtgaagctgatgagcggaaaagatgtcttttaccttcccccggaaaagtgcgacacactgctctgtgatattggcgagtccagcccttctcccaccgtggaagagtcccggacaatccgcgttctgaaaatggtggagccctggctgaagaacaatcagttctgcattaaggtcctcaacccttatatgcccaccgtgatcgaacaccttgagagactgcaacggaaacatggcgggatgctggttcgcaatcctctcagcagaaactctacgcacgaaatgtactggatctccaatggaacaggcaacattgtggctagcgtcaatatggtgtctcggctgcttctgaacagattcaccatgacccatcgccggccgacaatcgagaaggacgtggatctcggggccggaacgagacacgtcaacgcggaacccgagacccctaatatggacgttattggcgagcgcatcaaacggattaaggaagaacacaacagcacatggcattatgacgatgaaaatccctacaaaacctgggcctatcacgggtcctacgaggtgaaggctacaggatctgccagctccatgatcaacggcgtggtcaagctgctgaccaaaccttgggacgtggttcccatggtgacacagatggctatgaccgatacgaccccgtttggccagcaaagagtcttcaaggaaaaagtggacacacgcacccctcggagcatgcccgggacaagacgcgttatgggaatcaccgccgagtggctctggcggacgctgggcagaaataagaaacctcgcctttgtacacgggaggaatttaccaagaaggtgagaacaaacgccgcgatgggggctgtcttcaccgaggaaaatcagtgggattccgccaaagccgctgtggaggacgaagatttttggaagctggttgaccgcgagagagagctccataaactgggaaagtgcggctcttgcgtgtataacatgatggggaaacgggaaaagaaacttggcgagttcggaaaggccaagggcagccgcgctatttggtacatgtggctgggggccagatacctcgaatttgaggcgctgggattcctgaatgaggatcactggttttcccgggaaaactcttatagcggcgtcgagggggaaggactccataaactgggctacatccttagagacatttccaagatccccgggggcgccatgtatgctgatgacacggccggatgggacacccggattacagaggatgacctgcacaatgaagagaaaatcacccagcagatggatcctgagcaccgccaactcgctaacgccatcttcaagctgacataccagaataaagtggtcaaggtgcagagacccaccccgacaggcaccgttatggacattatctctcggaaggatcagcgcgggagcggacaagtgggcacgtatgggcttaacacatttaccaatatggaagcgcagctgattagacagatggagggagaaggcgtcctctccaaagccgacctggagaaccctcatctgcccgaaaagaaaatcacccagtggctcgagacaaagggggtggagcggctgaaacgcatggctattagcggcgatgactgtgtggttaagcccatcgatgacagattcgccaacgcccttctggccctcaatgatatgggaaaggtgcggaaagacatccctcaatggcagccgtctaagggctggcacgattggcagcaggtccccttttgctcccatcacttccacgaactgattatgaaagacgggcgcaaacttgtggttccttgtagaccccaagacgagctgatcggacgggctcgcattagccagggcgccgggtggtctctcagagaaaccgcgtgcctgggaaaagcctacgctcagatgtggtccctgatgtatttccatcggcgcgatctcagactggccagcaacgccatctgttctgctgtgcctgtccactgggtgcccacatcccggacgacctggagcattcatgcccaccatcaatggatgacaaccgaggacatgcttacagtctggaatagagtgtggatcgaagataacccttggatggaggacaagacccccgttacgacctgggagaatgtgccgtacctgggcaagcgcgaagatcagtggtgcgggtccctcattggcctgacaagccgggcgacctgggctcagaacatccctacagccatccagcaagtcagatctcttattggaaatgaggaatttctggactacatgcccagcatgaaacgcttccggaaggaggaggaatccgagggcgccatctggtga

SEQ ID NO: 20403 - RNA, 9873 nt, synthetic construct
  misc_feature 1..9873: note = derived and/or modified CDS sequence (opt5) from DENV-3__JF808125__SS-prME
  source 1..9873: mol_type = other RNA
accagcctgtgcctcatgatgatcctgcccgccgctcttgccttccacctgacatcccgggacggcgagcctcggatgattgtgggggaaaacgagcgcggaaagtctctcctgtttaaaacggcgagcggcatcaatcggcggacccttattgctatggatctgggggaaatgtgtgaggaaacagagacctacaagtgcccgcacatcacagaggtcgaacccgaggacattgattgttggtgcaacctcacctccacatgggttacctatggaacgtgtaatcaggccggcgaacgcagacgggacaaacgctctgtggccctggctcctcacgtggggatgggactggataccagaacacagacctggatgagcgccgagggcgcttggcggcaggtcgagaaggtggaaacatgggccctccgccatcccggcttcaccatcctggcgctttttctggcccactacatcgggacgtccctcacacagaaagttgtgattttcatcctgcttatgctggtcaccccttctatgacaatgagatgcgtgggagttggcaaccgggactttgtggaggggctcagcggagctacctgggtcgatgtggtgctggaacatggcgggtgtgtcaccacaatggccaagaataagcccacgctggacattgagctccagaaaaccgaagctacacaactggccacccttcgcaagctgtgcatcgagggaaaaattacaaacatcaccacggattccagatgtcctacacagggcgaggcggttctcccggaagaacaggaccagaattatgtgtgcaagcacacctacgtggatcggggctgggggaacggatgtggcctgttcgggaaaggaagccttgtgacatgcgccaagtttcaatgcctggaacccattgagggcaaggtggttcagtatgaaaatctcaaatacacagtgatcatcaccgtccacacaggggaccagcatcaggtgggaaacgagacgcaaggcgttaccgctgagattacacctcaggcctctaccacagaagctatcctgcccgagtatggcaccctggggctcgaatgttcccctcgcacgggactggatttcaatgagatgattcttctgaccatgaagaacaaagcctggatggtgcacagacagtggtttttcgacctccccctgccgtggacaagcggcgccaccgctgaaacacctacctggaatcggaaggagcttctggtcacgtttaaaaacgcgcatgccaagaaacaagaggtggtcgtgctcgggtctcaggaaggagctatgcacacagccctgaccggcgccacagagatccaaaattccgggggcaccagcattttcgctggacacctgaagtgcagactcaagatggacaaactggaacttaagggcatgtcttacgccatgtgtaccaacacatttgttctgaaaaaggaggtgtccgagacgcagcatgggaccatcctcatcaaagtcgaatacaagggagaggatgcgccctgcaagattcctttcagcacagaagacggccaagggaaagctcacaacggacgcctgatcaccgccaatcccgtggttacaaagaaagaggaacccgtgaacattgaggccgagcctccgttcggcgaatccaatatcgtcattgggatcggcgataacgctctgaagatcaattggtataaaaagggatctagcattggcaagatgtttgaggccaccgctagaggggccagacgcatggcgatccttggagacacggcctgggatttcggctccgtcgggggagtgctcaacagcctgggcaaaatggttcatcagatttttgggtctgcttacacagccctgttctccggcgtcagctgggtgatgaagatcggaattggcgtgctcctgacctggatcgggcttaattctaaaaacaccagcatgtccttttcttgtattgctatcggaatcattacactgtatctcggcgccgtcgtgcaggcggacatggggtgcgttatcaattggaagggaaaagaactgaagtgtggcagcgggattttcgtgaccaacgaggtccacacatggacggaacagtacaagtttcaagccgattcccccaaacggctggctaccgccatcgctggcgcctgggagaatggagtgtgcggcattagaagcacaacccgcatggagaaccttctctggaagcagatcgccaatgaactgaactatatcctgtgggagaataacattaaactcacagttgtggtcggggacatcattggagtgctggaacagggcaagcggacccttacgcctcagcccatggagctgaaatactcttggaagacctgggggaaagctaagatcgttacagcggaaacccaaaactccagcttcattatcgatggacctaatacacccgagtgtccgtctgcctccagagcttggaacgtgtgggaggtcgaagactatggctttggcgtgttcaccacaaatatctggctcaagctgcgcgaggtgtacacccagctgtgcgatcatcggcttatgagcgccgccgtcaaagacgaaagagctgttcacgccgacatggggtactggattgagtcccagaagaacggatcttggaaactcgagaaggcgagcctgatcgaagtgaaaacgtgtacatggcctaagtcccacaccctgtggtctaatggcgtgctcgagagcgatatgattatccccaagtccctggctgggcctattagccagcataaccaccgccccggatatcatacccaaacagccggcccttggcaccttgggaaactggaactcgactttaattactgcgagggaaccacggtcgtgatcacagaaaactgcggcacccggggcccctctctgagaacaaccacagtttccgggaagctgatccacgagtggtgttgccggagctgtacccttccgcctctccgctatatgggagaggatggctgctggtacgggatggaaattagacccatctctgagaaagaagagaatatggtgaagtccctggtcagcgccggatctggcaaagtggacaacttcacgatgggggttctgtgtctcgctattctgtttgaagaggtgatgcggggaaagttcggcaagaaacatatgatcgccggcgtcttctttaccttcgtgcttctgctcagcgggcagattacatggagagatatggcgcacaccctgatcatgattggatccaatgctagcgaccgcatgggcatgggggttacatatctggcccttatcgccacctttaagatccagcccttcctggctctcggatttttcctgcggaaactcacgtctagagagaacctgcttctgggcgtggggctcgccatggctacaaccctgcaactgcctgaagatattgagcagatggccaatggaatcgcgcttggcctgatggccctcaagctgattacacagtttgaaacctaccagctctggaccgctctgatctcccttacatgcagcaacacgatgttcaccctgacagtcgcctggcgcaccgctacactcattctggccggcgtgtccctgcttccggtgtgtcaatctagctccatgagaaaaaccgactggctgcccatggccgtcgctgcgatgggggttcctcccctccctctgtttatcttctctctcaaggatacgctgaagcggcgcagctggccccttaatgagggagtgatggccgtgggcctggtctccatcctggcttctagcctcctgagaaacgacgtgcctatggccgggccccttgttgccggaggcctgctcattgcttgctatgtgatcacagggacctccgccgatctgaccgtcgaaaaagcggctgacattacatgggaggaggaagccgagcagaccggagtgagccataacctcatgatcacagttgatgacgacggcacgatgcggattaaggatgacgaaaccgagaatatcctgacagtgcttctgaaaaccgccctgctcatcgtctctggcgtgtttccgtactccattcctgctacactgcttgtctggcacacctggcagaagcagacgcaacgcagcggggtgctgtgggatgttccctctcctcccgagacccagaaagccgaactcgaggaaggagtgtacagaatcaagcagcagggcattttcgggaaaacacaagtcggagtgggcgttcagaaggagggggtgtttcataccatgtggcacgtcacacggggagcggtgctgacctataacggcaagcgcctcgaaccgaattgggcttccgtgaaaaaggacctgatcagctctggcgggggatggagactttccgcccagtggcaaaaaggcgaggaggttcaggtcattgccgtggaacctgggaagaaccccaaaaatttccagacaatgcctggaacgttccagaccacaaccggcgagatcggggctattgccctggattttaagcccggaaccagcggctcccccatcatcaaccgggaaggcaaggtggtcgggctgtacggaaatggcgtggttaccaagaacgggggatatgtgagcggcattgctcaaacgaatgccgagcctgacgggccgacccccgaactcgaggaggaaatgttcaagaaacgcaacctgacaatcatggatcttcaccctggctctggaaagaccagaaaatacctgcccgcgattgtccgggaggccatcaagagacgcctccggacactgattctcgctcctaccagagtggttgccgctgaaatggaggaagccctgaagggccttcccatccgctatcagacgacagccaccaaaagcgagcataccgggcgggagatcgtggacctgatgtgtcacgctacatttaccatgagactgctctcccctgtccgcgtgccgaattacaacctgattatcatggatgaagcgcatttcacagaccccgcctctattgctgcccggggatatatcagcaccagagttggcatgggggaggccgctgccatttttatgacggcgacacctcccggaaccgctgatgccttccctcagtccaatgcccccatccaggacgaagaacgcgatatcccggagcggtcttggaacagcggcaatgaatggattacagactttgctgggaagaccgtgtggttcgtcccttccatcaaagccggcaacgacattgcgaactgccttagaaagaatggcaaaaaggtgatccaactgtctcggaagacgtttgataccgagtaccagaaaacaaagctcaacgactgggatttcgtggtcaccacagacattagcgaaatgggagccaattttaaagctgatcgcgttatcgaccccagacggtgtctgaagcccgtgattctgaccgatgggcctgagcgcgtgatcctcgccggacccatgcctgtcacagctgcctccgctgcccagagacggggcagagtggggcgcaacccgcagaaagaaaatgaccaatacatcttcaccggacagccccttaacaatgatgaggaccacgcgcattggacggaggccaagatgctgctggataacattaatacacctgaaggcatcattcccgctctcttcgagcctgaacgggagaaaagcgccgctatcgacggggaatatagactgaaaggcgaatctcgcaagacctttgttgagcttatgcggagaggagacctgcccgtgtggctcgcccacaaagtcgcctccgaaggcattaagtacaccgatcgcaaatggtgcttcgacgggcagcggaacaatcagatcctggaggaaaacatggatgtggagatctggacaaaggaaggagagaaaaagaagctgagaccgcgctggctcgacgctagaacctatagcgatcctcttgcgctgaaagagtttaaggacttcgccgctggccggaaatctattgccctggatctcgttacagaaatcgggcgcgtgccctcccacctggcccatagaacgcggaatgctcttgacaacctggtcatgctccacaccagcgagcatggaggccgcgcctacagacacgcggtggaggaactgcctgagacaatggaaaccctgctccttctgcggctgatgattctcctgacaggcggggccatgctttttctgatctccggaaagggcattgggaaaacctctatcggactcatctgcgtcattgctagctccggcatgctgtggatggccgagatccccctgcaatggattgctagcgccatcgtgctcgagttctttatgatggttcttctgattcctgagcccgaaaagcagagaacgccgcaggataatcaactggcgtatgtggtgatcgggattctcaccctggccgctatcatcgccgctaacgagatgggacttctggagacaaccaagcgcgacctcggcatgtctaaagaacctggcgtcgtttcccccacaagctacctggatgtggacctgcaccccgcctctgcttggaccctctatgccgtggcgacgacagtcattacccctatgcttcggcatacaatcgagaatagcaccgccaacgtgtccctggctgccattgctaaccaggccgttgtgctgatggggctcgataagggatggccgatctctaaaatggacctgggcgtcccccttctggccctcgggtgttacagccaggtgaatcctctgaccctgacagcggctgtcctccttctgattacgcactacgccatcatcggacccggcctgcaggctaaggccaccagagaagcccaaaaacgcacagctgccgggattatgaagaaccctaccgtggacggaatcatgacaattgatctcgaccccgttatctatgattccaagttcgagaaacagctgggccaggtgatgcttctggtcctctgcgcggtgcagctgctgctcatgcggacctcttgggccctttgtgaagctctgacgctggccacaggccctattaccaccctctgggaggggagcccgggaaagttttggaatacaaccatcgctgtttccatggccaacatcttcagaggcagctacctggcgggggccggacttgctttttctattatgaaatccgtgggcacagggaagcggggaacgggcagccaaggcgagaccctgggggaaaaatggaagaagaaactcaatcagctgtcccgcaaggagttcgacctgtataaaaagtctggaatcacagaagtcgatagaaccgaggccaaagaaggcctcaagagaggggaaattacacatcacgctgtgagccgcggatccgccaaacttcagtggtttgtggagagaaacatggttatccccgaaggccgggtcattgacctggggtgcggacgcggcggctggtcttactattgtgctgggctgaagaaggtgaccgaggtgagaggatacacgaaaggcgggcctggacatgaggaacccgtccctatgagcacctatggctggaatatcgttaagctcatgtccgggaaagatgtgttctacctgcccccggagaagtgcgacacacttctgtgtgatattggagaaagctctccttcccccaccgtggaggaaagccggacaatccgcgtcctcaaaatggtggagccctggctgaagaacaatcagttctgcatcaaggttctgaacccttacatgcccaccgtgattgaacacctcgagagacttcaacggaaacacggcggcatgctggtcagaaatcctctgtctcgcaactccacacatgagatgtattggatcagcaatgggaccggaaacattgtggcctctgttaatatggtgagccggctcctgcttaacagatttacgatgacacaccgccggccgaccatcgaaaaggacgtcgatctgggcgcggggaccagacatgtgaacgccgagcccgaaacacctaatatggacgtgattggagagcgcatcaaacggatcaaggaggagcacaactccacgtggcactacgatgacgagaatccctataaaacctgggcttaccatggctcttatgaagtcaaggccacagggagcgcttccagcatgattaacggagttgtgaagctcctgaccaaaccttgggacgtggtccccatggtgacacagatggccatgaccgatacaaccccgttcggccagcaaagagtttttaaggagaaagtggacacgcgcacccctcggtccatgcccggcacaagacgcgtcatggggatcaccgccgaatggctgtggcggacactcggaagaaataagaaacctcgcctgtgtaccagagaggagttcacgaagaaggtgcggacaaacgcggctatgggcgccgtttttaccgaggagaatcagtgggattctgccaaagctgccgtggaagacgaggatttctggaaacttgtcgaccgcgaaagagagctgcacaaactcgggaagtgcggaagctgtgtgtacaacatgatgggcaaacgggagaagaaactgggggaatttggcaaggctaagggatccagagccatttggtatatgtggcttggcgcgcggtacctggagttcgaagccctcgggtttctgaatgaggatcattggttctctcgcgaaaacagctactccggagttgagggcgaggggctgcacaaactcggatatatcctgagagacatttctaagatccccggcggggctatgtacgccgatgacacagctggctgggatacccggatcacggaagacgaccttcataatgaggagaaaattacccagcagatggatcctgagcaccgccaactggccaacgcgatctttaagctcacatatcagaataaagtggtcaaggtgcagagacccaccccgacaggaaccgtcatggacattatcagccggaaggatcagcgcggctccgggcaagtgggaacatacggcctgaacaccttcacgaatatggaagcccagcttattagacagatggagggggagggagttctgagcaaagctgacctcgaaaaccctcatctgcccgagaagaaaatcacacagtggctggaaaccaagggcgtggagcggctcaaacgcatggccatctctggggatgactgcgtcgtgaagcccattgatgacagatttgctaacgccctgcttgctctgaatgatatgggcaaggtgcggaaagacatccctcaatggcagccgtccaagggatggcatgattggcagcaggttcccttctgcagccaccatttccacgaactcattatgaaagacggccgcaagctggtggtcccttgtagaccccaagatgagcttatcgggcgggcccgcatttctcagggagcgggctggtccctgagagagaccgcctgcctcgggaaggcttatgcccagatgtggagcctgatgtactttcaccggagagacctgcgcctcgcctctaacgctatctgttccgccgtgcctgttcattgggtgcccacaagccggaccacatggtccattcacgcgcatcaccaatggatgacgaccgaagacatgctgacagtctggaatagagtgtggatcgaggataacccttggatggaagacaagacccccgtcacaacctgggagaatgtgccgtatcttggaaagcgcgaggatcagtggtgcggcagcctgatcgggctcacgtctcgggctacctgggcccagaacattcctacagccatccagcaagttagaagcctgattggcaatgaagagttccttgactacatgccctccatgaaacgctttcggaaggaagaggaatctgagggagctatctggtga

SEQ ID NO: 20404 - RNA, 9873 nt, synthetic construct
  misc_feature 1..9873: note = derived and/or modified CDS sequence (opt5) from DENV-3__JF808129__SS-prME
  source 1..9873: mol_type = other RNA
accagcctgtgcctcatgatgattctgcccgccgctcttgccttccacctgacatcccgggacggagagcctcggatgattgtggggaagaatgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcacgggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgaagtctacacacagctgtgtgaccaccggcttatgagcgctgccgttaaggatgagagagccgtgcacgctgacatggggtactggatcgagtcccagaaaaacggatcttggaagctcgaaaaagccagcctgattgaggtgaagacctgcacctggcctaagtcccatacactgtggtctaatggcgtcctcgaaagcgatatgatcattcccaaatccctggcggggcctatcagccagcacaaccatcgccccggatatcacacccaaacggctggcccttggcaccttgggaagctggagctcgactttaattactgcgagggaacaaccgtggttattacagaaaactgtggcacccggggcccctctctgagaacaaccacggtgtccgggaaactgatccatgagtggtgctgtcgcagctgcacccttccgcctctccggtatatgggagaagatggctgttggtacgggatggagatcagacccatttctgaaaaggaggagaatatggtcaaatccctggtgagcgccggatctggcaaggttgacaactgcacaatgggggtgctgtgtctcgccatcctgttcgaagatgtcatgcggggaaagtttggcaaaaagcacatgattgctggcgtgttcttcacctttgttcttctgctcagcgggcagatcacatggcgcgacatggcccataccctgattatgatcggatccaatgcgagcgatagaatgggcatgggggtgacgtatctggctcttattgccacattcaaaatccagccctttctggccctcggattctttctgcggaagctcacctctagagagaacctgcttctgggcgtcgggctcgctatggccacaaccctgcaactgcctgaagacatcgagcagatggctaatggaattgcccttggcctgatggcgctcaaactgatcacccagttcgaaacataccagctctggacggccctgatttcccttacctgcagcaacacaatgtttaccctgacagtggcttggcgcaccgccacgctcatcctggctggcgtgtccctgcttccggtctgtcaatctagctccatgcggaagacagattggctgcccatggccgttgccgctatgggggtgcctcccctccctctgttcatcttttctctcaaggacaccctgaaaagacgcagctggccccttaatgagggagtgatggcggtcggcctggtgtccatcctggcctctagcctcctgagaaacgatgttcctatggctgggccccttgtggccggaggcctgctcatcgcctgctatgtcattaccgggacatccgctgacctgaccgtggagaaggccgcggacatcacatgggaagaggaagctgagcagacgggagttagccacaacctcatgaccacagtggatgacgatggcaccatgcggattaaagacgatgaaacagagaatatcctgaccgtccttctgaagacggccctgaccattgtgtctggcgtcttcccgtactccatccctgccacactcctggtgtggcatacctggcagaaacagacacaacgcagcggggttctttgggacgtgccctctcctcccgagacccagaaggctgaacaggaggaaggagtctacagaatcaaacagcaaggcatttttgggaagacacaggtgggagttggcgtgcagaaggagggggtcttccacacgatgtggcacgtgacccggggagccgtgctgacatataacggcaaacgcctcgagccgaattgggcgtccgttaagaaagatctgatcagctacggcgggggatggagactctctgctcaatggcagaagggcgaagaggtccaggtgattgccgtggaacctgggaaaaaccccaagaattttcagaccatgcctggaaccttccaaacaacgaccggcgagatcggggccattgctctggacttcaagcccggaacatccggcagccccatcattaaccgggaaggcaaagtcgtggggctttatggaaatggcgttgtgaccaagaacgggggatacgtctccggcatcgcccagacaaatgctgagcctgatgggccgacccccgagctggaagaggaaatgtttaaaaagcgcaacctgacgatcatggacctccatcctggcagcggaaaaacaagaaagtatctgcccgccattgtgcgggaggcgatcaagcgcagacttcggaccctgattctcgcccctaccagagttgtggctgccgaaatggaggaggctctgaaaggcctccccatccgctaccagacaaccgccacaaagtctgaacacaccgggcgggagattgtcgatctgatgtgtcatgccacgttcacaatgagacttctgagccctgtgcgcgttccgacctataatctgatcatcatggacgaagctcactttacagatcccgcgtccattgccgctcggggatacatctctaccagagtgggcatgggggaggccgccgctattttcatgacggccacccctcccggaacagcggacgcttttcctcagagcaacgcccccatccaagacgaggaacgcgatattccggagcggtcctggaactctggcaacgaatggatcaccgacttcgccgggaaaacagtctggtttgtgcctagcatcaaggctggcaatgatattgccaactgcctccgcaaaaacggaaagaaggtgatccagctgtccagaaaaaccttcgacacagagtaccagaagaccaaacttaatgattgggactttgtcgttacgacagatatttctgaaatgggcgcgaacttcaaggccgaccgggtgatcgatcccagacggtgcctgaaacccgtgattctcaccgacgggcctgagcgcgtcatcctggctggacccatgcctgtgaccgccgctagcgccgctcagagacggggccgcgttgggagaaatccgcaaaaggagaacgatcagtatatttttacaggacagcccctgaataacgacgaagaccatgcccactggaccgaggcgaagatgctccttgataatatcaacacacctgaaggcatcattcccgccctgttcgagcctgaacgggagaaatccgctgccatcgacggggagtacagactgaagggcgaaagccgcaaaacgttcgtggagctcatgcggagaggagatctgcccgtctggcttgctcacaaggtggcctctgaaggcattaaatataccgaccgcaagtggtgttttgatgggcagcggaataaccaaatcctggaggaaaatatggacgttgagatttggacaaaagagggagaaaagaagaaactcagaccgcgctggctggatgcccggacctactccgaccctctggctctcaaggagttcaaagattttgcggccggcagaaagagcatcgctcttgacctggtgacagaaatcgggcgcgtcccctctcatctggcccacagaacccggaacgccctcgataatctggtgatgcttcatacgtccgagcacggaggccgcgcttatagacacgccgtcgaagaactccctgagaccatggaaacactcctgctgctcggccttatgattctgctgaccgggggagcgatgctgttcctgatcagcggcaaagggattggaaagacatccatcggccttatttgcgtgatcgcctctagcgggatgctgtggatggctgagatccccctccagtggattgcctccgctatcgttctggaatttttcatgatggtgctgctcattcctgagcccgagaagcagcggaccccgcaagacaaccagcttgcctacgtggtcatcggcattctgacgctggcggccatcattgctgccaatgaaatgggcctcctggagacaaccaaacgcgatcttggcatgagcaaggaacctggggttgtgtctcccacatcctatctggacgtggacctccatcccgctagcgcctggaccctgtacgctgtcgccaccacagtgatcacgcctatgctgagacacaccatcgagaactctacagcgaatgttagcctcgccgctattgccaaccaggctgtggtccttatgggactggataaaggctggccgatctccaagatggacctgggggtgcccctcctggcccttggatgttactctcaggtcaaccctctgaccctcacagccgcggtgctgctgctcattacccattatgctatcattggccccgggcttcaagccaaagctacgcgggaagcccagaagagaacagccgctggaatcatgaagaatcctaccgttgatggcatcatgaccattgacctggatcccgtgatctacgacagcaaatttgagaagcagctgggccaggtcatgctcctggtgctttgcgccgttcaactgctcctgatgcgcacatcctgggcgctgtgtgaggccctcacccttgctacagggcctattacgaccctgtgggaaggatctccgggcaaattctggaacacaaccatcgccgtgagcatggctaatatttttcgggggtcctatctggccggagcgggcctcgccttcagcatcatgaagtctgtcgggacaggaaaaagaggcaccggctcccagggggagacgctgggagaaaagtggaagaagaaacttaaccagctgagccgcaaagagtttgatctctacaagaaatccggcatcaccgaagtggaccggacagaggctaaagaggggctgaaaagaggagaaattacccaccatgccgtgtctcggggcagcgctaagctgcagtggttcgttgagcgcaatatggtcatccccgaagggagagtgattgatctcggatgcggccggggcgggtggtcctattactgtgccggacttaagaaagtgacagaggtccgcggctataccaaagggggacctggccacgaggagcccgttcctatgtctacatacgggtggaacatcgtgaaactgatgagcggaaaggacgtgttttacctgcccccggagaaatgcgataccctcctgtgtgacattggcgaatccagcccttctcccacggtcgaggaatccagaacaatccgggtgcttaagatggttgagccctggctgaagaataaccaattctgcattaaagtgctcaatccttatatgcccaccgtcatcgagcacctggaacgcctgcagagaaagcatggcgggatgctcgtgcggaaccctcttagccgcaattctacccacgagatgtactggatctccaacggaacaggcaatattgttgctagcgtgaacatggtctctagactgctgctcaatcggttcacgatgacccatagacgcccgacaatcgaaaaagatgtggacctgggggccggaacccggcacgtgaacgcggagcccgaaacacctaacatggacgtcattggcgagagaatcaagcgcaccaaagaggaacacaatagcacatggcattatgatgacgagaacccctacaagacctgggcctatcacgggtcctacgaagttaaggctacgggatctgccagctccatgattaatggcgtggtgaaacttctgaccaagccttgggatgtcgtgcccatggttacacagatggctatgaccgacacaaccccgtttggccaacagcgggtgttcaaagagaaggtcgatacgagaacacctcgcagcatgcccgggacccggagagtgatgggaatcacagccgaatggctctggcgcaccctgggccggaacaaaaagcctagactgtgtacgcgcgaggagtttaccaagaaagttcggacaaatgccgcgatgggggctgtgttcaccgaagagaaccagtgggactccgccaaggccgctgtcgaagatgaggacttttggaaactcgtggatagagaacgcgagctgcataaacttggaaaatgcggctcttgcgtttataatatgatggggaagagagagaaaaagctgggcgagttcggaaaggccaaaggcagccgggctatctggtacatgtggctcggggcccgctacctggagtttgaagcgcttggattcctgaacgaggaccactggttttccagagaaaattcttatagcggcgtggaaggggagggactccataagctgggctacattctgcgggatatctccaaaattcccgggggcgccatgtatgctgacgacacagccggatgggataccagaatcacagaagacgatctccacaacgaggaaaagattacccagcaaatggaccctgagcaccggcagctggctaatgccatcttcaaacttacgtaccagaacaaggtcgtgaaggtccagcgccccacaccgaccggcaccgtgatggatatcatttctagaaaagaccaacgggggagcggacaggttggcacatatgggctgaatacctttacaaacatggaggcgcagctcatccgccagatggaaggagagggcgtgctgtccaaggccgatcttgaaaatcctcatctgcccgagaaaaagattacgcaatggctcgaaaccaaaggggtcgagagactgaagcggatggctatcagcggcgacgattgtgtggtgaagcccattgacgatcgcttcgccaacgctctgctcgccctgaacgacatgggaaaagttagaaaggatatccctcagtggcagccgtctaaaggctggcacgactggcagcaagtgcccttttgctcccatcacttccacgagcttatcatgaaggacgggcggaaactggtcgtgccttgtcgcccccaggatgaactcattggacgggctcggatcagccagggcgccgggtggtctctgcgcgagacagcgtgccttggaaaggcctacgctcaaatgtggtccctgatgtatttccatagacgggacctccgcctggccagcaatgccatttgttctgctgttcctgtgcactgggtccccacctccagaacaacctggagcatccatgcccaccatcagtggatgacgaccgaagatatgctgacagtgtggaaccgggtctggattgaggacaatccttggatggaagataagacccccgtgacaacctgggagaacgttccgtacctcggcaaaagagaggaccagtggtgcgggtccctgatcggccttacgagccgcgcgacatgggctcagaatattcctaccgccatccaacaggtgcggtctctgatcggaaacgaagagtttctcgattacatgcccagcatgaagagattccgcaaagaagaggagtccgaaggcgccatttggtga

SEQ ID NO: 20405 - RNA, 9873 nt, synthetic construct
  misc_feature 1..9873: note = derived and/or modified CDS sequence (opt5) from DENV-3__JF808123__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacacctggccacccttagaaaactgtgtatcgagggaaagattacaaacatcaccacggattcccggtgccctacacaaggcgaagcggtgctcccggaggaacaggaccagaattatgtgtgtaaacacacctacgtcgatcgcggctgggggaacggatgcggcctgttcgggaagggaagccttgtgacctgcgccaagtttcagtgtctgggccccattgaggggaaagttgtgcaatatgagaatctcaagtacacagtcatcatcaccgtgcatacaggagaccagcaccaggttggcaacgaaacgcagggcgtgaccgctgagattacacctcaagcctctaccacagaagctatcctgcccgagtatgggaccctgggactcgaatgctcccctagaacgggcctggacttcaatgagatgattcttctgaccatgaaaaacaaggcctggatggtccatcggcagtggtttttcgatctccccctgccgtggacaagcggggccaccacagagacccctacgtggaatcgcaaagaacttctggtgacatttaagaacgctcacgcgaaaaagcaggaggtcgtggttctcggatctcaagaaggcgccatgcacaccgctctgacaggggccaccgagatccagaattccggcggaaccagcattttcgccggccatctgaagtgtagactcaaaatggacaagctggaacttaaagggatgtcttacgctatgtgcacaaacacgtttgtgctgaagaaagaggtctccgagacccagcacggaacaatcctcatcaaggtggaatacaagggcgaggatgccccctgtaaaattcctttcagcaccgaagacgggcagggaaaggcgcataacggccggctgatcacagctaatcccgttgtgaccaaaaaggaggagcccgtcaacattgaagccgagcctccgttcggggaatccaatatcgtgattggcacgggagataacgccctgaaaatcaattggtataagaagggctctagcatcgggaaaatgtttgaggctacagccagaggagctcgccggatggccattcttggcgacaccgcgtgggatttcgggtccgtgggaggcgttctcaacagcctggggaagatggtccaccaaatctttggctctgcctacaccgctctgttctccggagtgagctgggtgatgaaaattggcatcggggtcctcctgacatggattggacttaattctaagaacaccagcatgtccttttcttgcatcgccattggcatcatcacactgtatctcggggctgtggttcaggccgacatgggatgtgtgattaattggaaaggcaaggaactgaagtgcgggagcggcatcttcgtcacgaacgaggtgcatacctggacagagcagtacaaatttcaggcggattcccccaagagactggccaccgctattgccggagcttgggaaaatggcgtttgtgggatccgcagcacaacccggatggagaaccttctctggaaacaaattgccaatgaactgaactatatcctgtgggagaataacatcaagctcacggtggtcgtgggagacattatcggcgttctggaacaggggaaaagaacccttacacctcagcccatggagctgaagtactcttggaaaacctggggaaaggccaagattgtgacagctgagacccagaactccagcttcatcattgatggccctaatacacccgaatgcccgtctgcgtcccgcgcctggaacgtctgggaggtggaagactatggctttggggtgttcaccacgaatatctggctcaaactgcgggaggtctacacacaactgtgtgaccacagacttatgagcgctgccgttaaggatgaacgcgccgtgcacgctgacatgggatactggatcgagtcccagaaaaacggctcttggaagctcgagaaagccagcctgattgaagtgaagacctgcacctggcctaagtcccatacactgtggtctaatggggtcctcgagagcgatatgatcattcccaaatccctggcgggacctatcagccagcacaaccatcggcccggctatcacacccagacggctgggccttggcaccttggaaagctggaactcgactttaattactgcgagggcacaaccgtggttattacagagaactgtggcaccagagggccctctctgcgcacaaccacggtgtccggaaaactgatccatgaatggtgctgtcggagctgcacccttccgcctctcagatatatgggcgaggatgggtgttggtacggaatggaaatccggcccatttctgagaaggaagagaatatggtcaaatccctggtgagcgccggctctgggaaggttgacaacttcacaatgggagtgctgtgcctcgccatcctgtttgaggaagtcatgcgcggcaagttcggcaaaaagcacatgattgctggggtgttctttaccttcgttcttctgctcagcggacaaatcacatggagagatatggcccataccctgattatgatcggctccaatgcgagcgaccggatggggatgggagtgacgtatctggctcttattgccacatttaaaatccagcccttcctggccctcggctttttcctgagaaagctcacctctcgcgagaacctgcttctgggggtcggactcgctatggccacaaccctgcagctgcctgaagatatcgagcaaatggctaatggcattgcccttggcctgatggcgctcaaactgatcacccagtttgaaacataccagctctggacggccctgatttcccttacctgtagcaacacaatgttcaccctgacagtggcttggcggaccgccacgctcatcctggctggggtgtccctgcttccggtctgccagtctagctccatgagaaagacagactggctgcccatggccgttgccgctatgggagtgcctcccctccctctgtttattttctctctcaaggataccctgaaacgcagaagctggccccttaatgagggcgtgatggcggtcgggctggtgtccatcctggcctctagcctcctgcggaacgacgttcctatggctggaccccttgtggccggcgggctgctcatcgcctgttatgtcattaccggaacatccgctgatctgaccgtggagaaggccgcggacatcacatgggaagaggaagctgagcaaacgggcgttagccacaacctcatgattaccgtggacgatgacggcacaatgcgcatcaaagatgacgaaaccgagaatattctgacagtccttctgaagaccgccctgctcatcgtgtctggggtctttccgtactccatccctgccacgctgcttgtgtggcatacctggcagaaacagacacagagaagcggagttctgtgggatgtgccctctcctcccgagacccaaaaggctgaactcgaggaaggcgtctaccggattaaacagcaggggatcttcggaaagacacaggtgggcgttggggtgcaaaaggagggagtctttcacaccatgtggcacgtgacacgcggcgccgtgctgacgtataacggcaaaagactcgagccgaattgggcgtccgttaagaaagacctgattagctacgggggaggctggcggctttctgctcagtggcagaagggggaagaggtccaagtgatcgccgtggaacctggaaaaaaccccaagaatttccagaccatgcctggcacattccagaccaccacaggggagattggagccatcgctctggattttaagcccggcacgtccggcagccccattatcaaccgcgaagggaaagtcgtgggactgtatggcaatggggttgtgaccaagaacggaggctacgtctccgggatcgcccagacaaatgctgagcctgacggcccgacccccgagctcgaagaggaaatgttcaaaaagagaaacctgacaattatggatcttcatcctggaagcggcaaaacccggaagtatctgcccgccatcgtgcgcgaggcgattaagagacggctcagaacgctgatcctcgcccctacacgcgttgtggctgccgaaatggaggaggctctgaaagggcttcccattcggtaccaaaccaccgccacaaagtctgaacacaccggaagagagatcgtcgacctgatgtgccatgccacatttaccatgcgcctgctcagccctgtgcgggttccgaattataacctgatcattatggatgaagctcacttcacggaccccgcgtccatcgccgctagaggctacatttctacacgcgtggggatgggagaggccgccgctatctttatgaccgccacacctcccggcaccgcggatgctttccctcagagcaatgcccccattcaggacgaagagcgggacatcccggagagatcctggaactctgggaatgaatggatcacggattttgccggcaaaaccgtctggttcgtgcctagcattaaggctggaaacgacatcgccaactgtcttcgcaaaaatggcaagaaggtgattcagctgtcccggaaaacatttgataccgagtaccaaaagacaaaactcaacgactgggatttcgtcgttaccacagacatctctgaaatgggggcgaattttaaggccgatagagtgattgacccccggcgctgcctgaaacccgtgatcctgaccgatggacctgagagagtcattctcgctggccccatgcctgtgacggccgctagcgccgctcagcggcgcgggagagttggacggaacccgcagaaggagaatgaccagtatatcttcacaggccaaccccttaacaatgatgaagaccatgcccactggaccgaggcgaagatgctgctggacaacatcaatacccctgaagggattatccccgccctcttcgagcctgaaagagagaaatccgctgccattgatggcgagtaccgcctgaagggagaaagccggaaaacatttgtggagcttatgagacgcggcgacctgcccgtctggctcgctcacaaggtggcctctgaagggatcaaatataccgatcggaagtggtgcttcgacggacagagaaacaatcagattctggaggaaaacatggatgttgagatctggacaaaagagggcgaaaagaagaaactgcgcccgcggtggctcgacgccagaacgtactccgatcctcttgctctgaaggagtttaaagacttcgcggccgggcgcaagagcatcgctctggatctcgtgaccgaaattggaagagtcccctctcatctggcccaccggacacgcaatgcccttgacaacctggtgatgctccatacctccgagcacggcggcagagcttatcggcacgccgtcgaagagctgcctgagacaatggaaaccctgctccttctggggctgatgatcctcctgacgggaggcgcgatgctttttctgattagcgggaaaggaatcggcaagacctccattgggctcatctgtgtgatcgcctctagcggaatgctgtggatggctgagattcccctgcagtggatcgcctccgctattgttctcgaattctttatgatggtgcttctgatccctgagcccgagaagcaacgcacaccgcaggataatcagctggcctacgtggtcattggcatcctcaccctggcggccattatcgctgccaacgaaatgggccttctggagacaaccaaaagagacctcgggatgagcaaggaacctggagttgtgtctcccacgtcctatctggatgtggacctgcatcccgctagcgcctggacactctacgctgtcgccaccacagtgatcacccctatgcttcggcacaccattgagaattctacagcgaacgttagcctggccgctatcgccaaccaagctgtggtcctgatgggcctcgacaaagggtggccgatttccaagatggatctgggagtgccccttctggccctcggctgctactctcaggtcaatcctctgacgctgaccgccgcggtgctccttctgatcacacattatgctattatcgggcccggactgcaggccaaagctaccagagaagcccagaagcgcacagccgctggcatcatgaagaaccctaccgttgacggcattatgacgatcgatctcgaccccgtgatttacgatagcaaattcgagaagcaactggggcaggtcatgcttctggtgctctgtgccgttcagctgctgctcatgcggacatcctgggcgctttgcgaggccctgaccctggctaccggacctatcacaaccctctgggaaggctctccggggaaattttggaatacaacgattgccgtgagcatggctaacatcttcagaggatcctatctggccggcgcggggcttgcctttagcatcatgaagtctgtcggaaccggcaaacgcggcacagggtcccagggagagaccctgggcgaaaagtggaagaaaaagctcaatcaactgagccggaaagagttcgacctgtacaagaaatccgggattacagaagtggatagaaccgaggctaaggagggactcaaacggggcgaaatcacgcaccatgccgtgtctcgcgggagcgctaagcttcagtggtttgttgagagaaacatggtcattcccgaaggacgggtgatcgacctgggctgtggccgcgggggatggtcctattactgcgccggcctgaagaaagtgaccgaggtcagagggtatacaaagggaggccctgggcacgaagagcccgttcctatgtctacctacggatggaatattgtgaaactcatgagcggcaaggatgtgttctacctgcccccggagaaatgtgacacacttctgtgcgatatcggcgaatccagcccttctcccaccgtcgaggaatcccggacaattcgcgtgctcaagatggttgagccctggctgaagaacaatcagttctgtatcaaagtgctgaacccttatatgcccaccgtcatcgagcacctcgaaagacttcagcggaagcatgggggaatgctggtgcgcaatcctctgagcagaaactctacgcacgagatgtactggatttccaatggcacagggaacatcgttgctagcgtgaatatggtctctcggctcctgcttaacagatttaccatgacccatcgccggccgacaattgaaaaagacgtggatctgggagccggcacgagacacgtgaacgcggagcccgaaacccctaatatggacgtcatcggggagcgcattaagcggatcaaagaggaacacaacagcacatggcattatgacgatgagaatccctacaagacctgggcctatcacggatcctacgaagttaaggctacaggctctgccagctccatgatcaacggcgtggtgaaactcctgaccaagccttgggacgtcgtgcccatggttacacaaatggctatgaccgatacgaccccgttcgggcagcagagagtgtttaaagagaaggtcgacacacgcacccctcggagcatgcccggaacaagacgcgtgatgggcattaccgccgaatggctgtggcggacgctcgggagaaataaaaagcctcgcctgtgcacacgggaggagttcaccaagaaagttagaacaaacgccgcgatgggagctgtgtttaccgaagagaatcaatgggattccgccaaggccgctgtcgaagacgaggatttctggaaacttgtggaccgcgaaagagagctgcataagctcggcaaatgtgggtcttgcgtttataacatgatgggcaagcgggagaaaaagctgggagaatttggcaaggccaaagggagccgcgctatctggtacatgtggcttggagccagatacctggagttcgaagcgctcggctttctgaatgaggatcactggttctcccgggagaactcttatagcggggtggaaggagagggcctgcataagctcgggtacattctgagagacatctccaaaattcccggcggagccatgtatgctgatgacacggccggctgggacacccggatcacagaagatgaccttcacaatgaggaaaagatcacccagcagatggatcctgagcaccgccagctggctaacgccatttttaaactcacataccaaaataaggtcgtgaaggtccagagacccaccccgacagggaccgtgatggacatcatttctcggaaagatcagcgcggaagcggccaggttgggacgtatggactgaacacattcaccaatatggaggcgcaacttatcagacagatggaaggcgagggggtgctgtccaaggccgacctcgaaaaccctcatctgcccgagaaaaagattacccagtggctggaaacaaaaggcgtcgagcggctcaagcgcatggctatcagcggagatgactgcgtggtgaagcccatcgatgacagatttgccaacgctctgcttgccctgaatgatatgggcaaagttcggaaggacattcctcagtggcaaccgtctaaagggtggcacgattggcagcaggtgcccttctgttcccatcacttccacgagctcatcatgaaggacggacgcaaactggtcgtgccttgcagaccccaggacgaacttattggccgggctcgcatcagccaaggggccggatggtctctgagagagaccgcgtgtctcggcaaggcctacgctcagatgtggtccctgatgtattttcatcggcgcgatctgagactcgccagcaacgccatttgctctgctgttcctgtgcactgggtccccacatcccggacgacctggagcatccatgcccaccatcagtggatgacaaccgaagacatgctgacagtgtggaatagagtctggattgaggataacccttggatggaagacaagacccccgtgacgacctgggagaatgttccgtaccttgggaaacgcgaggatcaatggtgtggctccctgatcggactcacaagccgggcgacctgggctcagaacatccctacagccattcagcaggtgagatctctgatcggcaatgaagagttccttgactacatgcccagcatgaagcgctttcggaaagaagaggagtccgaaggggccatttggtga

SEQ ID NO: 20406 - RNA, 9873 nt, synthetic construct
  misc_feature 1..9873: note = derived and/or modified CDS sequence (opt5) from DENV-3__JF808128__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagcgcaccgaagctacacaactggccacccttagaaagctgtgtatcgagggaaaaattacaaacatcaccacggattcccggtgccctacacagggcgaagcggtgctcccggaggaacaggaccagaattatgtgtgtaagcacacctacgtcgatcgcggctgggggaacggatgcggcctgttcgggaaaggaagccttgtgacctgcgccaagtttcaatgtctggagcccattgagggcaaggttgtgcagtatgaaaatctcaaatacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaagaacaaagcctggatggtccatcggcagtggtttctcgatctgccccttccgtggacaagcggcgccaccacagaaacccctacgtggaatcgcaaggagctgctcgtgacattcaaaaacgctcacgcgaagaaacaagaagtcgtggttctggggtctcaggagggagccatgcacaccgctctgacaggcgccaccgaaatccagaattccgggggcaccagcatttttgccggacatctcaagtgtagactgaagatggacaaacttgagctgaagggcatgtcttacgctatgtgcacaaacacgttcgtgctcaaaaaggaggtctccgaaacccagcacgggacaatcctgatcaaagtggagtacaagggagaagatgccccctgtaagattccttttagcaccgaggacggccaagggaaagcgcataacggacggctgatcacagctaatcccgttgtgaccaagaaagaggaacccgtcaacattgaggccgaacctccgttcggcgagtccaatatcgtgattgggatcggcgataacgcccttaagatcaattggtataaaaagggatctagcattggcaagatgttcgaagctacggccagaggggctcgccggatggccatcctcggagacacagcgtgggattttggctccgtggggggagttctgaacagcctgggcaaaatggtccaccagattttcgggtctgcctacaccgctctcttttccggcgtgagctgggtgatgaagatcggaattggcgtcctgcttacctggatcgggctgaattctaaaaacacaagcatgtccttctcttgcattgccatcggaatcattaccctctatctgggcgctgtggttcaggccgacatggggtgtgtgatcaattggaagggaaaagagctgaagtgcggcagcgggatttttgtcacaaacgaggtgcatacgtggaccgaacagtacaagttccaagcggattcccccaaaagacttgccacagctatcgccggcgcttgggagaatggagtttgtggcattcgcagcaccacacggatggaaaacctcctgtggaagcagatcgccaatgagctgaactatatcctctgggaaaataacattaaactgaccgtggtcgtgggggacatcattggagttcttgagcagggcaagagaacgctgacccctcagcccatggagctcaaatactcttggaagacatgggggaaatccaagatcgtgaccgccgaaacacaaaacagctcttttattatcgatggacctaatacccccgagtgcccgtccgctagccgcgcgtggaacgtctgggaagtggaggactatggcttcggcgtgtttacaaccaatatctggctgaagctgcgggaagtctacacgcagctttgtgaccacagactcatgtccgccgctgttaaagatgagcgcgccgtgcacgccgacatggggtactggattgagtctcagaagaacggaagctggaaactggaaaaggcttccctgatcgaggtgaaaacatgcacctggcctaagtctcataccctctggagcaatggcgtcctggaatccgatatgattatccccaagagccttgccgggcctatttctcagcacaaccatcggcccggatatcacacacaaaccgcgggcccttggcacctggggaaactcgagctggacttcaattactgcgagggaacgacagtggttatcaccgaaaactgtggcacaagaggccccgctctgcgcaccacaaccgtgtccgggaagcttatccatgagtggtgctgtcggagctgcacgctcccgcctctgagatatatgggagaagatggctgttggtacgggatggagattcggcccatctctgaaaaagaggagaatatggtcaagtccctggtgagcgccggatctggcaaagttgacaactttaccatgggggtgctctgcctggccattcttttcgaagaggtcatgcgcggaaagtttggcaagaaacacatgatcgctggcgtgttcttcacatttgttctgctcctgagcgggcagattacctggagagatatggcccatacactgatcatgattggatccaatgcgagcgaccggatgggcatgggggtgacctatcttgctctgatcgccacgttcaagatccagccctttctcgccctgggattctttctcagaaaactgacatctcgcgaaaaccttctgctcggcgtcgggctggctatggccaccacactgcaacttcctgaggatattgaacagatggctaatggaatcgccctgggcctcatggcgctgaagctcattacccagttcgagacctaccagctgtggacagcccttatctccctgacgtgtagcaacaccatgtttacactcaccgtggcttggcggacagccaccctgattctggctggcgtgtcccttctgccggtctgccaatctagctccatgagaaaaacggactggctccccatggccgttgccgctatgggggtgcctcccctgcctctcttcatcttttctctgaaggatacacttaagcgcagaagctggcccctgaatgagggagtgatggcggtcggcctggtgtccatcctcgcctctagcctgcttcggaacgacgttcctatggctgggcccctggtggccggaggcctcctgattgcctgttatgtcatcaccgggacctccgctgatctcacagtggaaaaagccgcggacattacctgggaggaagaggctgaacagacaggagttagccacaacctgatgatcacggtggacgatgacggcaccatgcgcattaaggatgacgagacagagaatatccttaccgtcctgctgaaaacagccctcctgatcgtgtctggcgtcttcccgtactccattcctgccacccttctggtgtggcatacgtggcagaagcagacccaaagaagcggggttctctgggatgtgccctctcctcccgaaacacagaaagctgagctggaagagggagtctaccggatcaagcagcagggcatttttgggaaaacccaagtgggagttggcgtgcagaaggagggggtcttccacacaatgtggcacgtgacccgcggagccgtgctcacatataacggcaagagactggaaccgaattgggcgtccgttaaaaaggaccttgtcagctacggcgggggatggcggctgtctgctcagtggcaaaaaggcgaggaagtgcaggtgatcgccgtcgagcctgggaagaaccccaaaaattttcagacgatgcctggaaccttccagacaaccaccggcgaaattggggccatcgctctggatttcaagcccggaacatccggcagccccattatcaaccgcgagggcaaggtggttgggctctatggaaatggcgtggtcacgaaaaacgggggatacgtgtccggcatcgcccaaaccaatgctgagcctgacgggccgacacccgaactggaggaagagatgtttaagaaaagaaaccttaccattatggatctgcatcctggcagcggaaagacacggaaatatctccccgccatcgttcgcgaagcgattaagagacggctgagaaccctcatcctggcccctacgcgcgtggtcgctgccgagatggaggaagctcttaagggcctgcccattcggtaccagacaaccgccaccaaatctgagcacacagggagagaaatcgtggacctgatgtgccatgccaccttcacaatgcgcctcctgagccctgttcgggtgccgaattataaccttatcattatggatgaggctcactttaccgaccccgcgtccatcgccgctagaggatacatttctacgcgcgtcggcatgggggaagccgccgctatcttcatgacagccacccctcccggaacagcggatgcttttcctcagagcaatgcccccattcaggacgaggagcgggacatcccggaaagatcctggaactctggcaatgagtggatcaccgatttcgccgggaagacggtgtggtttgtgcctagcattaaagctggcaacgacatcgccaactgtctgcgcaagaatggaaaaaaggtcattcaactctcccggaagaccttcgatacagaataccagaaaaccaagctgaacgactgggattttgttgtgacaaccgacatctctgagatgggcgcgaatttcaaagccgatagagtgattgacccccggcgctgcctgaagcccgtcatcctcacagatgggcctgagagagtgattcttgctggacccatgcctgttaccgccgctagcgccgctcagcggcgcggcagagtggggcggaacccgcagaaagaaaatgaccaatatatctttacgggacagcccctgaacaatgatgaggaccatgcccactggacagaagcgaagatgctgctcgacaacatcaatacccctgagggcattatccccgccctgttcgaacctgagagagagaagtccgctgccattgatggggaataccgccttaaaggcgagagccggaagaccttcgtcgaactgatgagacgcggagacctccccgtgtggctggctcacaaagttgcctctgagggcatcaagtatacagatcggagatggtgctttgacgggcagcgcaacaatcagattctggaagagaacatggatgtggagatctggaccaaagaaggagagaagaaaaagctccggccgagatggcttgacgcccgcacatactccgatcctctggctctgaaggaattcaaagactttgcggccggcagaaagagcatcgctctcgatctggtcacggagattgggcgggtgccctctcatcttgcccaccgcaccagaaatgccctggacaacctcgtcatgctgcatacatccgaacacggaggccgggcttatcgccacgccgtggaggagctgcctgaaaccatggagacactccttctgctgggcctcatgatcctgcttaccgggggagcgatgctgttcctcattagcggcaaagggatcggaaagacgtccattggcctgatctgtgttatcgcctctagaagcatgtcctggatggctgaaattcccctgcaatggatcgccagcgctattgtgctcgagtttttcatgatggtgcttctgatccctgagcccgaaaaacagcggaccccgcaggataatcaactggcctacgtcgttattgggatcctcacactggcggccattatcgctgccaacgagatgggacttctggaaaccacaaagagagacctcggcatgtctaaggagcctggcgtggtgtcccccaccagctatctggatgtcgacctgcatcccgcttctgcctggacgctctacgctgtggccacaaccgttatcacacctatgcttcgccacaccattgaaaatagcaccgcgaacgtgtccctggccgctatcgccaaccaggctgtcgtgctgatggggctcgacaaaggatggccgatttctaagatggatctgggcgtcccccttctggccctcgggtgctacagccaggtgaatcctctgacactgacggccgcggttctccttctgatcacccattatgctattatcggacccggcctgcaggccaaagctacacgggaggcccaaaagagaaccgccgctgggatcatgaaaaaccctacagtggacggaattatgaccatcgatctcgaccccgtcatttacgattccaagtttgagaagcagctgggccaggtgatgcttctggttctctgtgccgtgcagctgctgctcatgcgcacgtcttgggcgctttgcgaagccctgacactggctaccggccctatcaccacactctgggaggggagcccgggaaaattctggaataccacaattgccgtctccatggctaacatctttcggggcagctatctggccggggcgggacttgccttctctatcatgaagtccgtgggcacggggaaaagaggaaccggcagccaaggcgaaacactgggggagaagtggaaaaagaagctcaatcagctgtcccggaaagaatttgacctgtacaagaaatctggaattaccgaggtggatcgcacagaggctaaggaaggcctcaaaagaggggagatcacccaccatgccgttagccggggatccgctaagcttcagtggttcgtcgaacgcaacatggtgattcccgagggcagagtgatcgacctggggtgtggacggggcggctggtcttattactgcgccgggctgaaaaaggtcacggaagttcgcggatataccaagggcgggcctggacacgaggagcccgtgcctatgagcacatacggctggaatattgtgaaactcatgtccgggaaggatgtcttttacctgcccccggaaaaatgtgacacccttctgtgcgatatcggagagagctctccttcccccacagtggaagagagcagaaccattcgggttctcaagatggtggagccctggctgaaaaacaatcagttctgtatcaaggtcctgaacccttatatgcccacagtgatcgaacacctcgagcgccttcaaagaaagcatggcggcatgctggttcggaatcctctgtctagaaactccacccacgaaatgtactggattagcaatgggacgggaaacatcgtggcttctgtcaatatggtgagccgcctcctgcttaaccggttcacaatgacccatagacgcccgaccattgagaaagacgtggatctgggcgccgggacacggcacgtcaacgcggaacccgagacgcctaatatggacgttatcggagagagaattaagcgcatcaaagaagagcacaactccacctggcattatgacgatgaaaatccctacaagacatgggcctatcacggctcttacgaggtgaaagctaccgggagcgcctccagcatgatcaacggagtggtcaagctcctgacaaagccttgggacgtggttcccatggtgacccagatggctatgacagataccacgccgtttggccagcaacgggtcttcaaagaaaaggtggacaccagaacacctcgctccatgcccggcacccggagagttatggggattacagccgagtggctgtggcgcaccctcggacggaataaaaagcctagactgtgcacgcgcgaggaatttacaaaaaaggtgagaaccaacgccgcgatgggcgctgtcttcacagaggaaaatcagtgggattctgccaaggccgctgtggaggacgaagatttttggaaacttgttgaccgggagcgcgagctgcataagctcgggaaatgtggaagctgcgtgtataacatgatgggcaagagagaaaaaaagctgggggagttcggcaaagccaagggatcccgggctatctggtacatgtggcttggcgccagatacctggaatttgaggcgctcgggttcctgaatgaggatcactggttttctcgggaaaacagctattccggagtcgagggcgaagggctgcataagctcggatacattctgcgcgacatctctaaaattcccggcggggccatgtatgctgatgacaccgccggctgggacacgagaatcaccgaggatgaccttcacaatgaagagaagatcacacagcagatggatcctgagcaccggcaactggctaacgccattttcaaactcacctaccagaataaggtggtcaaagtgcagcgccccacaccgaccggaacagttatggacatcattagcagaaaggatcagcggggctccgggcaagtgggaacctatggcctgaacacgtttacaaatatggaagcgcagcttatccgccagatggagggggaaggagtcctgagcaaggccgacctcgagaaccctcatctgcccgaaaaaaagattacccagtggctggagaccaaaggcgtggagagactcaagcggatggctatctctggggatgactgcgtggttaaacccatcgatgaccgcttcgccaacgctctgcttgccctgaatgatatgggcaaggtgagaaaggacattcctcaatggcagccgtccaaaggatggcacgattggcagcaggtccccttttgtagccatcacttccacgaactcatcatgaaggacggccggaaactggtggttccttgccgcccccaagacgagcttattgggagagctcggatctctcagggagccggctggtccctgcgcgaaacagcgtgtctcgggaaggcctacgctcagatgtggagcctgatgtatttccatagacgggatctgagactcgcctctaacgccatttgctccgctgtgcctgtccactgggtgcccaccagccgcacaacgtggtccatccatgcccaccatcaatggatgaccacagaggacatgctgaccgtctggaatcgggtgtggattgaagataacccttggatggaggacaaaacacccgttaccacgtgggagaatgtgccgtaccttggaaagagagaagatcagtggtgtggcagcctgatcgggctcacctctcgcgcgacatgggctcagaacatccctaccgccattcagcaagtccggagcctgatcggcaatgaggaatttcttgactacatgccctccatgaagagattccgcaaagaggaggaatctgagggagccatttggtga

SEQ ID NO: 20407 - RNA, 9873 nt, synthetic construct
  misc_feature 1..9873: note = derived and/or modified CDS sequence (opt5) from DENV-3__JF808122__SS-prME
  source 1..9873: mol_type = other RNA
accagcctgtgcctcatgatgatcctgcccgccgctcttgccttccacctgacatccagagacggagagcctcggatgattgtggggaagaatgaacgcggaaaatctctcctgtttaagacggcgagcggcatcattaaatgtacccttatcgctatggatctgggggagatgtgcgacgataccgtgacctacaagtgtccgcatattacagaagttgagcccgaagacatcgattgctggtgtaatctcacctccacatgggtgacctatggaacgtgcaaccaggccggcgagagacggcgcgacaaaagatctgtggccctggctcctcacgtcgggatgggactggatacccggacacagacctggatgagcgccgagggcgcttggcgccaggtggaaaaggttgagacatgggccctcagacatcccggcttcaccatcctggcgctttttctggcccactacattgggacgtccctcacacagaaggtggtcatcttcattctgcttatgctggtgaccccttctatgacaatgcggtgtgttggagtgggcaatcgcgactttgtcgaagggctcagcggagctacctgggtggatgtggtcctggagcatggcgggtgcgttaccacaatggccaaaaacaagcccacgctggacatcgagctccagaaaaccgaagctcctcacctggccacacttagaaagctgtgtattgagggaaaaatcaccaatattacaaccgattcccggtgcccgacgcaaggcgaagcggtgctccccgaggaacaggaccagaactatgtgtgtaagcacacatacgtcgatcgcggctgggggaatggatgcggcctgttcgggaagggaagccttgtgacctgcgccaaatttcagtgtctggagcctatcgagggcaaggttgtgcaatatgaaaacctcaaatacaccgtcatcattacagtgcataccggggaccagcaccaggttggaaatgagacacagggcgtgacggctgaaatcacaccccaggcctctacaaccgaggctattctgcctgaatatggcacactggggctcgagtgctcccccagaaccggactggacttcaacgagatgatccttctgacgatgaagaataaagcctggatggtccatcggcagtggtttttcgatctcccgctgccttggaccagcggcgccacaaccgaaacacccacctggaaccgcaaggagcttctggtgacgtttaaaaatgctcacgcgaagaagcaggaagtcgtggttctcgggtctcaagagggagccatgcacacagctctgaccggcgccacagaaattcagaactccgggggcaccagcatcttcgccggacatctgaaatgtagactcaagatggacaaactggagcttaagggcatgtcttacgctatgtgcaccaatacatttgtgctgaaaaaggaggtctccgaaacgcagcacgggaccatcctcattaaggtggagtacaaaggagaagatgccccttgtaagatccccttcagcacagaggacggccaggggaaagcgcataacggacggctgattaccgctaaccccgttgtgacaaagaaagaggaacctgtcaatatcgaggccgaaccgcccttcggcgagtccaacattgtgatcgggaccggcgataatgccctgaagatcaactggtataagaaaggatctagcattggcaagatgtttgaagctacggccagaggggctcgccggatggccatccttggagacacagcgtgggatttcggctccgtcgggggagttctcaatagcctgggcaaaatggtccaccaaatttttgggtctgcctacaccgctctgttctccggcgtgagctgggtgatgaagatcggaattggcgtcctcctgacctggatcgggcttaactctaaaaatacaagcatgtccttttcttgcattgccatcggaatcattaccctgtatctcggcgctgtggttcaggccgacatggggtgtgtgatcaactggaagggaaaggagctgaaatgcggcagcgggattttcgtcacaaatgaggtgcatacgtggaccgaacagtacaagtttcaggcggattcccctaaaagactggccacagctatcgccggcgcttgggagaacggagtttgtggcattcgcagcaccacacggatggaaaatcttctctggaagcaaatcgccaacgagctgaattatatcctgtgggaaaacaatattaaactcaccgtggtcgtgggggacatcattggagttctggagcagggcaagagaacgcttacaccccaacctatggagctgaaatactcttggaagacctgggggaaggccaaaatcgtgaccgctgaaacacagaactccagcttcattatcgatggacccaacaccccggagtgcccttctgcgtcccgcgcctggaatgtctgggaagtggaggactatggctttggcgtgttcacaaccaacatctggctcaagctgcgggaagtctacacgcaactgtgtgaccacagacttatgagcgctgccgttaaagatgagcgcgccgtgcacgctgacatggggtactggattgagtcccagaagaatggatcttggaaactcgaaaaggccagcctgatcgaggtgaagacatgcacctggcccaaatcccataccctgtggtctaacggcgtcctcgaaagcgatatgattatccctaagtccctggcggggcccattagccagcacaatcatcggcctggatatcacacacagaccgctggcccctggcaccttgggaaactggagctcgactttaactactgcgagggaacgacagtggttatcaccgaaaattgtggcacaagaggcccgtctctgcgcaccacaaccgtgtccgggaagctgatccatgagtggtgctgtcggagctgcacgcttcctcccctcagatatatgggagaagatggctgttggtacgggatggagattcggcccatctctgaaaaagaggagaacatggtcaagtccctggtgagcgccggatctggcaaggttgacaatttcaccatgggggtgctgtgcctcgccattctgtttgaagaggtcatgcgcggaaaattcggcaagaaacacatgatcgctggcgtgttctttacattcgttcttctgctcagcgggcaaattacctggagagatatggcccatacactgatcatgattggatccaacgcgagcgaccggatgggcatgggggtgacctatctggctcttatcgccacgtttaagatccagcctttcctggccctcggatttttcctgagaaaactcacatctcgcgaaaatctgcttctgggcgtcgggctcgctatggccaccacactgcagctgccggaggatattgaacaaatggctaacggaatcgcccttggcctgatggcgctcaagctgattacccagtttgagacctaccagctctggacagccctgatctcccttacgtgtagcaataccatgttcacactgaccgtggcttggcggacagccaccctcattctggctggcgtgtccctgcttcccgtctgccagtctagctccatgagaaagacggactggctgcctatggccgttgccgctatgggggtgccccctctccccctgtttatcttctctctcaaagatacactgaagcgcagaagctggcctcttaacgagggagtgatggcggtcggcctggtgtccatcctggcctctagctttctccggaatgacgttcccatggctgggccgctggtggccggaggccttctgattgcctgttatgtcatcaccgggacctccgctgatctcacagtggaaaaagccgcggacattacctgggaggaagaggctgaacaaacaggagttagccacaacctgatgatcacggtggacgatgacggcaccatgcgcattaaggatgacgagacagagaacatcctcaccgtcctgcttaaaacagccctgctgatcgtgtctggcgtcttcccttactccattcccgccaccctcctggtgtggcatacgtggcagaagcagacccagagaagcggggttctttgggatgtgccttctcccccggaaacacaaaaagctgagctggaagagggagtctaccggatcaagcagcagggcatttttgggaagacccaggtgggagttggcgtgcaaaaagagggggtcttccacacaatgtggcacgtgacccgcggagccgtgctcacatataatggcaagagactggaacctaactgggcgtccgttaaaaaggacctcatcagctacggcgggggatggcggctgtctgctcagtggcagaaaggcgaggaagtccaagtgattgccgtggagcccgggaagaatcctaagaacttccagacgatgcccggaacctttcagacaaccaccggcgaaatcggggccattgctcttgatttcaaacccggaacatccggcagccctatcatcaatcgcgagggcaaggtcgtggggctgtatggaaacggcgttgtgacgaaaaatgggggatacgtctccggcattgcccagaccaacgctgagccggacgggcccacacctgaactggaggaagagatgtttaagaaaagaaatctcaccatcatggatctgcatcccggcagcggaaagacacggaagtatcttcctgccattgtgcgcgaagcgatcaaaagacggctgagaaccctcattctggcccccacgcgcgttgtggctgccgagatggaggaagctctcaagggcctgcctatccggtaccaaacaaccgccaccaaatctgagcacacagggagagaaatcgtcgaccttatgtgccatgccaccttcacaatgcgcctgctgagcccggtgcgggttcccaactataatctcattatcatggatgaggctcactttaccgaccctgcgtccattgccgctagaggatacatctctacgcgcgtgggcatgggggaagccgccgctattttcatgacagccacaccccctggaacagcggatgcttttccccagagcaacgccccgatccaggacgaggagcgggacatccctgaaagatcctggaactctggcaacgagtggattaccgatttcgccgggaagacggtctggtttgtgcccagcatcaaagctggcaatgacattgccaactgtctgcgcaagaacggaaagaaagtgatccagctttcccggaagaccttcgatacagaataccagaagaccaagctgaatgactgggattttgtcgttacaaccgacatttctgagatgggcgcgaacttcaaagccgatagagtgatcgacccccggcgctgcctcaagcctgtgattctgacagatgggcccgagagagtcatcctggctggacctatgccggtgaccgccgctagcgccgctcagcggcgcggcagagttgggcggaatccccagaaggaaaacgaccagtatatcttcacgggacaacctctcaataacgatgaggaccatgcccactggacagaagcgaaaatgcttctggacaatattaacacccccgagggcatcattcctgccctgtttgaacccgagagagagaagtccgctgccatcgatggggaataccgcctcaaaggcgagagccggaagaccttcgtggaactgatgagacgcggagaccttccggtctggctggctcacaaagtggcctctgagggcattaagtatacagatcggaaatggtgctttgacgggcagagaaataaccagatcctcgaagagaatatggatgttgagatctggaccaaggaaggagagaagaaaaagctgcgccctcggtggctggacgccagaacatactccgatcccctcgctcttaaagagttcaaggactttgcggccggccgcaaaagcattgctctggatctggtgacggagatcgggagagtcccttctcatctcgcccaccggacccgcaacgccctggacaatcttgtgatgctgcatacatccgaacacggaggcagagcttatcggcacgccgtcgaggagctccccgaaaccatggagacactgctgctccttggcctgatgattctgctcaccgggggagcgatgctgttccttatcagcggcaaggggattggaaagacgtccatcggcctgatctgtgtgattgcctctagcgggatgtcctggatggctgaaatccctctccagtggattgccagcgctatcgttctggagtttttcatgatggtgctgctcattcccgagccggaaaaacaacgcacccctcaggataaccagcttgcctacgtggtcatcggcattctgacactggcggccatcatcgctgccaatgagatgggcctcctggaaaccacaaagagagaccttggcatgtctaaagagcccggggttgtgtcccccaccagctatctggatgtggacctccatcctgcttctgcctggacgctgtacgctgtcgccacaaccgtgattacaccgatgctgcggcacaccatcgaaaacagcaccgcgaatgtttccctcgccgctattgccaaccaagctgtggtccttatgggactggacaagggctggcccatctctaaaatggatctgggggtgcctctcctggcccttggatgctacagccaggtcaaccccctgacactcacggccgcggtgctgctgctcattacccattatgctatcatcggccctgggcttcaggccaaggctacaagagaggcccagaagcgcaccgccgctggaattatgaaaaatcccacagttgacggcatcatgaccattgatctggaccctgtgatctacgattccaagtttgagaaacaactgggccaggtcatgctcctggtgctttgtgccgttcagctgctcctgatgcggacgtcttgggcgctgtgcgaagccctcacacttgctaccgggccgattaccacactgtgggagggaagccccggcaagttctggaacaccacaatcgccgtgtccatggctaatatctttagagggagctatctggccggagcgggcctcgccttctctattatgaaatccgtcgggacgggaaagcgcggcaccggcagccagggggaaacactgggagagaagtggaaaaagaaacttaaccaactgtcccggaaggaatttgacctctacaaaaagtctggcatcaccgaggtggatagaacagaggctaaagaagggctgaagcggggagagattacccaccatgccgtgagccgcggctccgctaagctgcagtggttcgttgaaagaaatatggtcatccctgaggggcgggtgattgacctcggatgtggccgcggcgggtggtcttattactgcgccggacttaaaaaggtgacggaagtcagaggctataccaaagggggacccggccacgaggagcctgttcccatgagcacatacgggtggaacatcgtgaagctgatgtccggaaaagatgtgttctacctgccgcctgaaaagtgtgacaccctcctgtgcgatattggcgagagctctccctcccccacagtcgaagagagccggaccatccgcgtgcttaagatggttgagccttggctgaaaaataaccagttttgtatcaaggtgctcaatccctatatgcctacagtcattgaacacctggagagactgcagcggaaacatggcgggatgctcgtgcgcaacccgctttctagaaattccacccacgaaatgtactggatcagcaacggaacgggcaatattgttgcttctgtgaacatggtcagccggctgctgctcaatagattcacaatgacccatcgccggcccaccatcgagaaggacgtggatctgggggccggaacaagacacgtgaacgcggaacctgagacgcccaacatggacgtcattggcgagcgcatcaaacggatcaaggaagaacacaattccacctggcattatgacgatgaaaacccttacaagacatgggcctatcacgggtcttacgaggttaaagctaccggaagcgcctccagcatgattaatggcgtggtgaaacttctgacaaaaccctgggacgtcgtgccgatggttacccaaatggctatgacagataccacgccttttggccagcagagagtgttcaaggaaaaagtcgacacccgcacaccccggtccatgcctgggaccagacgcgtgatgggaatcacagccgagtggctctggcggaccctgggcagaaacaagaagccccgcctgtgcacgcgggaggaatttaccaagaaggttagaaccaatgccgcgatgggggctgtgttcacagaggaaaaccaatgggattctgccaaagccgctgtcgaggacgaagatttttggaagctcgtggaccgcgagagagagctgcataaacttggaaagtgtggcagctgcgtttataatatgatggggaaacgggaaaagaagctgggcgagttcggaaaagccaacggctcccgcgctatttggtacatgtggctcggggccagatacctggaatttgaggcgcttggattcctgaaggagtatcactggttttctcgggaaaatagctactccggcgtggagggggaaggactccataaactgggctatatcctgagagatatttctaagatccctgggggcgccatgtacgctgacgataccgccggatgggacacgcggatcaccgaggacgatctccacaacgaagagaaaattacacagcagatggaccccgagcaccgccagctggctaatgccatcttcaaacttacctatcaaaacaaggtcgtgaaagtccagagaccgacacctaccggcacagtgatggatattatcagccggaaggaccagcgcgggtccggacaggttggcacctacgggctgaatacgtttacaaacatggaagcgcaactcattagacagatggagggagaaggcgtgctgagcaaagccgatcttgagaatccccatctgcccgaaaagaaaatcacccagtggctcgagaccaagggggtcgagcggctgaagcgcatggctatctctggcgacgattgcgtggtgaaacctattgacgatagattcgccaacgctctgctcgccctgaacgacacaggaaaggttcggaaagatatcccgcagtggcaaccctccaagggctggcacgactggcaacaggtgcctttctgtagccatcactttcacgaacttattatgaaagatgggcgcaagctggtcgtgccctgcagacctcaggacgagctcatcggacgggctcgcatttctcaaggcgccgggtggtccctgagagaaaccgcgtgtcttggaaaggcctatgctcagatgtggagcctgatgtacttccatcggcgcgacctcagactggcctctaatgccatctgctccgctgttcccgtgcactgggtccctacaagccggacgacctggtccattcatgcccaccatcagtggatgacaaccgaggatatgctgacagtgtggaacagagtctggatcgaagacaatccctggatggaggataaaaccccggtgacgacctgggagaacgttccttacctcggcaagcgcgaagaccaatggtgtgggagcctgatcggccttacatctcgggcgacctgggctcagaatattcccacagccatccaacaggtgagaagcctgattggaaacgaggaatttctcgattatatgccttccatgaaacgcttccggaaggaggaggaatctgagggcgccatctggtga

SEQ ID NO: 20408 - RNA, 9873 nt, synthetic construct
  misc_feature 1..9873: note = derived and/or modified CDS sequence (opt5) from DENV-3__GQ466079__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacacgatcggagttctggagcagggcaaacggacccttacacctcagcccatggagctgaagtactcttggaaaacctgggggaaggccaagattgtgacagctgaaacccaaaactccttctttatcattgatggacctaatacacccgagtgcccgagcgcgtctagagcctggaacgtctgggaagtggaggactatggcttcggcgtgtttaccacgaatatctggctcaaactgcgcgaagtctacacacagctgtgtgaccaccggcttatgtccgctgccgttaaggatgagagagccgtgcacgctgacatggggtactggatcgagagccagaaaaacggatcctggaagctcgaaaaagcctctctgattgaggtgaagacctgcacctggcctaagagccatacactgtggtccaatggcgtcctcgaatctgatatgatcattcccaaaagcctggcggggcctatctcccagcacaaccatcgccccggatatcacacccaaacggctggcccttggcaccttgagaatctggagctcgacttcacatactgcgaagggaccacagtggttattaccgagaactgtggaacacggggccccagcctgagaaccacgaccgtgtctggcaagctgatccatgaatggtgctgtcgctcctgcacacttccgcctctccggtatatgggggaggatggatgttggtacggcatggaaatcagacccattagcgagaaagaggaaaatatggtcaagtctctggtgtccgccgggagcggaaaagttgacaactttaccatgggcatcctgtgcctcgccattctgttcgaggaagtgatgcgggggaagttcggaaagaaacacatgatcgctggcgtctttttcacatttgtgcttctgctctctggccagattacctggcgcgatatggcccatacgctgatcatgattgggagcaatgcgtccgacagaatgggaatgggcgttacatatctggctcttatcgccaccttcaagatccagccctttctggccctcgggttctttctgcggaaactcacaagcagagagaacctgcttctgggagtgggcctcgctatggccaccaccctgcaactgcctgaagatattgagcagatggctaatgggatcgcccttggactgatggcgctcaagctgattacacagttcgagacgtaccagctctggaccgccctgatctctcttacatgttccaacaccatttttacactgaccgtcgcttggcgcacggccacactcatcctggctggcgtgagcctgcttccggtgtgccaatcctctagcatgcggaaaaccgactggctgcccatgaccgtcgccgccatgggcgttcctcccctccctctgttcatcttttccctcaaggatacactgaagagacgctcttggccccttaatgaaggggtgatggctgtgggactggtcagcattctggcgtcctctctcctgagaaacgacgtgcctatggccggcccccttgttgctgggggactgctcatcgcctgttatgtgattaccggcacaagcgccgatctgacggtcgagaaagctgccgacgtgacctgggaagaggaagcggagcagacaggggtttcccacaacctcatgatcaccgtggacgatgacggaacaatgcggattaaggatgacgagaccgaaaatatcctgacggtccttctgaaaaccgctctgctcatcgtgagcggcattttcccgtactctatccctgccacactgcttgtctggcatacctggcagaagcagacacaacgctccggcgtgctgtgggatgttcccagccctcccgagacccagaaagccgaactcgaggagggggtgtacagaattaagcagcagggaatcctgggcaaaacacaagtcggggtgggagttcagaaggaaggcgtgtttcacacgatgtggcacgtcaccagaggggctgtgctcacacataacggaaagcgcctggagccgaattgggcctctgtgaaaaaggaccttatttcctatggcggcgggtggagactgagcgcgcagtggcaaaaaggagaagaggttcaggtcatcgctgtggaacctggcaagaaccccaaaaatttccagaccatgcctgggaccttccagacaacgaccggagagattggcgccatcgccctggattttaagcccgggacatctggatcccccatcattaaccgggagggcaaggtggtcggcctctacgggaatggagtggttaccaaaaacggcgggtatgtgagcggaatcgctcaaacaaatgccgaacctgacggcccgacccccgagctggaagaggaaatgttcaagaaacgcaaccttacgattatggatctgcaccctgggtccggcaagacaagaaaatacctccccgctatcgtccgggaggccattaagcgcagactgcggaccctcatcctggcgcctaccagagtggttgccgctgagatggaagaggcccttaagggactgcccatccgctatcagacaaccgctacaaaaagcgaacataccggccgggagattgtggacctgatgtgccacgccacgtttacaatgagactcctgtctcctgtccgcgtgccgaattacaaccttatcattatggatgaagcccatttcaccgaccccgctagcatcgcggcccgggggtatatttccacaagagttggaatgggcgaggctgccgccatctttatgtctgctacccctcccgggacggccgatgcgttccctcagagcaatgctcccatccaggacgaggaacgcgacattccggagcggtcctggaactctggaaatgaatggatcaccgattttgccggcaagacagtgtggttcgtccctagcattaaagccgggaacgacatcgctaactgtctgagaaagaatggcaaaaaggtgattcaactctcccgcaagacctttgatacagagtaccagaaaaccaagctgaacgactgggatttcgtggtcacaaccgacatctctgagatgggagccaattttaaagcggatcgggttattgaccccagacggtgcctgaagcccgtgatcctcacggatggccctgaacgcgtgatccttgccgggcccatgcctgtcacagctgccagcgctgcccagagacggggacgcgtgggcagaaacccgcagaaagagaatgaccaatacattttcaccgggcagcccctgaacaatgatgaagaccacgctcactggaccgaggccaagatgctgctcgacaacatcaatacacctgaaggaattatccccgcgctgttcgagcctgagcgggaaaagtccgccgctattgatggcgagtatagacttaaaggggaaagccgcaagacctttgttgagctgatgcggagaggcgacctccccgtgtggctggcccataaagtcgcttctgaaggaatcaagtacacagatcgcaaatggtgcttcgacggccagcggaacaatcagatcctggaggagaacatggatgtggaaatttggacgaaggagggggagaagaagaagctcagaccgcgctggcttgacgcccggacctattccgatcctctggccctgaaagagtttaaggacttcgctgcgggaagaaaaagcatcgccctcgatctggttacagaaattggccgcgtgccctctcaccttgctcatagaacccggaatgccctggacaacctcgtcatgctgcacacatccgagcacgggggacgcgcctacagacatgctgtggaggaactgcctgagaccatggaaacgctccttctgctgggcctcatgatcctgcttaccggcggggccatgctgtttctcattagcggaaagggcatcgggaaaacatccatcggactgatttgtgtcatcgcgtctagcggcatgctgtggatggccgagattcccctccaatggatcgcttccgccattgtgcttgagttctttatgatggttctgctgatccctgaacccgagaagcagcggaccccgcaggataatcaactcgcttatgtggtgattgggatcctgacacttgccgcgatcattgccgctaacgaaatgggactgctcgagaccacgaagcgcgacctgggcatgagcaaagaacctggcgtcgtttctcccacatcctacctggatgtggacctccaccccgccagcgcttggaccctttatgccgtggctacaaccgtcatcacccctatgctgagacatacaattgaaaattctacggccaacgtgagcctggcggccatcgctaaccaggccgttgtgctcatggggctggacaagggatggccgatttccaaaatggatcttggcgtccccctgctcgctctggggtgctactctcaggtgaatcctctgaccctcacagccgccgtccttctgctgatcacccactacgcgatcattggacccggcctccaggctaaggccacacgggaggctcagaaacggaccgccgccgggatcatgaagaaccctacggtggacggaattatcacaattgatctggaccccgttatctatgatagcaagttcgagaaacagcttggccaggtgatgctgctcgtcctgtgtgctgtgcagctgctccttatgcgcacctcctgggccctgtgcgaggcgctgaccctcgccacaggccctatcaccacactgtgggaagggtctccgggaaagttttggaatacgaccattgctgttagcatggccaacatcttccggggctcctaccttgctggggccggactggcgtttagcattatgaaatctgtgggcacagggaagagaggaaccggctcccaaggcgagacactcggggaaaaatggaagaagaaactgaatcagctgagccgcaaggagttcgacctctataaaaagtccggaatcaccgaggtcgatcggacggaagccaaagagggccttaagagaggggaaaccacacatcacgctgtgtctcggggaagcgccaaactgcagtggctggtggagcgcaacatggttattcccgaaggcagagtcatcgacctcgggtgtggacggggcggctggtcctactattgcgctgggctgaagaaggtgaccgaggtgcgcggatacacaaaaggcgggcctggacacgaggaacccgtccctatgtctacctatggctggaatattgttaaacttatgagcgggaaagatgtgttttacctgcccccggagaagtgtgacacactcctgtgcgatatcggagaatccagcccttctcccaccgtggaggagtccagaacgatccgggtcctgaaaatggtggaaccctggctcaagaacaatcagttctgtattaaggttcttaacccttacatgcccgccgtgatcgagcatctggaacgcctgcaaagaaaacacggcggcatgctcgtccggaatcctctgagccgcaactctacacatgagatgtattggatttccaatgggaccggaaacatcgtgagctctgttaatatggtgagcagacttctgctcaaccggttcaccatgacacacagacgcccgacgattgaaaaggacgtcgatctgggcgctgggacccggcacgtgaacgccgagcccgagacacctaatatggacgtgatcggagaaagaatcaaacgcattaaggaggaacataactccacctggcactacgacgatgagaatccctataaaacatgggcgtaccatggctcttatgaagtcaaggccaccgggagcgcttccagcatgatcaacggagttgtgaagctgctcacaaaaccttgggacgtggtccccatggtgacccagatggccatgacggataccacaccgtttggccagcaacgggttttcaaggagaaagtggacaccagaacacctcgccccatgcctggcacccggaaggtcatggagattacggctgaatggctgtggagaacacttgggcgcaataaacggcccagactgtgcacccgcgaggaatttacaaagaaggtgcggaccaacgccgccatgggagcggttttcacggaggaaaatcagtgggattccgctaaagccgccgtggaggacgaggaattttggaagctcgtcgatagagagcgcgaactgcacaaacttggcaagtgtgggtcttgcgtgtacaacatgatgggaaaaagagagaagaaactgggcgagttcgggaaggctaagggcagccgggccatctggtatatgtggctcggatcccgctacctggaatttgaggctctgggcttcctcaatgaagaccattggttttctagagagaacagctactccggggttgaaggagagggcctgcacaaacttgggtatattctgcgggatatctctaagatccctggaggcgccatgtacgcggacgataccgccgggtgggacacaagaattaccgaggacgatctccacaatgaagagaaaatcacacagcagatggaccccgaacatcggctgcttgctaacgccattttcaagctgacctatcaaaataaagtggtcaaggtgcagcgcccgacacctaccggcacggtcatggatatcattagcagaaaggaccagcggggatccggccaggtggggacatacggactcaacacctttaccaatatggaggctcaactggttcgccagatggaaggcgagggggtgctgagcaaagccgatctcgagaacccccatctgcccgaaaagaaaatcacacagtggcttgagaccaagggagtcgaaagactgaaacggatggcgatctctggcgacgattgcgtggtgaagcctattgacgatcgcttcgccaacgctctcctggcccttaatgacatggggaaggttagaaaagatatcccgcagtggcaaccctccaagggctggcatgactggcaacaggtgcctttttgtagccaccacttccatgagctgattatgaaagatggacggaagctcgtcgtgccctgccgccctcaggacgaactgatcggcagagctcggatttctcaaggggccggatggtccctgcgcgagacagcttgtctcggcaaagcctatgcgcagatgtggagcctgatgtacttccacagacgggaccttcgcctggcctctaacgctatctgctccgccgttcccgtgcattgggtccctacgagcagaaccacatggtccattcacgcccatcaccagtggatgaccacagaggatatgctcaccgtgtggaatcgggtctggatcgaagacaacccctggatggaggataagacgccggtgaccacatgggaaaatgttccttatctggggaagagagaggaccaatggtgtggaagccttatcggcctgacctctcgcgctacatgggcccagaacattcccaccgcgatccaacaggtgcggagcctcattgggaatgaggaatttctggattacatgccttccatgaaaagattccgcaaggaggaagagtctgaaggcgctatctggtga

SEQ ID NO: 20409 - RNA, 9873 nt, synthetic construct
  misc_feature 1..9873: note = derived and/or modified CDS sequence (opt5) from DENV-3__FJ898462__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaaccatcgccccggatatcacacacaaaccgctggcccttggcaccttgggaagctggagctcgactttaattactgcgagggaacgacagtggttatcaccgaaaactgtggcacacggggcccctctctgagaaccacaaccgtgtccgggaaactgatccatgagtggtgctgtcgcagctgcacgcttccgcctctccggtatatgggagaagatggctgttggtacgggatggagattagacccatctctgaaaaggaggagaatatggtcaaatccctggtgagcgccggatctggcaaggttgacaacttcaccatgggggtgctgtgcctcgccattctgtttgaagaggtcatgcggggaaagttcggcaaaaagcacatgatcgctggcgtgttctttacattcgttcttctgctcagcgggcagattacctggcgcgatatggcccatacactgatcatgattggatccaatgcgagcgacagaatgggcatgggggtgacctatctggctcttatcgccacgtttaaaatccagcccttcctggccctcggatttttcctgcggaagctcacatctagagaaaacctgcttctgggcgtcgggctcgctatggccaccacactgcaactgcctgaggatattgaacagatggctaatggaatcgcccttggcctgatggcgctcaaactgattacccagtttgagacctaccagctctggacagccctgatctcccttacgtgtagcaacaccatgttcacactgaccgtggcttggcgcacagccaccctcattctggctggcgtgtccctgcttccggtctgccaatctagctccatgcggaagacggactggctgcccatggccgttgccgctatgggggtgcctcccctccctctgtttatcttctctctcaaggatacactgaaaagacgcagctggccccttaatgagggagtgatggcggtcggcctggtgtccatcctggcctctagcctcctgagaaacgacgttcctatggctgggccccttgtggccggaggcctgctcattgcctgttatgtcatcaccgggacctccgctgatctgacagtggaaaaggccgcggacattacctgggaggaagaggctgaacagacaggagttagccacaacctcatgatcacggtggacgatgacggcaccatgcggattaaagatgacgagacagagaatatcctgaccgtccttctgaagacagccctgctcatcgtgtctggcgtctttccgtactccattcctgccaccctgcttgtgtggcatacgtggcagaaacagacccaacgcagcggggttctgtgggatgtgccctctcctcccgaaacacagaaggctgagctcgaagagggagtctacagaatcaaacagcagggcattttcgggaagacccaagtgggagttggcgtgcagaaggagggggtctttcacacaatgtggcacgtgacccggggagccgtgctgacatataacggcaaacgcctcgaaccgaattgggcgtccgttaagaaagacctgatcagctacggcgggggatggagactttctgctcagtggcaacggggcgaggaagtccaggtgattgccgtggagcctgggaagaaccccaaaaatttccagacgatgcctggaaccttccagacaaccaccggcgaaatcggggccattgctctggattttaagcccggaacatccggcagccccatcatcaaccgcgagggcaaggtcgtggggctgtatggaaatggcgttgtgacgaaaaacgggggatacgtctccggcattgcccaaaccaatgctgagcctgacgggccgacacccgaactcgaggaagagatgttcaagaaaagaaacctgaccatcatggatcttcatcctggcagcggaaagacacggaaatatctgcccgccattgtgcgcgaagcgatcaagagacggctcagaaccctgattctcgcccctacgcgcgttgtggctgccgagatggaggaagctctgaagggccttcccatccggtaccagacaaccgccaccaaatctgagcacacagggagagaaatcgtcgacctgatgtgccatgccacctttacaatgcgcctgctcagccctgtgcgggttccgaattataacctgattatcatggatgaggctcacttcaccgaccccgcgtccattgccgctagaggatacatctctacgcgcgtgggcatgggggaagccgccgctatttttatgacagccacccctcccggaacagcggatgctttccctcagagcaatgcccccatccaggacgaggagcgggacatcccggaaagatcctggaactctggcaatgagtggattaccgattttgccgggaagacggtctggttcgtgcctagcatcaaagctggcaacgacattgccaactgtcttcgcaagaatggcaaaaaggtgatccaactgtcccggaagacctttgatacagaataccagaaaaccaagctcaacgactgggatttcgtcgttacaaccgacatttctgagatgggagcgaattttaaagccgatagagtgatcgacccccggcgctgcctgaagcccgtgattctgacagatgggcctgagagagtcatcctcgctggacccatgcctgtgaccgccgctagcgccgctcagcggcgcggcagagttgggcggaacccgcagaaagaaaatgaccaatatatcttcacgggacagccccttaacaatgatgaggaccatgcccactggacagaagcgaagatgctgctggacaacattaatacccctgagggcatcattcccgccctcttcgaacctgagagagagaagtccgctgccatcgatggggaataccgcctgaaaggcgagagccggaagacctttgtggaacttatgagacgcggagacctgcccgtctggctcgctcacaaagtggcctctgagggcattaagtatacagatcggaaatggtgcttcgacgggcagagaaacaatcagatcctggaagagaacatggatgttgagatctggaccaaggaaggagagaaaaagaagctgcgcccgcggtggctcgacgccagaacatactccgatcctcttgctctgaaagaatttaaggacttcgcggccggccgcaaaagcattgctctggatctcgtgacggagatcgggagagtcccctctcatctggcccaccggacccgcaatgcccttgacaacctggtgatgctccatacatccgaacacggaggcagagcttatcggcacgccgtcgaggagctgcctgaaaccatggagacactgctccttctgggcctgatgattctcctgaccgggggagcgatgctttttctgatcagcggcaaggggattggaaaaacgtccatcggcctcatctgtgtgattgcctctagcgggatgctgtggatggctgaaatccccctgcaatggattgcctccgctatcgttctcgagttctttatgatggtgcttctgattcctgagcccgaaaagcagcgcaccccgcaggataatcaactggcctacgtggtcatcggcattctcacactggcggccatcatcgctgccaacgagatgggccttctggaaaccacaaagagagacctcggcatgagcaaagagcctggggttgtgtctcccacctcctatctggatgtggacctgcatcccgctagcgcctggacgctctacgctgtcgccacaaccgtgattacacctatgcttcggcacaccatcgaaaattctaccgcgaacgttagcctggccgctattgccaaccaggctgtggtcctgatgggactcgacaagggctggccgatctccaaaatggatctgggggtgccccttctggccctcggatgctactctcaggtcaatcctctgacactgacggccgcggtgctccttctgattacccattatgctatcatcggccccgggctgcaggccaaggctacaagagaggcccaaaaacgcaccgccgctggaattatgaagaaccctacagttgacggcatcatgaccattgatctcgaccccgtgatctacgatagcaagttcgagaaacagctgggccaggtcatgcttctggtgctctgtgccgttcagctgctgctcatgcggacgtcctgggcgctttgcgaagccctgacactggctaccgggcctattaccacactctgggagggatctccgggcaagttttggaataccacaatcgccgtgagcatggctaacatcttcagagggtcctatctggccggagcgggccttgcctttagcattatgaaatctgtcgggacgggaaagcgcggcaccggctcccaaggggaaacactgggagagaaatggaagaagaaactcaatcagctgagccggaaggagttcgacctgtacaaaaagtccggcatcaccgaggtggatagaacagaggctaaagaagggctcaagcggggagagaccacgcaccatgccgtgtctcgcggcagcgctaaacttcagtggtttgttgaaagaaacatggtcattcccgaggggcgggtgatcgacctgggatgtggccgcggcgggtggtcctattactgcgccggactgaagaaggtgaccgaagtcagaggctatacaaaagggggacctggccacgaggagcccgttcctatgtctacctacgggtggaatattgtgaagctcatgagcggaaaagatgtgttctacctgcccccggaaaagtgtgacacacttctgtgcgatatcggcgagtccagcccttctcccattgtcgaagagtcccggaccatccgcgtgctcaaaatggttgagccctggctgaagaacaatcagttctgtatcaaggtgctgaacccttatatgcccacagtcattgaacacctcgagagacttcaacggaaacatggcgggatgctggtgcgcaatcctctgagcagaaactctacccacgaaatgtactggatctccaatggaacgggcaacattgttgctagcgtgaatatggtctctcggctcctgcttaacagatttacaatgacccatcgccggccgaccatcgagaaggacgtggatctgggggccggaacaagacacgtgaacgcggaacccgagacgcctaatatggacgtcattggcgagcgcatcaaacggatcaaggaagaacacaacagcacctggcattatgacgatgaaaatccctacaaaacatgggcctatcacgggtcctacgaggttaaggctaccggatctgccagctccatgattaacggcgtggtgaagctcctgacaaaaccttgggacgtcgtgcccatggttacccagatggctatgacagataccacgccgttcggccagcaaagagtgtttaaggaaaaagtcgacacccgcacacctcggagcatgcccgggaccagacgcgtgatgggaatcacagccgagtggctgtggcggaccctcggcagaaataagaaacctcgcctgtgcacgcgggaggagttcacaaagaaggttagaaccaacgccgcgatgggggctgtgtttacagaggaaaatcagtgggattccgccaaagccgctgtcgaggacgaagatttctggaaacttgtggaccgcgagagagagctgcataaactcggaaagtgtggctcttgcgtttataacatgatggggaaacgggaaaagaaactgggcgagtttggaaaggccaagggcagccgcgctatttggtacatgtggcttggggccagatacctggagttcgaggcgctcggatttctgaatgaggatcactggttctcccgggaaaactcttatagcggcgtggagggggaaggactgcataaactcggctacatcctgagagacatttccaagatccccgggggcgccatgtatgctgatgacaccgccggatgggacacgcggatcaccgaggatgaccttcacaatgaagagaaaattacacagcagatggatcctgagcaccgccaactggctaacgccatctttaagctcacctaccagaataaagtcgtgaaggtccagagacccacaccgaccggcacagtgatggacattatctctcggaaggatcagcgcgggagcggacaagttggcacctatgggctgaacacgttcacaaatatggaagcgcagcttattagacagatggagggagaaggcgtgctgtccaaagccgacctcgagaaccctcatctgcccgaaaagaaaatcacccagtggctggagaccaagggggtcgagcggctcaaacgcatggctatcagcggcgatgactgcgtggtgaagcccattgatgacagatttgccaacgctctgcttgccctgaatgatatgggaaaggttcggaaagacatccctcaatggcagccgtctaagggctggcacgattggcaacaggtgcccttctgttcccatcacttccacgaactcattatgaaagacgggcgcaagctggtcgtgccttgcagaccccaagacgagcttatcggacgggctcgcattagccagggcgccgggtggtctctgagagaaacagcgtgtctcggaaaagcctacgctcagatgtggtccctgatgtattttcatcggcgcgatctgagactcgccagcaacgccatctgctctgctgttcctgtgcactgggtccccacctcccggacaacgtggagcattcatgcccaccatcaatggatgaccacagaggacatgctgaccgtgtggaatagagtctggatcgaagataacccttggatggaggacaagacacccgtgaccacgtgggagaatgttccgtaccttggcaagcgcgaagatcagtggtgtgggtccctgatcggcctcaccagccgggcgacatgggctcagaacattcctaccgccatccagcaagtgagatctctgattggaaatgaggagttccttgactacatgcccagcatgaaacgctttcggaaggaggaggaatccgagggcgccatctggtga

SEQ ID NO: 20410 - RNA, 9873 nt, synthetic construct
  misc_feature 1..9873: note = derived and/or modified CDS sequence (opt5) from DENV-3__KF955473__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccatccttcgcaaactgtgtattgagggaaagatcaccaacattacaaccgattccagatgccctacgcagggcgaagcggtgctcccggaggaacaggaccagaattatgtgtgtaaacacacatacgtcgatcggggctgggggaacggatgcggcctgttcgggaagggaagccttgtgacctgcgccaagtttcaatgtctggagcccatcgagggcaaagttgtgcagtatgaaaatctcaagtacaccgtcatcattacagtgcataccggggaccagcaccaggttggaaacgagacacaaggcgtgacggctgaaatcacccctcaggcctctacaaccgaggctattctgcccgaatatggcacactggggctcgagtgctcccctcgcaccggactggacttcaatgagatgatccttctgacgatgaaaaacaaggcctggatggtccatagacagtggtttttcgatctccccctgccgtggaccagcggcgccacaaccgaaacacctacctggaatcggaaagagcttctggtgacgtttaagaacgctcacgcgaaaaagcaagaagtcgtggttctcgggtctcaggagggagccatgcacacagctctgaccggcgccacagaaattcaaaattccgggggcaccagcatcttcgccggacatctgaagtgtcgcctcaaaatggacaagctggagcttaaaggcatgtcttacgctatgtgcaccaacacatttgtgctgaagaaagaggtctccgaaacgcagcacgggaccatcctcattaaggtggagtacaagggagaagatgccccctgtaaaatccctttcagcacagaggacggccaagggaaggcgcataacggaagactgattaccgctaatcccgttgtgaccaagaaggaggaacccgtcaacatcgaggccgaacctccgttcggcgagtccaatattgtgatcgggatcggcgataacgccctgaaaattaattggtataagaagggatctagcatcggcaaaatgtttgaagctaccgccagaggggctagacgcatggccattcttggagacacggcgtgggatttcggctccgtcgggggagttctcaacagcctgggcaagatggtccaccagatctttgggtctgcctacacagctctgttctccggcgtgagctgggtgatgaaaattggaatcggcgtcctcctgacctggattgggcttaattctaagaacaccagcatgtccttttcttgcatcgccatcggaattatcacactgtatctcggcgctgtggttcaggccgacatggggtgtgtgattaattggaaaggaaaggagctgaagtgcggcagcgggatcttcgtcaccaacgaggtgcatacatggacggaacagtacaaatttcaagcggattcccccaagcggctggccaccgctattgccggcgcttgggagaatggagtttgtggcatcagaagcacaacccgcatggaaaaccttctctggaaacagatcgccaatgagctgaactatattctgtgggaaaataacatcaagctcacagtggtcgtgggggacattatcggagttctggagcagggcaaacggacccttacgcctcagcccatggagctgaagtactcttggaaaacctgggggaaggccaagattgtgacagctgaaacccaaaactccagcttcatcatcgatggacctaatacacccgagtgcccgtctgcgtccagagcctggaacgtctgggaagtggaggactatggctttggcgtgttcaccacaaatatttggctcaaactgcgcgaagtctacacccagctgtgtgaccaccggcttatgagcgctgccgttaaggatgagagagccgtgcacgctgacatggggtactggatcgagtcccagaaaaacggatcttggaagctcgaaaaagccagcctgattgaggtgaagacgtgcacatggcctaagtcccataccctgtggtctaatggcgtcctcgaaagcgatatgatcattcccaaatccctggcggggcctatcagccagcacaaccatcgccccggatatcacacccaaacagctggcccttggcaccttgggaagctggagctcgactttaattactgcgagggaaccacggtggttatcacagaaaactgtggcacccggggcccctctctgagaacaaccacagtgtccgggaaactgattcatgagtggtgctgtcgcagctgcacccttccgcctctccggtatatgggagaagatggctgttggtacgggatggagatcagacccatttctgaaaaggaggagaatatggtcaaatccctggtgagcgccggatctggcaaggttgacaacttcacgatgggggtgctgtgcctcgccatcctgtttgaagaggtcatgcggggaaagttcggcaaaaagcacatgattgctggcgtgttctttaccttcgttcttctgctcagcgggcagatcacatggcgcgatatggcccataccctgattatgatcggatccaatgcgagcgacagaatgggcatgggggtgacatatctggctcttatcgccacctttaaaattcagcccttcctggccctcggatttttcctgcggaagctcacgtctagagaaaacctgcttctgggcgtcgggctcgctatggccacaaccctgcaactgcctgaggatatcgaacagatggctaatggaattgcccttggcctgatggcgctcaaactgatcacacagtttgagacctaccagctctggaccgccctgatttcccttacatgtagcaacacgatgttcaccctgacagtggcttggcgcaccgccacactcatcctggctggcgtgtccctgcttccggtctgccaatctagctccatgcggaagaccgactggctgcccatggccgttgccgctatgggggtgcctcccctccctctgtttatcttctctctcaaggatacgctgaaaagacgcagctggccccttaatgagggagtgatggcggtcggcctggtgtccattctggcctctagcctcctgagaaacgacgttcctatggctgggccccttgtggccggaggcctgctcatcgcctgttatgtcattacagggacctccgctgatctgaccgtggaaaaggccgcggacatcacatgggaggaagaggctgaacagaccggagttagccacaacctcatgattacagtggacgatgacggcacgatgcggatcaaagatgacgagaccgagaatatcctgacagtccttctgaagaccgccctgctcattgtgtctggcgtctttccgtactccatccctgccacactgcttgtgtggcatacctggcagaaacagacgcaacgcagcggggttctgtgggatgtgccctctcctcccgaaacccagaaggctgagctcgaagagggagtctacagaattaaacagcagggcatcttcgggaagacacaagtgggagttggcgtgcagaaggagggggtctttcacaccatgtggcacgtgacacggggagccgtgctgacctataacggcaaacgcctcgaaccgaattgggcgtccgttaagaaagacctgattagctacggcgggggatggagactttctgctcagtggcaaaagggcgaggaagtccaggtgatcgccgtggagcctgggaaaaaccccaagaatttccagacaatgcctggaacgttccagaccacaaccggcgaaattggggccatcgctctggattttaagcccggaacctccggcagccccatcattaaccgggagggcaaagtcgtggggctgtatggaaatggcgttgtgacaaagaacgggggatacgtctccggcatcgcccaaacgaatgctgagcctgacgggccgacccccgaactcgaggaagagatgttcaaaaagcgcaacctgacaattatggatcttcatcctggcagcggaaaaaccagaaagtatctgcccgccatcgtgcgggaagcgattaagcgcagactccggacactgatcctcgcccctaccagagttgtggctgccgagatggaggaagctctgaaaggccttcccatccgctaccagacgacagccaccaagtctgagcacaccgggcgggaaattgtcgacctgatgtgccatgccacatttaccatgagactgctcagccctgtgcgcgttccgaattataacctgatcattatggatgaggctcacttcacagaccccgcgtccatcgccgctcggggatacatttctaccagagtgggcatgggggaagccgccgctatctttatgacggccacacctcccggaaccgcggatgctttccctcagagcaatgcccccatccaggacgaggagcgcgacattccggaacggtcctggaactctggcaatgagtggatcacagattttgccgggaaaaccgtctggttcgtgcctagcattaaggctggcaacgacatcgccaactgtcttcgcaaaaatggaaagaaggtgattcaactgtccagaaaaacgtttgataccgaataccagaagacaaaactcaacgactgggatttcgtcgttaccacagacatctctgagatgggcgcgaattttaaggccgatcgggtgattgaccccagacggtgcctgaaacccgtgatcctgaccgatgggcctgagcgcgtcatcctcgctggacccatgcctgtgacagccgctagcgccgctcagagacggggccgcgttgggagaaacccgcagaaggaaaatgaccaatatattttcaccggacagccccttaacaatgatgaggaccatgcccactggacggaagcgaagatgctgctggacaacatcaatacacctgagggcattatccccgccctcttcgaacctgagcgggagaaatccgctgccattgatggggaatacagactgaagggcgagagccgcaaaacctttgtggaacttatgcggagaggagacctgcccgtctggctcgctcacaaggtggcctctgagggcatcaaatataccgatcgcaagtggtgcttcgacgggcagcggaacaatcagatcctggaagagaacatggatgttgagatttggacaaaagaaggagagaagaagaaactgagaccgcgctggctcgacgcccggacctactccgatcctcttgctctgaaggaatttaaagacttcgcggccggcagaaagagcatcgctctggatctcgtgacagagattgggcgcgtcccctctcatctggcccacagaacgcggaatgcccttgacaacctggtgatgctccatacctccgaacacggaggccgcgcttatagacacgccgtcgaggagctgcctgaaacaatggagaccctgctccttctgggcctgatgatcctcctgacagggggagcgatgctttttctgattagcggcaaagggatcggaaagacctccatcggcctcatttgtgtgatcgcctctagcgggatgctgtggatggctgaaattcccctgcaatggatcgcctccgctattgttctcgagttctttatgatggtgcttctgatccctgagcccgaaaagcagcggacgccgcaggataatcaactggcctacgtggtcattggaatcctcaccctggcggccatcattgctgccaacgagatgggccttctggaaacaaccaaacgcgacctcggcatgagcaaggagcctggggttgtgtctcccacatcctatctggatgtggacctgcatcccgctagcgcctggaccctctacgctgtcgccacgacagtgatcacccctatgcttagacacacaattgaaaattctaccgcgaacgttagcctggccgctatcgccaaccaggctgtggtcctgatgggactcgacaaaggctggccgatttccaagatggatctgggggtgccccttctggccctcggatgctactctcaggtcaatcctctgaccctgacagccgcggtgctccttctgatcacgcattatgctatcattggccccgggctgcaggccaaagctacccgggaggcccaaaagagaacagccgctggaatcatgaagaaccctaccgttgacggcattatgacaatcgatctcgaccccgtgatttacgatagcaaattcgagaagcagctgggccaggtcatgcttctggtgctctgtgccgttcagctgctgctcatgcgcacctcctgggcgctttgcgaagccctgacgctggctacagggcctatcaccaccctctgggagggatctccgggcaaattttggaatacaaccatcgccgtgagcatggctaacattttccgggggtcctatctggccggagcgggccttgcctttagcatcatgaagtctgtcgggacaggaaaaagaggcacgggctcccaaggggaaaccctgggagagaagtggaagaaaaagctcaatcagctgagccgcaaagagttcgacctgtacaagaaatccggcattacagaggtggatcggaccgaggctaaggaagggctcaaaagaggagagacaacccaccatgccgtgtctcggggcagcgctaaacttcagtggtttgttgaacgcaacatggtcatccccgaggggagagtgattgacctgggatgtggccggggcgggtggtcctattactgcgccggactgaagaaagtgacggaagtccgcggctataccaaagggggacctggccacgaggagcccgttcctatgtctacatacgggtggaatatcgtgaaactcatgagcggaaaggatgtgttctacctgcccccggaaaaatgtgacacccttctgtgcgatattggcgagtccagcccttctcccacagtcgaagagtccagaaccatccgggtgctcaagatggttgagccctggctgaagaacaatcagttctgtatcaaagtgctgaacccttatatgcccacagtcattgaacacctcgagcgccttcaaagaaagcatggcgggatgctggtgcggaatcctctgagccgcaactctacccacgaaatgtactggatctccaatggaacgggcaacattgttgctagcgtgaatatggtctctagactcctgcttaaccggtttacaatgacccatagacgcccgaccatcgagaaagacgtggatctgggggccggaacacggcacgtgaacgcggaacccgagacgcctaatatggacgtcattggcgagagaatcaagcgcatcaaagaagaacacaacagcacctggcattatgacgatgaaaatccctacaagacatgggcctatcacgggtcctacgaggttaaggctaccggatctgccagctccatgattaacggcgtggtgaaactcctgacaaagccttgggacgtcgtgcccatggttacccagatggctatgacagataccacgccgttcggccagcaacgggtgtttaaagaaaaggtcgacaccagaacacctcgcagcatgcccgggacccggagagtgatgggaatcacagccgagtggctgtggcgcaccctcggccggaataaaaagcctagactgtgcacgcgcgaggagttcacaaagaaagttcggaccaacgccgcgatgggggctgtgtttacagaggaaaatcagtgggattccgccaaggccgctgtcgaggacgaagatttctggaaacttgtggacagagagcgcgagctgcataagctcggaaaatgtggctcttgcgtttataacatgatggggaagagagagaagaagctgggcgagtttggaaaggccaaaggcagccgggctatttggtacatgtggcttggggcccgctacctggagttcgaggcgctcggatttctgaatgaggatcactggttctccagagaaaactcttatagcggcgtggagggggaaggactgcataagctcggctacatcctgcgggacatttccaaaatccccgggggcgccatgtatgctgatgacaccgccggatgggacacgagaatcaccgaggatgaccttcacaatgaagagaagattacacagcagatggatcctgagcaccggcaactggctaacgccatctttaaactcacctaccagaataaggtcgtgaaggtccagcgccccacaccgaccggcacagtgatggacattatctctagaaaagatcagcgggggagcggacaagttggcacctatgggctgaacacgttcacaaatatggaagcgcagcttattcgccagatggagggagaaggcgtgctgtccaaggccgacctcgagaaccctcatctgcccgagaaaaagatcacccagtggctggagaccaaaggggtcgagagactcaagcggatggctatcagcggcgatgactgcgtggtgaagcccattgatgaccgctttgccaacgctctgcttgccctgaatgatatgggaaaagttagaaaggacatccctcaatggcagccgtctaaaggctggcacgattggcaacaggtgcccttctgttcccatcacttccacgaactcattatgaaggacgggcggaaactggtcgtgccttgccgcccccaagacgagcttatcggacgggctcggattagccagggcgccgggtggtctctgcgcgaaacagcgtgtctcggaaaggcctacgctcagatgtggtccctgatgtattttcatagacgggatctgcgcctcgccagcaacgccatctgctctgctgttcctgtgcactgggtccccacctccagaacaacgtggagcattcatgcccaccatcaatggatgaccacagaggacatgctgaccgtgtggaatcgggtctggatcgaagataacccttggatggaggacaagacacccgtgaccacgtgggagaatgttccgtaccttggcaaaagagaagatcagtggtgtgggtccctgatcggcctcaccagccgcgcgacatgggctcagaacattcctaccgccatccagcaagtgcggtctctgattggaaatgaggagttccttgactacatgcccagcatgaagagatttcgcaaagaggaggaatccgagggcgccatctggtga

SEQ ID NO: 20411 - RNA, 9873 nt, synthetic construct
  misc_feature 1..9873: note = derived and/or modified CDS sequence (opt5) from DENV-3__FJ850079__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacgtggaggctgaacctccgttcggcgagtccaatattgttatcgggattggcgataacgccctgaaaatcaattggtataagaagggatctagcatcggcaaaatgtttgaagccacggctagaggggccagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctaagaacacaagcatgtccttttcttgcatcgctattggaatcatcaccctgtatctcggcgccgtggtccaggctgacatggggtgtgtgattaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattacgggagtcctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgcttccagagcgtggaacgtgtgggaagtcgaggactatggctttggcgttttcaccacgaatatttggctcaaactgcgcgaagtgtacacacagctgtgtgaccaccggcttatgagcgccgctgtgaaggatgagagagccgtccacgccgacatggggtactggatcgagtcccagaaaaacggatcttggaagctcgaaaaagctagcctgatcgaggtgaagacctgcacctggcctaagtcccatacactgtggtctaatggcgttctcgaaagcgatatgattatccccaaatccctggccgggcctattagccagcacaactatcgccccggataccatacccaaacggcgggcccttggcaccttgggaagctggagctcgactttaattattgcgagggaacaaccgtggtcatcacagaaaactgtggcacccggggcccctctctgagaacaaccacggtgtccgggaaactgattcacgagtggtgctgtcgcagctgcacccttccgcctctccggtacatgggagaagatggctgttggtatgggatggagatcagacccatctctgaaaaggaggagaatatggttaaatccctggtgagcgctggatctggcgaagtcgacaacttcacaatgggggtgctgtgcctcgccattctgtttgaggaagttatgcggggaaagttcggcaagaaacatatgatcgccggcgtgttctttaccttcgtccttctgctcagcgggcagattacatggcgcgatatggctcacaccctgatcatgattggatccaatgccagcgacagaatgggcatgggggtgacgtacctggcgcttatcgctacatttaagattcagcccttcctggccctcggatttttcctgcggaaactcacctctagagagaacctgcttctgggcgtggggctcgccatggctacaaccctgcaactgcctgaagatatcgagcagatggccaatggaatcgctcttggcctgatggccctcaagctgattacccagtttgagacatatcagctctggacggcgctgatctcccttacctgtagcaacacaattttcaccctgacagtcgcctggcgcaccgctacgctcatcctggccggcgtttccctgcttccggtgtgccaatctagctccatgcggaaaacagactggctgcccatgaccgtggctgccatgggggtccctcccctccctctgtttattttctctctcaaggataccctgaagagacgcagctggccccttaatgaaggagtgatggccgttggcctggtgtccatcctggcttctagcctcctgagaaacgacgtccctatggcggggccccttgtggccggaggcctgctcatcgcttgttacgttattacagggacctccgccgatctgacagtggagaaagccgctgacgtcacgtgggaagaggaagccgagcagaccggagtgagccataacctcatgatcacagtcgacgatgacggcaccatgcggattaaggatgacgagacagaaaatatcctgaccgtgcttctgaaaacggcgctgctcattgtttctggcatctttccgtactccatccctgctaccctgcttgtgtggcacacatggcagaagcagacccaacgcagcggggtcctgtgggatgtgccctctcctcccgagacacagaaagccgaactcgaggagggagtttatagaattaagcagcagggcatcttcgggaaaacccaagtgggagtcggcgtgcagaaggaaggggtgtttcatacaatgtggcacgttacgcggggagccgtcctgacctacaacggcaagcgcctcgagccgaattgggcttccgtgaaaaaggacctgattagctatggcgggggatggagactttctgcccagtggcaaaaaggcgaagaggtgcaggtcatcgcggtggaacctgggaagaaccccaaaaatttccagacaatgcctggaaccttccagaccacaacgggcgagattggggctatcgccctggattttaagcccggaacctccggcagccccattatcaaccgggagggcaaggttgtggggctgtacggaaatggcgtcgtgaccaagaacgggggatatgtttccggcatcgcccaaaccaatgctgaacctgacgggccgacacccgagctcgaagaggaaatgttcaagaaacgcaacctgaccattatggatcttcaccctggcagcggaaagacgagaaaatacctgcccgccatcgtgcgggaggctattaagcgcagactccggacactgatcctcgcccctaccagagtcgtggcggccgagatggaagaggctctgaagggccttcccattcgctatcagaccacagccaccaaatctgaacatacagggcgggagatcgttgacctgatgtgccacgctacctttacgatgagactgctcagccctgtgcgcgtcccgaattacaacctgatcattatggatgaagcccatttcacagaccccgcctccatcgctgcgcggggatacatttctaccagagtgggcatgggggaggccgctgccatctttatgacagccacccctcccggaacggctgatgccttccctcagagcaatgcgcccattcaggacgaggaacgcgacatcccggagcggtcctggaactctggcaatgaatggatcaccgattttgctgggaagacagtgtggttcgtccctagcattaaagccggcaacgacatcgccaactgtcttagaaagaatggcaaaaaggttattcaactgtcccgcaagacctttgatacagagtatcagaaaaccaagctcaacgactgggatttcgtggtgacaaccgacatctctgagatgggagctaattttaaagccgatcgggtcattgaccccagacggtgcctgaagcccgtgatcctgacggatgggcctgaacgcgttattctcgcgggacccatgcctgtgacagccgctagcgccgctcagagacggggccgcgtcgggagaaacccgcagaaagagaatgaccaatacatcttcaccggacagccccttaacaatgatgaagaccacgcccattggaccgaggctaagatgctgctggacaacatcaatacacctgaaggcattatccccgccctcttcgagcctgagcgggaaaagtccgcggccattgatggggagtatagactgaaaggcgaaagccgcaagacctttgtggagcttatgcggagaggagacctgcccgtttggctcgctcacaaagtggcctctgaaggcatcaagtacacagatcgcaaatggtgcttcgacgggcagcggaacaatcagattctggaggagaacatggatgtcgaaatctggacgaaggagggagagaagaagaagctgagaccgcgctggctcgacgctcggacctattccgatcctcttgccctgaaagagtttaaggacttcgccgctggcagaaaaagcatcgcgctggatctcgtgacagaaattgggcgcgtccccacccacctggcccatagaacacggaatgctcttgacaacctggtgatgctccacacctctgagcatggaggcaaggcctaccgccacgccgttgaggaactgcctgagacgatggaaaccctgctccttctgggcctgatgatcctcctgacagggggagctatgctttttctgatttccggcaaagggatcggaaagaccagcattggcctcatctgtgtgatcgcctcctctgggatgctgtggatggcggagattcccctgcaatggatcgccagcgctattgtgctcgagttctttatgatggtccttctgatccctgaacccgagaagcagagaacaccgcaggataatcaactggcctatgttgtgattggaatcctcaccctggctgccattatcgcggccaacgaaatgggccttctggagacgacaaaacgggacctcggcatgtccaaggaacctggggtggtcagccccacctcttacctggatgtggacctgcaccccgcttccgcctggacactctacgctgttgccaccaccgtgatcacacctatgcttcgccatacgattgagaatagcaccgctaacgtctctctggccgcgatcgccaaccaggctgtggtcctgatgggactcgacaaaggctggccgattagcaagatggatctgggggtgccccttctggccctcggatgctattcccaggttaatcctctgacactgaccgctgccgtgctccttctgatcacacactacgccattatcggccccgggctgcaggcgaaagctaccagagaggcccaaaagcggacggctgccggaatcatgaagaaccctacagtcgacggcattatgaccatcgatctcgaccccgtgatttatgattctaaattcgaaaagcagctgggccaggttatgcttctggtgctctgtgccgtccagctgctgctcatgagaaccagctgggctctttgcgaggccctgacactggcgaccgggcctatcacaacgctctgggaaggatccccgggcaaattttggaataccacaattgccgtgtctatggctaacatcttccgcgggagctacctggccggagctggccttgccttttccatcatgaaaagcgtggggaccggaaaacggggcacaggctctcaaggggagaccctgggagaaaagtggaagaaaaagctcaatcagctgtccagaaaagagttcgacctgtataagaaaagcggcattacggaggttgatcgcaccgaagcgaaggaggggctcaaacggggagaaatcacacatcacgccgtctccagaggctctgctaaacttcagtggtttgtggagcggaacatggtgattcccgaagggcgcgtcatcgacctgggatgtggcagaggcgggtggagctactattgcgccggactgaagaaagttaccgaggtgcggggctacacaaaagggggacctggccatgaggaacccgtgcctatgtccacctacgggtggaatattgtcaaactcatgtctggaaaggatgtgttctatctgcccccggagaaatgtgacacacttctgtgcgatatcggcgaaagctcccctagccccaccgttgaggagtctcgcacgattagagtgctcaagatggtcgaaccctggctgaagaacaatcagttctgtatcaaagtgctgaacccttacatgcccacagttatcgagcacctcgaacggcttcaacgcaagcacggcgggatgctggtgagaaatcctctgtcccggaacagcacccatgagatgtattggatttctaatggaaccggcaacatcgtcgcttccgtgaatatggtgagccgcctcctgcttaacagatttacaatgacgcaccggagaccgaccattgaaaaagacgtcgatctgggggccggaacacgccatgttaacgctgagcccgagacccctaatatggacgtgatcggcgaacggattaagagaatcaaagaggaacacgactctacatggcactacgatgacgagaacccctataagacctgggcctaccatgggagctatgaagtgaaggcgacaggatccgcctctagcatgatcaatggcgtcgtgaaactcctgaccaagccttgggatgttgtgcccatggtcacgcagatggctatgaccgacacaaccccgttcggccagcaacgcgtgtttaaagagaaggttgatacacggacccctagatccatgcccgggacgcgccgggtgatgggaattacagccgagtggctgtggagaaccctcggccgcaacaaaaagcctcggctgtgcacaagagaagagttcaccaagaaagtccgcacgaatgctgccatgggggccgtgtttaccgaagagaaccagtgggacagcgcgaaggctgccgttgaagatgaggacttctggaaacttgtggatcgggagagagaactgcacaagctcggaaaatgtggctcctgcgtctacaatatgatggggaagcgcgagaaaaagctgggcgaatttggaaaggccaaaggctctagagctatctggtacatgtggcttggggcccggtatctggagttcgaggctctcggatttctgaacgaagaccattggttcagccgcgaaaattcctactctggcgtggagggggagggactgcacaagctcggctatattctgagagatatcagcaaaattcccgggggcgccatgtacgcggacgacacagccggatgggatacccggatcacagaagacgatcttcataacgaggagaagatcacccagcagatggaccctgaacacagacaactggctaatgccatttttaaactcacatatcagaacaaggtcgtgaaggttcagcggcccaccccgacgggcacagtgatggatatcatttcccgcaaagaccagagagggtctggacaagtcggcacctacgggctgaataccttcacaaacatggaggctcagcttatccggcagatggaaggagagggcgtgctgagcaaggccgatctcgaaaatcctcatctgcccgagaaaaagattacccagtggctggagacaaaaggggtggaacgcctcaagagaatggcgatctccggcgacgattgcgttgtgaagcccatcgacgatcggtttgccaacgctctgcttgccctgaacgacatgggaaaagtccgcaaggatattcctcaatggcagccgagcaaaggctggcatgactggcaacaggtgcccttctgttctcaccatttccacgagctcatcatgaaggacgggagaaaactggttgtgccttgccggccccaagatgaacttattggacgcgctagaatctcccagggcgccgggtggagcctgcgggagacggcttgtctcggaaaggcctatgcgcagatgtggtctctgatgtactttcaccgcagagacctgcggctcgcctccaatgctatttgcagcgccgtccctgtgcattgggtccccacctctcgcacaacctggtccatccacgcccatcaccaatggatgacaaccgaagatatgctgacggtgtggaacagagtttggattgaggacaatccttggatggaggataagacccccgtgacaacctgggaaaacgtcccgtaccttggcaaacgggaggaccagtggtgtgggagcctgatcggcctcacatccagagctacctgggcccagaatatccctacggcgattcagcaagtgcgcagcctgatcggaaacgaagagttccttgattatatgccctctatgaagcggtttagaaaagaggaagagagcgaaggcgctatttggtga

SEQ ID NO: 20412 - RNA, 9873 nt, synthetic construct
  misc_feature 1..9873: note = derived and/or modified CDS sequence (opt5) from DENV-3__FJ850080__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcacagacgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggatgagcccgtcaacattgaagccgagcctccgttcggcgaatccaatatcgtgattgggatcggcgacaacgccctgaaaatcaattggtataagaagggatctagcattggcaaaatgtttgaggctacggccagaggggctagacgcatggccatccttggagatacagcgtgggacttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgatatggggtgtgtgatcaattggaaaggaaaggaactgaagtgcggcagcgggattttcgtcacaaacgaggtgcatacgtggaccgagcagtacaaatttcaagcggactcccccaagcggctggccacagctatcgccggcgcttgggaaaatggagtttgtggcattagaagcaccacacgcatggagaaccttctctggaaacaggtggccaatgaactgaactatatcctgtgggagaataacatcaagctcaccgtcgtggttggggatattatcggagtgctggaacagggcaaacggacgcttacccctcagcccatggagctgaagtactcttggaaaacatgggggaaggccaagattgtcaccgctgagacacaaaactccagcttcatcattgacggacctaatacccccgaatgcccgtctgcgtccagagcctggaacgtgtgggaggtggaagactatggctttggcgtcttcacaaccaatatctggctcaaactgcgcgaggtttacacgcagctgtgtgatcaccggcttatgagcgctgccgtgaaggacgaaagagccgtgcacgctgatatggggtactggatcgagtcccagaaaaacggatcttggaagctcgagaaagccagcctgattgaagtcaagacatgcacctggcctaagtcccataccctgtggtctaatggcgtgctcgagagcgacatgatcattcccaaatccctggcggggcctatcagccagcacaaccatcgccccggatatcacacacaaaccgctggcccttggcaccttgggaagctggaactcgattttaattactgcgagggaacgacagttgtgattaccgagaactgtggcacacggggcccctctctgagaaccacaaccgtctccgggaaactgatccatgaatggtgctgtcgcagctgcacgcttccgcctctccggtatatgggagaggacggctgttggtacgggatggaaatcagacccatttctgagaaggaagagaatatggtgaaatccctggttagcgccggatctggcaaggtggataacttcaccatgggggtcctgtgcctcgccatcctgtttgaggaagtgatgcggggaaagttcggcaaaaagcacatgattgctggcgttttctttatgttcgtgcttctgctcagcgggcagatcacatggcgcgacatggcccataccctgattatgatcggatccaatgcgagcgatagaatgggcatgggggtcacatatctggctcttattgccacctttaaaatccagcccttcctggccctcggatttttcctgcggaagctcacgtctagagagaacctgcttctgggcgtggggctcgctatggccacaaccctgcaactgcctgaagacatcgagcagatggctaatggaattgcccttggcctgatggcgctcaaactgatcacacagtttgaaacctaccagctctggaccgccctgatttcccttacatgtagcaacacgatgttcaccctgacagtggcttggcgcaccgccacactcatcctggctggcgtctccctgcttccggtttgccaatctagctccatgcggaagaccgattggctgcccatggccgtggccgctatgggggtgcctcccctccctctgtttattttctctctcaaggacacgctgaaaagacgcagctggccccttaatgagggagtcatggcggtgggcctggtttccatcctggcctctagcctcctgagaaacgatgtgcctatggctgggccccttgtcgccggaggcctgctcatcgcctgttatgtgattacagggacctccgctgacctgaccgttgagaaggccgcggacatcacatgggaagaggaagctgagcagaccggagtgagccacaacctcatgattacagtcgatgacgatggcacgatgcggatcaaagacgatgaaaccgagaatattctgacagtgcttctgaagaccgccctgctcatcgtctctggcgtgtttccgtactccatccctgccacactgcttgtttggcatacctggcagaaacagacgcaacgcagcggggtgctgtgggacgtcccctctcctcccgagacccagaaggctgaactcgaggaaggagtgtacagaattaaacagcagggcatcttcgggaagacacaagttggagtgggcgtccagaaggagggggtgtttcacaccatgtggcacgtgacacggggagccgttctgacctataacggcaaacgcctcgagccgaattgggcgtccgtcaagaaagatctgattagctacggcgggggatggagactttctgctcagtggcaaaagggcgaagaggtccaggtgatcgccgtcgaacctgggaaaaaccccaagaatttccagacaatgcctggaacgttccagaccacaaccggcgagattggggccatcgctctggactttaagcccggaacctccggcagccccattatcaaccgggaaggcaaagtggttgggctgtatggaaatggcgtggtcacaaagaacgggggatacgtgtccggcatcgcccaaacgaatgctgagcctgatgggccgacccccgagctcgaagaggaaatgttcaaaaagcgcaacctgacaattatggaccttcatcctggcagcggaaaaaccagaaagtatctgcccgccatcgttcgggaggcgattaagcgcagactccggacactgatcctcgcccctaccagagtggtcgctgccgaaatggaggaggctctgaaaggccttcccattcgctaccagacgacagccaccaagtctgaacacaccgggcgggagatcgtggatctgatgtgccatgccacatttaccatgagactgctcagccctgttcgcgtgccgaattataacctgatcattatggacgaagctcacttcacagatcccgcgtccatcgccgctcggggatacatttctaccagagtcggcatgggggaggccgccgctatctttatgacggccacacctcccggaaccgcggacgctttccctcagagcaatgcccccattcaggacgaggaacgcgatatcccggagcggtcctggaactctggcaatgaatggatcacagactttgccgggaaaaccgtgtggttcgtgcctagcattaaggctggcaacgatatcgccaactgtcttcgcaaaaatggaaagaaggtcattcaactgtccagaaaaacgtttgacaccgagtaccagaagacaaaactcaacgattgggacttcgttgtgaccacagatatctctgaaatgggcgcgaattttaaggccgaccgggtgattgatcccagacggtgcctgaaacccgtcatcctgaccgacgggcctgagcgcgtgattctcgctggacccatgcctgttacagccgctagcgccgctcagagacggggccgcgtggggagaaacccgcagaaggagaatgatcaatatatcttcaccggacagccccttaacaatgacgaagaccatgcccactggacggaggcgaagatgctgctggataacatcaatacacctgaaggcattatccccgccctcttcgagcctgaacgggagaaatccgctgccattgacggggagtacagactgaagggcgaaagccgcaaaacctttgtcgagcttatgcggagaggagatctgcccgtgtggctcgctcacaaggttgcctctgaaggcatcaaatataccgaccgcaagtggtgcttcgatgggcagcggaacaatcagattctggaggaaaacatggacgtggagatctggacaaaagagggagaaaagaagaaactgagaccgcgctggctcgatgcccggacctactccgaccctcttgctctgaaggagtttaaagatttcgcggccggcagaaagagcatcgctctggacctcgtcacagaaattgggcgcgtgccctctcatctggcccacagaacgcggaatgcccttgataacctggtcatgctccatacctccgagcacggaggccgcgcttatagacacgccgtggaggaactgcctgagacaatggaaaccctgctccttctgggcctgatgatcctcctgacagggggagcgatgctttttctgattagcggcaaagggatcggaaagacctccattggcctcatctgtgttatcgcctctagcgggatgctgtggatggctgagattcccctgcaatggatcgcctccgctattgtgctcgagttctttatgatggtgcttctgatccctgagcccgagaagcagcggacgccgcaggacaatcaactggcctacgtcgttattggaatcctcaccctggcggccattatcgctgccaacgaaatgggccttctggagacaaccaaacgcgatctcggcatgagcaaggaacctggggtggtgtctcccacatcctatctggacgtcgacctgcatcccgctagcgcctggaccctctacgctgtggccacgacagttatcacccctatgcttagacacacaattgaaaattctaccgcgaacgtgagcctggccgctatcgccaaccaggctgtcgtgctgatgggactcgataaaggctggccgatttccaagatggacctgggggtcccccttctggccctcggatgctactctcaggtgaatcctctgaccctgacagccgcggttctccttctgatcacgcattatgctattatcggccccgggctgcaggccaaagctacccgggaagcccaaaagagaacagccgctggaatcatgaagaaccctaccgtggatggcattatgacaatcgacctcgatcccgtcatttacgacagcaaattcgagaagcagctgggccaggtgatgcttctggttctctgtgccgtgcagctgctgctcatgcgcacctcctgggcgctttgcgaggccctgacgctggctacagggcctatcaccaccctctgggaaggatctccgggcaaattttggaatacaaccattgccgtcagcatggctaacatcttccgggggtcctatctggccggagcgggccttgcctttagcatcatgaagtctgtggggacaggaaaaagaggcacgggctcccaaggggagaccctgggagaaaagtggaagaaaaagctcaatcagctgagccgcaaagagttcgatctgtacaagaaatccggcattacagaagtggaccggaccgaggctaaggaggggctcaaaagaggagaaacaacccaccatgccgtttctcggggcagcgctaaacttcagtggtttgtcgagcgcaacatggtgatccccgaagggagagtgattgatctgggatgtggccggggcgggtggtcctattactgcgccggactgaagaaagtcacggaggttcgcggctataccaaagggggacctggccacgaggaacccgtgcctatgtctacatacgggtggaatatcattaaactcatgagcggaaaggacgtgttctacctgcccccggagaaatgtgatacccttctgtgcgacatcggcgaatccagcccttctcccacagtcgaggaatccagaaccattcgggtgctcaagatggttgagccctggctgaagaacaatcagttctgtatcaaaatcctgaacccttatatgcccacagtgattgagcacctcgaacgccttcaaagaaagcatggcgggatgctggtccggaatcctctgagccgcaactctacccacgagatgtactggatctccaatggaacgggcaacattgtggctagcgttaatatggtgtctagactcctgcttaaccggtttacaatgacccatagacgcccgaccatcgaaaaagatgtcgacctgggggccggaacacggcacgtgaacgcggagcccgaaacgcctaatatggacgtgattggcgagagaatcaagcgcatcaaagaggaacacaacagcacctggcattatgatgacgagaatccctacaagacatgggcctatcacgggtcctacgaagtcaaggctaccggatctgccagctccatgattaacggcgttgtgaaactcctgacaaagccttgggatgtggtccccatggtgacccagatggctatgacagacaccacgccgttcggccagcaacgggtttttaaagagaaggtggataccagaacacctcgcagcatgcccgggacccggagagtcatgggaatcacagccgaatggctgtggcgcaccctcggccggaataaaaagcctagactgtgcacgcgcgaggagttcacaaagaaagtgcggaccaacgccgcgatgggggctgtttttacagaagagaatcagtgggactccgccaaggccgctgtggaagatgaggacttctggaaacttgtcgatagagaacgcgagctgcataagctcggaaaatgtggctcttgcgtgtataacatgatggggaagagagagaaaaagctgggcgaatttggaaaggccaaaggcagccgggctatttggtacatgtggcttggggcccgctacctggagttcgaagcgctcggatttctgaatgaggaccactggttctccagagagaactcttatagcggcgttgaaggggagggactgcataagctcggctacatcctgcgggatatttccaaaatccccgggggcgccatgtatgctgacgacaccgccggatgggatacgagaatcaccgaagacgatcttcacaatgaggaaaagattacacagcagatggaccctgagcaccggcaactggctaacgccatctttaaactcacctaccagaataaggtggtcaaggtgcagcgccccacaccgaccggcacagtcatggatattatctctagaaaagaccagcgggggagcggacaagtgggcacctatgggctgaacacgttcacaaatatggaggcgcagcttattcgccagatggaaggagagggcgttctgtccaaggccgatctcgaaaaccctcatctgcccgagaaaaagatcacccagtggctggaaaccaaaggggtggagagactcaagcggatggctatcagcggcgacgattgcgtcgtgaagcccattgacgatcgctttgccaacgctctgcttgccctgaatgacatgggaaaagtgagaaaggatatccctcaatggcagccgtctaaaggctggcacgactggcagcaggttcccttctgttcccatcacttccacgagctcattatgaaggacgggcggaaactggtggtcccttgccgcccccaagatgaacttatcggacgggctcggattagccagggcgccgggtggtctctgcgcgagacagcgtgtctcggaaaggcctacgctcagatgtggtccctgatgtattttcatagacgggacctgcgcctcgccagcaacgccatctgctctgctgtgcctgttcactgggtgcccacctccagaacaacgtggagcattcatgcccaccatcaatggatgaccacagaagatatgctgaccgtctggaatcgggtgtggatcgaggacaacccttggatggaagataagacacccgtcaccacgtgggaggacgtgccgtaccttggcaaaagagaggatcagtggtgtgggtccctgatcggcctcaccagccgcgcgacatgggctcagaatattcctaccgccatccagcaagttcggtctctgattggaaacgaagagttccttgactacatgcccagcatgaagagatttcgcaaagaagaggagtccgaaggcgccatctggtga

SEQ ID NO: 20413 - RNA, 9873 nt, synthetic construct
  misc_feature 1..9873: note = derived and/or modified CDS sequence (opt5) from DENV-3__FJ850083__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagcatgaaaatctcaagtatacagtcatcatcaccgtgcacacaggggaccagcatcaggttggaaacgagacgcaaggcgtgaccgctgaaattacacctcaggcctctaccacagaggctatcctgcccgaatacggcaccctggggctcgagtgctcccctcgcacgggactggacttcaatgagatgattcttctgaccatgaaaaacaaggcctggatggtccacagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcataccgctctgacaggcgccaccgaaatccagaattccgggggcaccagcattttcgccggacacctgaagtgtcgcctcaaaatggacaagctggagcttaaaggcatgtcttatgctatgtgcacaaacacgtttgtgctgaagagagaggtctccgaaacccagcatgggacaatcctcatcaaagtggagtacaagggagaagatgccccctgtaagattcctttcagcaccgaggacggccaagggaaagcgcacaacggacggctgatcacagctaatcccgttgtgaccaagaaagatgagcccgtcaacattgaagccgagcctccgttcggcgaatccaatatcgtgattgggatcggcgacaacgccctgaagatcaattggtacaaaaagggatctagcattggcaagatgtttgaggctacggccagaggggctcgccggatggccatccttggagatacagcgtgggacttcggctccgtggggggagttctcaacagcctgggcaaaatggtccatcagatttttgggtctgcctataccgctctgttctccggcgtgagctgggtgatgaagatcggaattggcgtcctcctgacctggatcgggcttaattctaaaaacacaagcatgtccttttcttgcattgccatcggaaccatcacactgtacctcggcgctgtggttcaggccgatatggggtgtgtgattaattggaagggaaaagaactgaagtgcggcagcgggatcttcgtcacgaacgaggtgcacacctggacagagcagtataagtttcaagcggactcccccaaaagactggccaccgctattgccggcgcttgggaaaatggagtttgtggcatccgcagcacaacccggatggagaaccttctctggaagcagattgccaatgaactgaactacatcctgtgggagaataacatcaaactcacggtggtcgtgggggatattatcggagttctggaacagggcaagagaacccttacacctcagcccatggagctgaaatattcttggaagacctgggggaaagccaagattgtgacagctgagacccaaaactccagcttcatcattgacggacctaatacacccgaatgcccgtctgcgtcccgcgcctggaacgtctgggaggtggaagactacggctttggcgtgttcaccacgaatatctggctcaagctgcgggaggtctatacacagctgtgtgatcacagacttatgagcgctgccgttaaagacgaacgcgccgtgcatgctgatatggggtactggatcgagtcccagaagaacggatcttggaaactcgagaaggccagcctgattgaagtgaaaacctgcacctggcctaagtcccacacactgtggtctaatggcgtcctcgagagcgacatgatcattcccaagtccctggcggggcctatcagccagcataaccaccggcccggataccacacccaaacggctggcccttggcatcttgggaaactggaactcgattttaattattgcgagggaacaaccgtggttattacagagaactgtggcaccagaggcccctctctgcgcacaaccacggtgtccgggaagctgatccacgaatggtgctgtcggagctgcacccttccgcctctcagatacatgggagaggacggctgttggtatgggatggaaatccggcccatttctgagaaagaagagaatatggtcaagtccctggtgagcgccggatctggcaaagttgataacttcacaatgggggtgctgtgcctcgccatcctgtttgaggaagtcatgcgcggaaagttcggcaagaaacatatgattgctggcgtgttctttaccttcgttcttctgctcagcgggcagatcacatggagagacatggcccacaccctgattatgatcggatccaatgcgagcgatcggatgggcatgggggtgacgtacctggctcttattgccacatttaagatccagcccttcctggccctcggatttttcctgagaaaactcacctctcgcgagaacctgcttctgggcgtcgggctcgctatggccacaaccctgcaactgcctgaagacatcgagcagatggctaatggaattgcccttggcctgatggcgctcaagctgatcacccagtttgaaacatatcagctctggacggccctgatttcccttacctgtagcaacacaatgttcaccctgacagtggcttggcggaccgccacgctcatcctggctggcgtgtccctgcttccggtctgccaatctagctccatgagaaaaacagattggctgcccatggccgttgccgctatgggggtgcctcccctccctctgtttattttctctctcaaggacaccctgaagcgcagaagctggccccttaatgagggagtgatggcggtcggcctggtgtccatcctggcctctagcctcctgcggaacgatgttcctatggctgggccccttgtggccggaggcctgctcatcgcctgttacgtcattaccgggacatccgctgacctgaccgtggagaaagccgcggacatcacatgggaagaggaagctgagcagacgggagttagccataacctcatgattaccgtggatgacgatggcacaatgcgcatcaaggacgatgaaaccgagaatattctgacagtccttctgaaaaccgccctgctcatcgtgtctggcgtctttccgtattccatccctgccacgctgcttgtgtggcacacctggcagaagcagacacaaagaagcggggttctgtgggacgtgccctctcctcccgagacccagaaagctgaactcgaggaaggagtctaccggattaagcagcagggcatcttcgggaaaacacaagtgggagttggcgtgcagaaggagggggtctttcacaccatgtggcatgtgacacgcggagccgtgctgacgtacaacggcaagagactcgagccgaattgggcgtccgttaaaaaggatctgattagctatggcgggggatggcggctttctgctcagtggcaaaaaggcgaagaggtccaggtgatcgccgtggaacctgggaagaaccccaaaaatttccagaccatgcctggaacattccagaccaccacaggcgagattggggccatcgctctggactttaagcccggaacgtccggcagccccattatcaaccgcgaaggcaaggtcgtggggctgtacggaaatggcgttgtgaccaaaaacgggggatatgtctccggcatcgcccaaacaaatgctgagcctgatgggccgacccccgagctcgaagaggaaatgttcaagaaaagaaacctgacaattatggaccttcaccctggcagcggaaagacccggaaatacctgcccgccatcgtgcgcgaggcgattaagagacggctcagaacgctgatcctcgcccctacacgcgttgtggctgccgaaatggaggaggctctgaagggccttcccattcggtatcagaccaccgccacaaaatctgaacataccgggagagagatcgtcgatctgatgtgccacgccacatttaccatgcgcctgctcagccctgtgcgggttccgaattacaacctgatcattatggacgaagctcatttcacggatcccgcgtccatcgccgctagaggatatatttctacacgcgtgggcatgggggaggccgccgctatctttatgaccgccacacctcccggaaccgcggacgctttccctcagagcaatgcccccattcaggacgaagagcgggatatcccggagagatcctggaactctggcaatgaatggatcacggactttgccgggaagaccgtctggttcgtgcctagcattaaagctggcaacgatatcgccaactgtcttcgcaagaatggaaaaaaggtgattcaactgtcccggaagacatttgacaccgagtaccagaaaacaaagctcaacgattgggacttcgtcgttaccacagatatctctgaaatgggcgcgaattttaaagccgacagagtgattgatccccggcgctgcctgaagcccgtgatcctgaccgacgggcctgagagagtcattctcgctggacccatgcctgtgacggccgctagcgccgctcagcggcgcggcagagttgggcggaacccgcagaaagagaatgatcaatacatcttcacaggacagccccttaacaatgacgaagaccacgcccactggaccgaggcgaagatgctgctggataacatcaatacccctgaaggcattatccccgccctcttcgagcctgaaagagagaagtccgctgccattgacggggagtatcgcctgaaaggcgaaagccggaagacatttgtggagcttatgagacgcggagatctgcccgtctggctcgctcataaagtggcctctgaaggcatcaagtacaccgaccggaaatggtgcttcgatgggcagagaaacaatcagattctggaggaaaacatggacgttgagatctggacaaaggagggagaaaaaaagaagctgcgcccgcggtggctcgatgccagaacgtattccgaccctcttgctctgaaagagtttaaggatttcgcggccggccgcaaaagcatcgctctggacctcgtgaccgaaattgggagagtcccctctcacctggcccatcggacacgcaatgcccttgataacctggtgatgctccacacctccgagcacggaggcagagcttaccggcatgccgtcgaagagctgcctgagacaatggaaaccctgctccttctgggcctgatgatcctcctgacggggggagcgatgctttttctgattagcggcaaggggatcggaaaaacctccattggcctcatctgtgtgatcgcctctagcgggatgctgtggatggctgagattcccctgcaatggatcgcctccgctattgttctcgaattctttatgatggtgcttctgatccctgagcccgagaagcagcgcacaccgcaggacaatcaactggcctatgtggtcattggaatcctcaccctggcggccattatcgctgccaacgaaatgggccttctggagacaaccaagagagatctcggcatgagcaaagaacctggggttgtgtctcccacgtcctacctggacgtggacctgcaccccgctagcgcctggacactctatgctgtcgccaccacagtgatcacccctatgcttcggcataccattgagaattctacagcgaacgttagcctggccgctatcgccaaccaggctgtggtcctgatgggactcgataagggctggccgatttccaaaatggacctgggggtgccccttctggccctcggatgctactctcaggtcaatcctctgacgctgaccgccgcggtgctccttctgatcacacactacgctattatcggccccgggctgcaggccaaggctaccagagaagcccaaaaacgcacagccgctggaatcatgaagaaccctaccgttgatggcattatgacgatcgacctcgatcccgtgatttatgacagcaagttcgagaaacagctgggccaggtcatgcttctggtgctctgtgccgttcagctgctgctcatgcggacatcctgggcgctttgcgaggccctgaccctggctaccgggcctatcacaaccctctgggaaggatctccgggcaagttttggaatacaacgattgccgtgagcatggctaacatcttcagagggtcctacctggccggagcgggccttgcctttagcatcatgaaatctgtcgggaccggaaagcgcggcacaggctcccaaggggagaccctgggagaaaaatggaagaagaaactcaatcagctgagccggaaggagttcgatctgtataaaaagtccggcattacagaagtggacagaaccgaggctaaagaggggctcaagcggggagaaacgacccatcacgccgtgtctcgcggcagcgctaaacttcagtggtttgttgagagaaacatggtcatccccgaagggcgggtgattgatctgggatgtggccgcggcgggtggtcctactattgcgccggactgaagaaggtgacagaggtcagaggctacaccaaagggggacctggccacgaagagcccgttcctatgtctacatatgggtggaatatcgtgaagctcatgagcggaaaagacgtgttctacctgcccccggagaagtgtgatacccttctgtgcgacattggcgaatccagcccttctcccacagtcgaggaatcccggaccatccgcgtgctcaaaatggttgagccctggctgaagaacaatcagttctgtattaagatcctgaacccttacatgcccacggtgatcgagcatctcgaaagacttcaacggaaacacggcgggatgctggtccgcaatcctctgagcagaaactctacacatgagatgtattggatttccaatggaaccggcaacatcgtggctagcgttaatatggtgtctcggctcctgcttaacagatttaccatgacacaccgccggccgacgattgaaaaggatgtcgacctgggggccggaaccagacacgtgaacgcggagcccgaaacacctaatatggacgtgatcggcgagcgcattaaacggatcaaggaggaacataacagcacctggcactacgatgacgagaatccctataaaacatgggcctaccatgggtcctatgaagtcaaggctaccggatctgccagctccatgatcaacggcgttgtgaagctcctgacaaaaccttgggatgtggtccccatggtgacccagatggctatgacggacaccacaccgttcggccagcaaagagtttttaaggagaaagtggatacccgcacacctcggagcatgcccgggaccagacgcgtcatgggaattacggccgaatggctgtggcggacactcggcagaaataagaaacctcgcctgtgcacccgggaggagttcacaaagaaggtgagaaccaacgccgcgatgggggctgtttttacggaagagaatcagtgggactccgccaaagccgctgtggaagatgaggacttctggaagcttgtcgatcgcgaaagagagctgcacaaactcggaaagtgtggctcttgcgtgtacaacatgatggggaaacgggagaagaaactgggcgaatttggaaaggccaagggcagccgcgctatctggtatatgtggcttggggccagatacctggagttcgaagcgctcggatttctgaatgaggaccattggttctcccgggagaactcttacagcggcgttgaaggggagggactgcacaaactcggctatattctgagagatatctccaagattcccgggggcgccatgtacgctgacgacaccgccggatgggatacacggatcaccgaagacgatcttcacaatgaggaaaaaatcacacagcagatggaccctgagcatcgccaactggctaacgccatttttaagctcacctatcagaataaagtggtcaaggtgcagagacccacaccgaccggcacggtcatggatatcatttctcggaaggaccagcgcgggagcggacaagtgggcacatacgggctgaacaccttcaccaatatggaggcgcagcttatcagacagatggaaggagagggcgttctgtccaaagccgatctcgaaaaccctcacctgcccgagaagaaaattacacagtggctggaaaccaagggggtggagcggctcaaacgcatggctatcagcggcgacgattgcgtcgtgaagcccatcgacgatagatttgccaacgctctgcttgccctgaatgacatgggaaaggtgcggaaagatattcctcaatggcagccgtctaagggctggcatgactggcagcaggttcccttctgttcccaccacttccatgagctcatcatgaaagacgggcgcaagctggtggtcccttgcagaccccaagatgaacttattggacgggctcgcatcagccagggcgccgggtggtctctgagagagacagcgtgtctcggaaaagcctatgctcagatgtggtccctgatgtactttcaccggcgcgacctgagactcgccagcaacgccatttgctctgctgtgcctgttcattgggtgcccacgtcccggaccacatggagcatccacgcccatcaccaatggatgaccacagaagatatgctgaccgtctggaatagagtgtggattgaggacaacccttggatggaagataagacgcccgtcaccacatgggaggacgtgccgtatcttggcaagcgcgaggatcagtggtgtgggtccctgatcggcctcaccagccgggcgacatgggctcagaatatccctaccgccattcagcaagttagatctctgatcggaaacgaagagttccttgactacatgcccagcatgaaacgctttcggaaggaagaggagtccgaaggcgccatttggtga

SEQ ID NO: 20414 - RNA, 9873 nt, synthetic construct
  misc_feature 1..9873: note = derived and/or modified CDS sequence (opt5) from DENV-3__FJ850086__SS-prME
  source 1..9873: mol_type = other RNA
acaagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcgccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgaccaagaaggatgagcccgtcaacattgaagccgagcctccgttcggcgaatccaatatcgtgattgggatcggcgacaacgctctgaaaatcaattggtataagaagggatctagcattggcaaaatgtttgaggccaccgctagaggggccagacgcatggcgatccttggagatacggcctgggacttcggctccgtcgggggagttctcaacagcctgggcaagacagtccaccagatttttgggtctgcttacaccgccctgttctccggcgtgagctgggtgatgaaaatcggaattggcgtcctcctgacctggatcgggcttaattctaagaacacaagcatgtccttttcttgcattgctatcggaatcattaccctgtatctcggcgccgtggttcaggcggatatggggtgtgtgatcaattggaaaggaaaggaactgaagtgcggcagcgggattttcgtcacaaacgaggtgcatacgtggaccgagcagtacaaatttcaagccgactcccccaagcggctggctacagccatcgctggcgcctgggaaaatggagtttgtggcattagaagcaccacacgcatggagaaccttctctggaaacaggtggccaatgaactgaactatatcctgtgggagaataacatcaagctcaccgtcgtggttggggatattatcggagtgctggaacagggcaaacggacgcttacccctcagcccatggagctgaagtactcttggaaaacatgggggaaggctaagattgtcaccgcggagacacaaaactccagcttcatcattgacggacctaatacccccgaatgcccgtctgcctccagagcttggaacgtgtgggaggtggaagactatggctttggcgtcttcacaaccaatatctggctcaaactgcgcgaggtttacacgcagctgtgtgatcaccggcttatgagcgccgccgtgaaggacgaaagagctgtgcacgccgatatggggtactggatcgagtcccagaaaaacggatcttggaagctcgagaaagcgagcctgattgaagtcaagacatgcacctggcctaagtcccataccctgtggtctaatggcgtgctcgagagcgacatgatcattcccaaatccctggctgggcctatcagccagcacaaccatcgccccggatatcacacacaaaccgccggcccttggcaccttgggaagctggaactcgattttaattactgcgagggaacgacagttgtgattaccgagaactgtggcacacggggcccctctctgagaaccacaaccgtctccgggaaactgatccatgaatggtgctgtcgcagctgcacgcttccgcctctccggtatatgggagaggacggctgttggtacgggatggaaatcagacccatttctgagaaggaagagaatatggtgaaatccctggttagcgccggatctggcaaggtggataacttcaccatgggggtcctgtgcctcgctatcctgtttgaggaagtgatgcggggaaagttcggcaaaaagcacatgattgccggcgttttctttatgttcgtgcttctgctcagcgggcagatcacatggcgcgacatggcgcataccctgattatgatcggatccaatgctagcgatagaatgggcatgggggtcacatatctggcccttattgccacctttaaaatccagcccttcctggctctcggatttttcctgcggaagctcacgtctagagagaacctgcttctgggcgtggggctcgccatggctacaaccctgcaactgcctgaagacatcgagcagatggccaatggaattgcgcttggcctgatggccctcaaactgatcacacagtttgaaacctaccagctctggaccgctctgatttcccttacatgtagcaacacgatgttcaccctgacagtggcctggcgcaccgctacactcatcctggccggcgtctccctgcttccggtttgccaatctagctccatgcggaagaccgattggctgcccatggccgtggctgcgatgggggtgcctcccctccctctgtttattttctctctcaaggacacgctgaaaagacgcagctggccccttaatgagggagtcatggccgtgggcctggtttccatcctggcttctagcctcctgagaaacgatgtgcctatggccgggccccttgtcgccggaggcctgctcatcgcttgttatgtgattacagggacctccgccgacctgaccgttgagaaggcggctgacatcacatgggaagaggaagccgagcagaccggagtgagccacaacctcatgattacagtcgatgacgatggcacgatgcggatcaaagacgatgaaaccgagaatattctgacagtgcttctgaagaccgccctgctcatcgtctctggcgtgtttccgtactccatccctgctacactgcttgtttggcatacctggcagaaacagacgcaacgcagcggggtgctgtgggacgtcccctctcctcccgagacccagaaggccgaactcgaggaaggagtgtacagaattaaacagcagggcatcttcgggaagacacaagttggagtgggcgtccagaaggagggggtgtttcacaccatgtggcacgtgacacggggagcggttctgacctataacggcaaacgcctcgagccgaattgggcttccgtcaagaaagatctgattagctacggcgggggatggagactttctgcccagtggcaaaagggcgaagaggtccaggtgatcgccgtcgaacctgggaaaaaccccaagaatttccagacaatgcctggaacgttccagaccacaaccggcgagattggggctatcgccctggactttaagcccggaacctccggcagccccattatcaaccgggaaggcaaagtggttgggctgtatggaaatggcgtggtcacaaagaacgggggatacgtgtccggcatcgctcaaacgaatgccgagcctgatgggccgacccccgagctcgaagaggaaatgttcaaaaagcgcaacctgacaattatggaccttcatcctggcagcggaaaaaccagaaagtatctgcccgcgatcgttcgggaggccattaagcgcagactccggacactgatcctcgctcctaccagagtggtcgccgctgaaatggaggaggccctgaaaggccttcccattcgctaccagacgacagccaccaagtctgaacacaccgggcgggagatcgtggatctgatgtgccatgctacatttaccatgagactgctcagccctgttcgcgtgccgaattataacctgatcattatggacgaagcgcacttcacagatcccgcctccatcgctgcccggggatacatttctaccagagtcggcatgggggaggccgctgccatctttatgacggcgacacctcccggaaccgctgacgccttccctcagagcaatgcccccattcaggacgaggaacgcgatatcccggagcggtcctggaactctggcaatgaatggatcacagactttgctgggaaaaccgtgtggttcgtgcctagcattaaggccggcaacgatatcgcgaactgtcttcgcaaaaatggaaagaaggtcattcaactgtccagaaaaacgtttgacaccgagtaccagaagacaaaactcaacgattgggacttcgttgtgaccacagatatctctgaaatgggcgccaattttaaggctgaccgggtgattgatcccagacggtgcctgaaacccgtcatcctgaccgacgggcctgagcgcgtgattctcgccggacccatgcctgttacagctgccagcgctgcccagagacggggccgcgtggggagaaacccgcagaaggagaatgatcaatatatcttcaccggacagccccttaacaatgacgaagaccatgcgcactggacggaggccaagatgctgctggataacatcaatacacctgaaggcattatccccgctctcttcgagcctgaacgggagaaatccgccgctattgacggggagtacagactgaagggcgaaagccgcaaaacctttgtcgagcttatgcggagaggagatctgcccgtgtggctcgcccacaaggttgcctctgaaggcatcaaatataccgaccgcaagtggtgcttcgatgggcagcggaacaatcagattctggaggaaaacatggacgtggagatctggacaaaagagggagaaaagaagaaactgagaccgcgctggctcgatgctcggacctactccgaccctcttgcgctgaaggagtttaaagatttcgccgctggcagaaagagcatcgccctggacctcgtcacagaaattgggcgcgtgccctctcatctggcccacagaacgcggaatgctcttgataacctggtcatgctccatacctccgagcacggaggccgcgcctatagacacgcggtggaggaactgcctgagacaatggaaaccctgctccttctgggcctgatgatcctcctgacagggggagccatgctttttctgattagcggcaaagggatcggaaagacctccattggcctcatctgtgttatcgcttctagcgggatgctgtggatggccgagattcccctgcaatggatcgcttccgccattgtgctcgagttctttatgatggtgcttctgatccctgagcccgagaagcagcggacgccgcaggacaatcaactggcgtacgtcgttattggaatcctcaccctggccgctattatcgccgctaacgaaatgggccttctggagacaaccaaacgcgatctcggcatgagcaaggaacctggggtggtgtctcccacatcctatctggacgtcgacctgcatcccgccagcgcttggaccctctacgccgtggcgacgacagttatcacccctatgcttagacacacaattgaaaattctaccgccaacgtgagcctggctgccatcgctaaccaggccgtcgtgctgatgggactcgataaaggctggccgatttccaagatggacctgggggtcccccttctggccctcggatgctactctcaggtgaatcctctgaccctgacagcggctgttctccttctgatcacgcattatgccattatcggccccgggctgcaggctaaagccacccgggaagcccaaaagagaacagctgccggaatcatgaagaaccctaccgtggatggcattatgacaatcgacctcgatcccgtcatttacgacagcaaattcgagaagcagctgggccaggtgatgcttctggttctctgtgcggtgcagctgctgctcatgcgcacctcctgggccctttgcgaggctctgacgctggccacagggcctatcaccaccctctgggaaggatctccgggcaaattttggaatacaaccattgctgtcagcatggccaacatcttccgggggtcctatctggcgggagccggccttgcttttagcatcatgaagtctgtggggacaggaaaaagaggcacgggctcccaaggggagaccctgggagaaaagtggaagaaaaagctcaatcagctgagccgcaaagagttcgatctgtacaagaaatccggcattacagaagtggaccggaccgaggccaaggaggggctcaaaagaggagaaacaacccaccatgctgtttctcggggcagcgccaaacttcagtggtttgtcgagcgcaacatggtgatccccgaagggagagtgattgatctgggatgtggccggggcgggtggtcctattactgcgctggactgaagaaagtcacggaggttcgcggctataccaaagggggacctggccacgaggaacccgtgcctatgtctacatacgggtggaatatcattaaactcatgagcggaaaggacgtgttctacctgcccccggagaaatgtgatacccttctgtgcgacatcggcgaatccagcccttctcccacagtcgaggaatccagaaccattcgggtgctcaagatggttgagccctggctgaagaacaatcagttctgtatcaaaatcctgaacccttatatgcccacagtgattgagcacctcgaacgccttcaaagaaagcatggcgggatgctggtccggaatcctctgagccgcaactctacccacgagatgtactggatctccaatggaacgggcaacattgtggccagcgttaatatggtgtctagactcctgcttaaccggtttacaatgacccatagacgcccgaccatcgaaaaagatgtcgacctgggggcgggaacacggcacgtgaacgccgagcccgaaacgcctaatatggacgtgattggcgagagaatcaagcgcatcaaagaggaacacaacagcacctggcattatgatgacgagaatccctacaagacatgggcttatcacgggtcctacgaagtcaaggccaccggatctgctagctccatgattaacggcgttgtgaaactcctgacaaagccttgggatgtggtccccatggtgacccagatggccatgacagacaccacgccgttcggccagcaacgggtttttaaagagaaggtggataccagaacacctcgcagcatgcccgggacccggagagtcatgggaatcacagccgaatggctgtggcgcaccctcggccggaataaaaagcctagactgtgcacgcgcgaggagttcacaaagaaagtgcggaccaacgcggctatgggggccgtttttacagaagagaatcagtgggactccgccaaggctgccgtggaagatgaggacttctggaaacttgtcgatagagaacgcgagctgcataagctcggaaaatgtggctcttgcgtgtataacatgatggggaagagagagaaaaagctgggcgaatttggaaaggctaaaggcagccgggccatttggtacatgtggcttggggcgcgctacctggagttcgaagccctcggatttctgaatgaggaccactggttctccagagagaactcttatagcggcgttgaaggggagggactgcataagctcggctacatcctgcgggatatttccaaaatccccgggggcgctatgtatgccgacgacaccgctggatgggatacgagaatcaccgaagacgatcttcacaatgaggaaaagattacacagcagatggaccctgagcaccggcaactggccaacgcgatctttaaactcacctaccagaataaggtggtcaaggtgcagcgccccacaccgaccggcacagtcatggatattatctctagaaaagaccagcgggggagcggacaagtgggcacctatgggctgaacacgttcacaaatatggaggcccagcttattcgccagatggaaggagagggcgttctgtccaaggctgatctcgaaaaccctcatctgcccgagaaaaagatcacccagtggctggaaaccaaaggggtggagagactcaagcggatggccatcagcggcgacgattgcgtcgtgaagcccattgacgatcgctttgctaacgccctgcttgctctgaatgacatgggaaaagtgagaaaggatatccctcaatggcagccgtctaaaggctggcacgactggcagcaggttcccttctgttcccatcacttccacgagctcattatgaaggacgggcggaaactggtggtcccttgccgcccccaagatgaacttatcggacgggcccggattagccagggcgcggggtggtctctgcgcgagacagcctgtctcggaaaggcttacgcccagatgtggtccctgatgtattttcatagacgggacctgcgcctcgccagcaacgctatctgctctgccgtgcctgttcactgggtgcccacctccagaacaacgtggagcattcatgcgcaccatcaatggatgaccacagaagatatgctgaccgtctggaatcgggtgtggatcgaggacaacccttggatggaagataagacacccgtcaccacgtgggaggacgtgccgtaccttggcaaaagagaggatcagtggtgtgggtccctgatcggcctcaccagccgcgctacatgggcccagaatattcctaccgccatccagcaagttcggtctctgattggaaacgaagagttccttgactacatgcccagcatgaagagatttcgcaaagaagaggagtccgaaggcgctatctggtga

SEQ ID NO: 20415 - RNA, 9873 nt, synthetic construct
  misc_feature 1..9873: note = derived and/or modified CDS sequence (opt5) from DENV-3__FJ850089__SS-prME
  source 1..9873: mol_type = other RNA
accagcctgtgcctcatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggagatgtgcgacgatacagtcacctacaagtgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagcatgaaaatctcaagtatacagtcatcatcaccgtgcacacaggggaccagcatcaggttggaaacgagacgcaaggcgtgaccgctgaaattacacctcaggcctctaccacagaggtcatcctgcccgaatacggcaccctggggctcgagtgctcccctcgcacgggactggacttcaatgagatgattcttctgaccatgaaaaacaaggcttggatggtgcacagacagtggtttttcgatctccccctgccgtggacaagcggcgccaccacagaaacccctacgtggaatcggaaagagcttctggtcacatttaagaacgcccacgctaaaaagcaagaagtggttgtgctcgggtctcaggagggagcgatgcataccgccctgacaggcgctaccgaaatccaaaattccgggggcaccagcattttcgccggacacctgaagtgtcgcctcaaaatggacaagctggagcttaaaggcatgtcttatgccatgtgcacaaacacgtttgtcctgaagaaagaggtgtccgaaacccagcatgggacaatcctcatcaaggttgagtacaagggagaagatgctccctgtaaaattcctttcagcaccgaggacggccaagggaaggcccacaacggaagactgatcacagcgaatcccgtggtcaccaaaaaggatgagcccgtgaacattgaagctgagcctccgttcggcgaatccaatatcgtgattgggatcggcgacaacgccctgaaaatcaattggtacaagaagggatctagcattggcaaaatgtttgaggccacggctagaggggcgagacgcatggctatccttggagatacagcctgggacttcggctccgttgggggagtcctcaacagcctgggcaagatggtgcatcagatttttgggtctgcgtataccgccctgttctccggcgtgagctgggtcatgaaagtgggaatcggcgttctcctgacctggattgggcttaattctaagaacacaagcatgtccttttcttgcatcgctattggaatcatcaccctgtacctcggcgccgtggtccaggctgatatggggtgtgtgattaattggaaaggaaaggaactgaagtgcggcagcgggatcttcgttacaaacgaggtgcacacgtggaccgagcagtataaatttcaagccgactcccccaagcggctggcgacagccattgctggcgcctgggaaaatggagtctgtggcatcagaagcaccacacgcatggagaaccttctctggaaacagattgctaatgaactgaactacatcctgtgggagaataacatcaagctcaccgtggttgtgggggatattatcggagtcctggaacagggcaaacggacgcttacccctcagcccatggagctgaagtattcttggaaaacatgggggaaggccaagattgtgaccgccgagacacaaaactccagcttcatcattgacggacctaatacccccgaatgcccgtctgcttccagagcgtggaacgtgtgggaggtcgaagactacggctttggcgttttcacaaccaatatctggctcaaactgcgcgaggtgtatacgcagctgtgtgatcaccggcttatgagcgccgctgtgaaggacgaaagagccgtccatgccgatatggggtactggatcgagtcccagaaaaacggatcttggaagctcgagaaagctagcctgattgaagtgaagacatgcacctggcctaagtcccacaccctgtggtctaatggcgttctcgagagcgacatgatcattcccaaatccctggccgggcctatcagccagcataaccaccgccccggataccacacacaaaccgcgggcccttggcatcttgggaagctggaactcgattttaattattgcgagggaacgacagtggtcattaccgagaactgtggcacacggggcccctctctgagaaccacaaccgtgtccgggaaactgatccacgaatggtgctgtcgcagctgcacgcttccgcctctccggtacatgggagaggacggctgttggtatgggatggaaatcagacccatttctgagaaggaagagaatatggttaaatccctggtgagcgctggatctggcaaggtcgataacttcaccatgggggtgctgtgcctcgccatcctgtttgaggaagttatgcggggaaagttcggcaaaaagcatatgattgccggcgtgttctttacattcgtccttctgctcagcgggcagatcacctggcgcgacatggctcacacactgattatgatcggatccaatgccagcgatagaatgggcatgggggtgacctacctggcgcttattgctacgtttaaaatccagcccttcctggccctcggatttttcctgcggaagctcacatctagagagaacctgcttctgggcgtggggctcgccatggctaccacactgcaactgcctgaagacatcgagcagatggccaatggaattgctcttggcctgatggccctcaaactgatcacccagtttgaaacctatcagctctggacagcgctgatttcccttacgtgtagcaacaccatgttcacactgaccgtcgcctggcgcacagctaccctcatcctggccggcgtttccctgcttccggtgtgccaatctagctccatgcggaagacggattggctgcccatggctgtggccgccatgggggtccctcccctccctctgtttattttctctctcaaggacacactgaaaagacgcagctggccccttaatgagggagtgatggctgttggcctggtgtccatcctggcgtctagcctcctgagaaacgatgtccctatggccgggccccttgtggctggaggcctgctcatcgcctgttacgttattaccgggacctccgccgacctgacagtggagaaggctgccgacatcacctgggaagaggaagcggagcagacaggagtcagccataacctcatgattacggtggatgacgatggcaccatgcggatcaaagacgatgaaacagagaatattctgaccgtccttctgaagacagctctgctcatcgtgtctggcgtttttccgtattccatccctgccaccctgcttgtgtggcacacgtggcagaaacagacccaacgcagcggggtcctgtgggacgtgccctctcctcccgagacacagaaggccgaactcgaggaaggagtttacagaattaaacagcagggcatcttcgggaagacccaagtgggagtcggcgtgcagaaggagggggtgtttcacacaatgtggcatgttacccggggagctgtcctgacatacaacggcaaacgcctcgagccgaattgggcctccgtgaagaaagatctgattagctatggcgggggatggagactttctgcgcagtggcaaaagggcgaagaggtgcagatcattgctgtcgaacctgggaaaaaccccaagaatttccagacgatgcctggaaccttccagacaaccaccggcgagatcggggccattgccctggactttaagcccggaacatccggcagccccatcatcaaccgggaaggcaaagtggttgggctgtacggaaatggcgtggtcacgaagaacgggggatatgtgtccggcattgctcaaaccaatgccgagcctgatgggccgacacccgagctcgaagaggaaatgttcaaaaagcgcaacctgaccatcatggaccttcaccctggcagcggaaaaacaagaaagtacctgcccgctattgttcgggaggccatcaagcgcagactccggaccctgattctcgcgcctacgagagtggtcgccgctgaaatggaggaggccctgaaaggccttcccatccgctatcagacaaccgctaccaagtctgaacatacagggcgggagatcgtggatctgatgtgccacgccacctttacaatgagactgctcagccctgttcgcgtgccgaattacaacctgattatcatggacgaagcccatttcaccgatcccgcttccattgcggcccggggatatatctctacgagagtcggcatgggggaggctgccgccatttttatgacagctacccctcccggaacagccgacgcgttccctcagagcaatgctcccatccaggacgaggaacgcgatatcccggagcggtcctggaactctggcaatgaatggattaccgactttgccgggaaaacggtgtggttcgtgcctagcatcaaggccggcaacgatattgctaactgtcttcgcaaaaatggaaagaaggtcatccaactgtccagaaaaacctttgacacagagtaccagaagaccaaactcaacgattgggacttcgttgtgacaaccgatatttctgaaatgggcgccaattttaaggcggaccgggtgatcgatcccagacggtgcctgaaacccgtcattctgacagacgggcctgagcgcgtgatcctcgccggacccatgcctgttaccgctgccagcgctgcccagagacggggccgcgtggggagaaacccgcagaaggagaatgatcaatacatcttcacgggacagccccttaacaatgacgaagaccacgctcactggacagaggccaagatgctgctggataacattaatacccctgaaggcatcattcccgccctcttcgagcctgaacgggagaaatccgccgctatcgacggggagtatagactgaagggcgaaagccgcaaaacctttgtcgagcttatgcggagaggagatctgcccgtgtggctcgcccataaggttgcttctgaaggcattaaatacacagaccgcaagtggtgcttcgatgggcagcggaacaatcagatcctggaggaaaacatggacgtggagatctggaccaaagagggagaaaagaagaaactgagaccgcgctggctcgatgcccggacatattccgaccctcttgccctgaaggagtttaaagatttcgctgcgggcagaaagagcattgccctggacctcgtcacggaaatcgggcgcgtgccctctcacctggctcatagaacccggaatgcccttgataacctggtcatgctccacacatccgagcacggaggccgcgcctacagacatgctgtggaggaactgcctgagaccatggaaacactgctccttctgggcctgatgattctcctgaccgggggagccatgctttttctgatcagcggcaaagggattggaaagacgtccatcggcctcatctgtgttattgcgtctagcgggatgctgtggatggccgagatccccctgcaatggattgcttccgccatcgtgctcgagttctttatgatggtgcttctgattcctgagcccgagaagcagcggaccccgcaggacaatcaactggcttatgtcgttatcggcattctcacactggccgcgatcatcgccgctaacgaaatgggccttctggagaccacaaaacgcgatctcggcatgagcaaggaacctggggtggtgtctcccacctcctacctggacgtcgacctgcaccccgccagcgcttggacgctctatgccgtggctacaaccgttattacacctatgcttagacataccatcgaaaattctaccgccaacgtgagcctggcggccattgctaaccaggccgtcgtgctgatgggactcgataaaggctggccgatctccaagatggacctgggggtcccccttctggctctcggatgctactctcaggtgaatcctctgacactgacggccgccgttctccttctgattacccactacgcgatcatcggccccgggctgcaggctaaagccacacgggaagctcaaaagagaaccgccgccggaattatgaagaaccctacagtggatggcatcatgaccattgacctcgatcccgtcatctatgacagcaaattcgagaagcagctgggccaggtgatgcttctggttctctgtgctgtgcagctgctgctcatgcgcacgtcctgggccctttgcgaggcgctgacactggccaccgggcctattaccacactctgggaaggatctccgggcaaattttggaataccacaatcgctgtcagcatggccaacatcttccgggggtcctacctggctggagccggccttgcgtttagcattatgaagtctgtggggacgggaaaaagaggcaccggctcccaaggggagacactgggagaaaagtggaagaaaaagctcaatcagctgagccgcaaagagttcgatctgtataagaaatccggcatcaccgaagtggaccggacagaggccaaggaggggctcaaaagaggagaaaccacgcatcacgctgtttctcggggcagcgccaaacttcagtggtttgtcgagcgcaacatggtgattcccgaagggagagtgatcgatctgggatgtggccggggcgggtggtcctactattgcgctggactgaagaaagtcaccgaggttcgcggctacacaaaagggggacctggccacgaggaacccgtgcctatgtctacctatgggtggaatattgtgaaactcatgagcggaaaggacgtcttctacctgcccccggagaaatgtgatacacttctgtgcgacatcggcgaatccagcccttctcccaccgtggaggaatccagaacaattcgggttctcaagatggtggagccctggctgaagaacaatcagttctgtatcaaaatcctgaacccttacatgcccaccgtcattgagcatctcgaacgccttcaaagaaagcacggcgggatgctggtgcggaatcctctgagccgcaactctacgcatgagatgtattggatctccaatggaacaggcaacattgttgccagcgtgaatatggtctctagactcctgcttaaccggtttaccatgacccacagacgcccgacaatcgaaaaagatgtggacctgggggctggaacgcggcacgtgaacgccgagcccgaaacccctaatatggacgtcattggcgagagaatcaagcgcatcaaagaggaacataacagcacatggcactacgatgacgagaatccctataagacctgggcgtaccatgggtcctatgaagttaaggccacaggatctgctagctccatgattaacggcgtggtgaaactcctgaccaagccttgggatgtcgtgcccatggttacacagatggccatgaccgacacgaccccgttcggccagcaacgggtgtttaaagagaaggtcgatacaagaacccctcgcagcatgcccgggacacggagagtgatgggaatcaccgctgaatggctgtggcgcacgctcggccggaataaaaagcctagactgtgcacacgcgaggagttcaccaagaaagttcggacaaacgccgccatgggggcggtgtttaccgaagagaatcagtgggactccgctaaggccgccgtcgaagatgaggacttctggaaacttgtggatagagaacgcgagctgcacaagctcggaaaatgtggctcttgcgtttacaacatgatggggaagagagagaaaaagctgggcgaatttggaaaggctaaaggcagccgggccatttggtatatgtggcttggggctcgctacctggagttcgaagccctcggatttctgaatgaggaccattggttctccagagagaactcttacagcggcgtggaaggggagggactgcacaagctcggctatatcctgcgggatatttccaaaatccccgggggcgcgatgtacgccgacgacacggctggatgggataccagaatcacagaagacgatcttcacaatgaggaaaagattacccagcagatggaccctgagcatcggcaactggccaacgctatctttaaactcacatatcagaataaggtcgtgaaggtccagcgccccaccccgacaggcaccgtgatggatattatctctagaaaagaccagcgggggagcggacaagttggcacgtacgggctgaacacattcaccaatatggaggcccagcttattcgccagatggaaggagagggcgtgctgtccaaggcggatctcgaaaaccctcatctgcccgagaaaaagatcacccagtggctggaaacaaaaggggtcgagagactcaagcggatggccatcagcggcgacgattgcgtggtgaagcccattgacgatcgctttgctaacgccctgcttgctctgaatgacatgggaaaagttagaaaggatatccctcaatggcagccgtctaaaggctggcatgactggcaacaggtgcccttctgttcccaccacttccatgagctcattatgaaggacgggcggaaactggtcgtgccttgccgcccccaagatgaacttatcggacgggcccggattagccagggcgctgggtggtctctgcgcgagaccgcctgtctcggaaaggcgtatgcccagatgtggtccctgatgtactttcacagacgggacctgcgcctcgctagcaacgccatctgctctgccgttcctgtgcattgggtccccacatccagaacgacctggagcattcacgctcatcaccaatggatgacaaccgaagatatgctgacagtgtggaatcgggtctggatcgaggacaacccttggatggaagataagacccccgtgacgacctgggaggacgttccgtatcttggcaaaagagaggatcagtggtgtgggtccctgatcggcctcacaagccgcgccacctgggcgcagaatattcctacagctatccagcaagtgcggtctctgattggaaacgaagagttccttgactacatgcccagcatgaagagatttcgcaaagaagaggagtccgaaggcgccatctggtga

SEQ ID NO: 20416 - RNA, 9873 nt, synthetic construct
  misc_feature 1..9873: note = derived and/or modified CDS sequence (opt5) from DENV-3__FJ850092__SS-prME
  source 1..9873: mol_type = other RNA
accagcctgtgcctcatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggagatgtgcgacgatacagtcacctacaagtgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagcatgaaaatctcaagtatacagtcatcatcaccgtgcacacaggggaccagcatcaggttggaaacgagacgcaaggcgtgaccgctgaaattacacctcaggcctctaccacagaggtcatcctgcccgaatacggcaccctggggctcgagtgctcccctcgcacgggactggacttcaatgagatgattcttctgaccatgaaaaacaaggcttggatggtgcacagacagtggtttttcgatctccccctgccgtggacaagcggcgtcaccacagaaacccctacgtggaatcggaaagagcttctggtgacatttaagaacgcccacgccaaaaagcaagaagttgtggtcctcgggtctcaggagggagctatgcataccgcgctgacaggcgccaccgaaatccaaaattccgggggcaccagcattttcgctggacacctgaagtgtcgcctcaaaatggacaagctggagcttaaaggcatgtcttatgccatgtgcacaaacacgtttgtgctgaagaaagaggtttccgaaacccagcatgggacaatcctcatcaaggtggagtacaagggagaagatgccccctgtaaaattcctttcagcaccgaggacggccaagggaaggctcacaacggaagactgatcacagccaatcccgtcgtgaccaaaaaggatgagcccgtgaacattgaagcggagcctccgttcggcgaatccaatatcgttattgggatcggcgacaacgctctgaaaatcaattggtacaagaagggatctagcattggcaaaatgtttgaggccacggccagaggggctagacgcatggccatccttggagatacagcttgggacttcggctccgtcgggggagtgctcaacagcctgggcaagatggtgcatcagatttttgggtctgcctataccgcgctgttctccggcgtcagctgggtgatgaaagttggaatcggcgtgctcctgacctggattgggcttaattctaagaacacaagcatgtccttttcttgcatcgccattggaatcatcaccctgtacctcggcgctgtcgtgcaggccgatatggggtgtgttattaattggaaaggaaaggaactgaagtgcggcagcgggatcttcgtgacaaacgaggtccacacgtggaccgagcagtataaatttcaagctgactcccccaagcggctggccacagcgattgccggcgcttgggaaaatggagtgtgtggcatcagaagcaccacacgcatggagaaccttctctggaaacagattgccaatgaactgaactacatcctgtgggagaataacatcaagctcaccgttgtggtcggggatattatcggagtgctggaacagggcaaacggacgcttacccctcagcccatggagctgaagtattcttggaaaacatgggggaaggctaagattgtgaccgccgagacacaaaactccagcttcatcattgacggacctaatacccccgaatgcccgtctgcctccagagcttggaacgtctgggaggttgaagactacggctttggcgtgttcacaaccaatatctggctcaaactgcgcgaggtgtatacgcagctgtgtgatcaccggcttatgagcgcggccgtcaaggacgaaagagctgtgcatgccgatatggggtactggatcgagtcccagaaaaacggatcttggaagctcgagaaagccagcctgattgaagttaagacatgcacctggcctaagtcccacaccctgtggtctaatggcgtgctcgagagcgacatgatcattcccaaatccctggctgggcctatcagccagcataaccaccgccccggataccacacacaaaccgccggcccttggcatcttgggaagctggaactcgattttaattattgcgagggaacgacagtcgtgattaccgagaactgtggcacacggggcccctctctgagaaccacaaccgtttccgggaaactgatccacgaatggtgctgtcgcagctgcacgcttccgcctctccggtacatgggagaggacggctgttggtatgggatggaaatcagacccatttctgagaaggaagagaatatggtgaaatccctggtcagcgcgggatctggcaaggtggataacttcaccatgggggttctgtgcctcgctatcctgtttgaggaagtgatgcggggaaagttcggcaaaaagcatatgattgccggcgtcttctttacattcgtgcttctgctcagcgggcagatcacctggcgcgacatggcccacacactgattatgatcggatccaatgctagcgatagaatgggcatgggggtgacctacctggcccttattgcgacgtttaaaatccagcccttcctggctctcggatttttcctgcggaagctcacatctagagagaacctgcttctgggcgtcgggctcgccatggccaccacactgcaactgcctgaagacatcgagcagatggctaatggaattgcccttggcctgatggctctcaaactgatcacccagtttgaaacctatcagctctggacagccctgatttcccttacgtgtagcaacaccatgttcacactgaccgttgcgtggcgcacagccaccctcatcctggctggcgtgtccctgcttccggtgtgccaatctagctccatgcggaagacggattggctgcccatggccgtcgctgccatgggggtgcctcccctccctctgtttattttctctctcaaggacacactgaaaagacgcagctggccccttaatgagggagttatggccgtgggcctggtctccatcctggcttctagcctcctgagaaacgatgtgcctatggcggggccccttgttgccggaggcctgctcatcgcttgttacgtgattaccgggacctccgccgacctgatcgtcgagaaggccgctgacattacatgggaagaggaagccgagcagaccggagtgagccataacctcatgatcacagtcgatgacgatggcacgatgcggattaaagacgatgaaaccgagaatatcctgacagtgcttctgaagaccgcgctgctcatcgtttctggcgtgtttccgtattccattcctgctacactgcttgtctggcacacctggcagaaacagacgcaacgcagcggggtgctgtgggacgttccctctcctcccgagacccagaaggccgaactcgaggaaggagtgtacagaatcaaacagcagggcattttcgggaagacacaagtcggagtgggcgtgcagaaggagggggtttttcacaccatgtggcatgtcacacggggagccgtgctgacctacaacggcaaacgcctcgagccgaattgggcttccgtgaagaaagatctgatcagctatggcgggggatggagactttctgcccagtggcaaaagggcgaagaggtccaggtgattgcggttgaacctgggaaaaaccccaagaatttccagacaatgcctggaacgttccagaccacaaccggcgagatcggggctattgccctggactttaagcccggaacctccggcagccccatcatcaaccgggaaggcaaagtggtcgggctgtacggaaatggcgtggttacaaagaacgggggatatgtgtccggcattgcccaaacgaatgctgagcctgatgggccgacccccgagctcgaagaggaaatgttcaaaaagcgcaacctgacaatcatggaccttcaccctggcagcggaaaaaccagaaagtacctgcccgccattgtccgggaggctatcaagcgcagactccggacactgattctcgcccctaccagagtggttgcggccgaaatggaggaggctctgaaaggccttcccatccgctatcagacgacagccaccaagtctgaacataccgggcgggagatcgtggatctgatgtgccacgctacatttaccatgagactgctcagccctgtccgcgtgccgaattacaacctgattatcatggacgaagcccatttcacagatcccgcctccattgctgcgcggggatatatctctaccagagtgggcatgggggaggccgctgccatttttatgacggccacacctcccggaaccgctgacgccttccctcagagcaatgcgcccatccaggacgaggaacgcgatatcccggagcggtcctggaactctggcaatgaatggattacagactttgctgggaaaaccgtctggttcgttcctagcatcaaggccggcaacgatattgccaactgtcttcgcaaaaatggaaagaaggtgatccaactgtccagaaaaacgtttgacaccgagtaccagaagacaaaactcaacgattgggacttcgtggtcaccacagatatttctgaaatgggcgctaattttaaggccgaccgggtgatcgatcccagacggtgcctgaaacccgttattctgaccgacgggcctgagcgcgtgatcctcgcgggacccatgcctgtcacagccgctagcgccgctcagagacggggccgcgtggggagaaacccgcagaaggagaatgatcaatacatcttcaccggacagccccttaacaatgacgaagaccacgcccactggacggaggctaagatgctgctggataacattaatacacctgaaggcatcattcccgccctcttcgagcctgaacgggagaaatccgcggccatcgacggggagtatagactgaagggcgaaagccgcaaaacctttgttgagcttatgcggagaggagatctgcccgtgtggctcgctcataaggtcgcctctgaaggcattaaatacaccgaccgcaagtggtgcttcgatgggcagcggaacaatcagatcctggaggaaaacatggacgtggagatctggacaaaagagggagaaaagaagaaactgagaccgcgctggctcgatgctcggacctattccgaccctcttgccctgaaggagtttaaagatttcgccgctggcagaaagagcattgcgctggacctcgtcacagaaatcgggcgcgtgccctctcacctggcccatagaacgcggaatgctcttgataacctggttatgctccacacctccgagcacggaggccgcgcctacagacatgccgtggaggaactgcctgagacaatggaaaccctgctccttctgggcctgatgattctcctgacagggggagctatgctttttctgatcagcggcaaagggattggaaagacctccatcggcctcatctgtgtgattgcctctagcgggatgctgtggatggcggagatccccctgcaatggattgcctccgctatcgtcctcgagttctttatgatggttcttctgattcctgagcccgagaagcagcggacgccgcaggacaatcaactggcctatgtggtgatcggcattctcaccctggctgccatcatcgcggccaacgaaatgggccttctggagacaaccaaacgcgatctcggcatgagcaaggaacctggggtcgtgtctcccacatcctacctggacgttgacctgcaccccgctagcgcctggaccctctatgctgtggccacgacagtcattacccctatgcttagacatacaatcgaaaattctaccgctaacgtgagcctggccgcgattgccaaccaggctgtcgtgctgatgggactcgataaaggctggccgatctccaagatggacctgggggttccccttctggccctcggatgctactctcaggtgaatcctctgaccctgacagctgccgtcctccttctgattacgcactacgccatcatcggccccgggctgcaggcgaaagctacccgggaagcccaaaagagaacagctgccggaattatgaagaaccctaccgtggatggcatcatgacaattgacctcgatcccgttatctatgacagcaaattcgagaagcagctgggccaggtgatgcttctggtcctctgtgccgtgcagctgctgctcatgcgcacctcctgggctctttgcgaggccctgacgctggcgacagggcctattaccaccctctgggaaggatctccgggcaaattttggaatacaaccatcgccgtgagcatggctaacatcttccgggggtcctacctggccggagctggccttgcctttagcattatgaagtctgttgggacaggaaaaagaggcacgggctcccaaggggagaccctgggagaaaagtggaagaaaaagctcaatcagctgagccgcaaagagttcgatctgtataagaaatccggcatcacagaagtcgaccggaccgaggcgaaggaggggctcaaaagaggagaaacaacccatcacgccgtgtctcggggcagcgctaaacttcagtggtttgtggagcgcaacatggtcattcccgaagggagagttatcgatctgggatgtggccggggcgggtggtcctactattgcgccggactgaagaaagtgacggaggtgcgcggctacaccaaagggggacctggccacgaggaacccgtccctatgtctacatatgggtggaatattgtgaaactcatgagcggaaaggacgttttctacctgcccccggagaaatgtgatacccttctgtgcgacatcggcgaatccagcccttctcccacagtggaggaatccagaaccattcgggtcctcaagatggtggagccctggctgaagaacaatcagttctgtatcaaaatcctgaacccttacatgcccacagttattgagcatctcgaacgccttcaaagaaagcacggcgggatgctggtgcggaatcctctgagccgcaactctacccatgagatgtattggatctccaatggaacgggcaacattgtcgctagcgtgaatatggtgtctagactcctgcttaaccggtttacaatgacccacagacgcccgaccatcgaaaaagatgtcgacctgggggccggaacacggcacgttaacgctgagcccgaaacgcctaatatggacgtgattggcgagagaatcaagcgcatcaaagaggaacataacagcacctggcactacgatgacgagaatccctataagacatgggcctaccatgggtcctatgaagtgaaggcgaccggatctgccagctccatgattaacggcgtcgtgaaactcctgacaaagccttgggatgttgtgcccatggtcacccagatggctatgacagacaccacgccgttcggccagcaacgggtgtttaaagagaaggttgataccagaacacctcgcagcatgcccgggacccggagagtgatgggaatcacagccgaatggctgtggcgcaccctcggccggaataaaaagcctagactgtgcacgcgcgaggagttcacaaagaaagtccggaccaacgctgccatgggggccgtgtttacagaagagaatcagtgggactccgcgaaggctgccgttgaagatgaggacttctggaaacttgtggatagagaacgcgagctgcacaagctcggaaaatgtggctcttgcgtctacaacatgatggggaagagagagaaaaagctgggcgaatttggaaaggccaaaggcagccgggctatttggtatatgtggcttggggcccgctacctggagttcgaagctctcggatttctgaatgaggaccattggttctccagagagaactcttacagcggcgtggaaggggagggactgcacaagctcggctatatcctgcgggatatttccaaaatccccgggggcgccatgtacgcggacgacaccgccggatgggatacgagaatcaccgaagacgatcttcacaatgaggaaaagattacacagcagatggaccctgagcatcggcaactggctaacgccatctttaaactcacctatcagaataaggtcgtgaaggttcagcgccccacaccgaccggcacagtgatggatattatctctagaaaagaccagcgggggagcggacaagtcggcacctacgggctgaacacgttcacaaatatggaggctcagcttattcgccagatggaaggagagggcgtgctgtccaaggccgatctcgaaaaccctcatctgcccgagaaaaagatcacccagtggctggaaaccaaaggggtggagagactcaagcggatggcgatcagcggcgacgattgcgttgtgaagcccattgacgatcgctttgccaacgctctgcttgccctgaatgacatgggaaaagtcagaaaggatatccctcaatggcagccgtctaaaggctggcatgactggcaacaggtgcccttctgttcccaccacttccatgagctcattatgaaggacgggcggaaactggttgtgccttgccgcccccaagatgaacttatcggacgggctcggattagccagggcgccgggtggtctctgcgcgagacagcttgtctcggaaaggcctatgcgcagatgtggtccctgatgtactttcacagacgggacctgcgcctcgccagcaacgctatctgctctgccgtccctgtgcattgggtccccacctccagaacaacgtggagcattcacgcccatcaccaatggatgaccacagaagatatgctgaccgtgtggaatcgggtttggatcgaggacaacccttggatggaagataagacacccgtgaccacgtgggaggacgtcccgtatcttggcaaaagagaggatcagtggtgtgggtccctgatcggcctcaccagccgcgctacatgggcccagaatattcctaccgcgatccagcaagtgcggtctctgattggaaacgaagagttccttgactacatgcccagcatgaagagatttcgcaaagaagaggagtccgaaggcgctatctggtga

SEQ ID NO: 20417 - RNA, 9873 nt, synthetic construct
  misc_feature 1..9873: note = derived and/or modified CDS sequence (opt5) from DENV-3__FJ850094__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagggacccctacgtggaatcggaaagaacttctggtgacatttaagaacgctcacgcgaaaaagcaagaggtcgtggttctcggatctcaggaaggcgccatgcacaccgctctgacaggggccaccgagatccagaattccggcggaaccagcattttcgccggccatctgaagtgtcgcctcaaaatggacaagctggaacttaaagggatgtcttacgctatgtgcacaaacacgtttgtgctgaagaaagaggtctccgagacccagcacggaacaatcctcatcaaggtggaatacaagggcgaggatgccccctgtaaaattcctttcagcaccgaagacgggcaaggaaaggcgcataacggcagactgatcacagctaatcccgttgtgaccaaaaaggatgagcccgtcaacattgaggccgaacctccgttcggggagtccaatatcgtgattggcatcggagacaacgccctgaaaatcaattggtataagaagggctctagcattgggaaaatgtttgaagctacggcccggggagctagacgcatggccatccttggcgatacagcgtgggacttcgggtccgtgggaggcgttctcaacagcctggggaagatggtccaccagatttttggctctgcctacaccgctctgttctccggagtgagctgggtgatgaaaatcggcattggggtcctcctgacctggatcggacttaattctaagaacacaagcatgtccttttcttgcattgccatcggcatcattaccctgtatctcggggctgtggttcaggccgatatgggatgtgtggtcaattggaaaggcaaggagctgaagtgcgggagcggcatcttcgtgacaaacgaagttcatacgtggaccgagcagtacaaatttcaagcggactcccccaagcggctggccacagctattgccggagcttgggagaatggcgtgtgtgggatcagaagcaccacacgcatggaaaaccttctctggaaacagattgccaatgagctgaactatatcctgtgggaaaataacatcaagctcaccgtcgtggttggagatacgattggcgtgctggagcaggggaaacggacccttacacctcagcccatggaactgaagtactcttggaaaacctggggaaaggccaagatcgtcacagctgagacccaaaactccagcttcattatcgacggccctaatacacccgagtgcccgtctgcgtccagagcctggaacgtgtgggaagtggaggactatggctttggggtcttcaccacgaatatttggctcaaactgcgcgaagtttacacacagctgtgtgatcaccggcttatgagcgctgccgtgaaggacgagagagccgtgcacgctgatatgggatactggatcgaatcccagaaaaacggctcttggaagctcgagaaagccagcctgatcgaggtcaagacctgcacctggcctaagtcccatacactgtggtctaatggggtgctcgaaagcgacatgattatccccaaatccctggcgggacctattagccagcacaactatcgccccggctaccatacccaaacggctgggccttggcaccttggaaagctggagctcgattttaattattgcgaaggcacaaccgttgtgatcacagagaactgtggcacccgggggccctctctgagaacaaccacggtctccggaaaactgattcacgagtggtgctgtcgcagctgcacccttccgcctctccggtacatgggcgaagacgggtgttggtatggaatggagatcagacccatctctgaaaaggaggaaaatatggtgaaatccctggttagcgccggctctgggaaggtggataacttcacaatgggagtcctgtgcctcgccattctgtttgaggaggtgatgcggggcaagttcggcaaaaagcatatgatcgctggggttttctttaccttcgtgcttctgctcagcggacagattacatggcgcgacatggcccacaccctgatcatgattggctccaatgcgagcgatagaatggggatgggagtcacgtacctggctcttatcgccacatttaaaattcagcccttcctggccctcggctttttcctgcggaagctcacctctagagaaaacctgcttctgggggtgggactcgctatggccacaaccctgcaactgcctgaggacatcgaacagatggctaatggcatcgcccttggcctgatggcgctcaaactgattacccagtttgagacatatcagctctggacggccctgatctcccttacctgtagcaacacaatgttcaccctgacagtggcttggcgcaccgccacgctcattctggctggggtctccctgcttccggtttgccaatctagctccatgcggaagacagattggctgcccatggccgtggccgctatgggagtgcctcccctccctctgtttatcttctctctcaaggacacctttaaaagacgcagctggcccctgaatgaaggcgtcatggcggtggggcttgtttccattctggcctctagcctgctcagaaacgatgtgcctatggctggacccctggtcgccggcgggcttctgatcgcctgttacgtgatcaccggaacatccgctgacctcaccgttgagaaggccgcggacattacatgggaggaagaggctgaacagacgggcgtgagccataacctgatgatcaccgtcgatgacgatggcacaatgcggattaaagacgatgagaccgaaaatatcctcacagtgctgcttaagaccgccctgctgattgtctctggggtgttcccgtactccatccctgccacgctcctggtttggcacacctggcagaaacagacacaacgcagcggagtgctttgggacgtcccctctcctcccgagacccagaaggctgagctggaagagggcgtgtatagaatcaaacagcaggggatttttggaaagacacaagttggcgtgggggtccagaaggaaggagtgttccataccatgtggcacgtgacacggggcgccgttctcacgtacaacggcaaacgcctggagccgaattgggcgtccgtcaagaaagatctcatcagctatgggggaggctggagactgtctgctcagtggcaaaagggggaggaagtgcaggtgattgccgtcgagcctggaaaaaaccccaagaatttccagaccatgcctggcacatttcagaccaccacaggggaaatcggagccattgctcttgacttcaagcccggcacgtccggcagccccatcattaaccgggaggggaaagtggttggactgtacggcaatggggtggtcaccaagaacggaggctatgtgtccgggatcgcccaaacaaatgctgaacctgatggcccgacccccgagctggaggaagagatgtttaaaaagcgcaacctcacaatcatggacctgcaccctggaagcggcaaaaccagaaagtaccttcccgccattgttcgggaagcgatcaagcgcagactgcggacgctcattctggcccctacaagagtggtcgctgccgagatggaagaggctctcaaagggctgcccatccgctatcagaccaccgccacaaagtctgagcataccggacgggaaattgtggatcttatgtgccacgccacattcaccatgagactgctgagccctgttcgcgtgccgaattacaacctcatcatcatggacgaggctcattttacggatcccgcgtccattgccgctcggggctacatctctacaagagtcgggatgggagaagccgccgctattttcatgaccgccacacctcccggcaccgcggacgcttttcctcagagcaatgcccccatccaggacgaggaacgcgatattccggagcggtcctggaactctgggaatgagtggatcacggacttcgccggcaaaaccgtgtggtttgtgcctagcatcaaggctggaaacggcattgccaactgtctgagaaaaaatgggaagaaggtcatccaactttcccgcaaaacattcgataccgaatatcagaagacaaaactgaacgactgggattttgttgtgaccacagacatttctgagatgggagcgaatttcaaggccgatcgggtgatcgaccccagacggtgcctcaaacccgtcattctgaccgatggccctgaacgcgtgatcctggctgggcccatgcctgttacggccgctagcgccgctcagagacggggacgcgtgggcagaaacccgcagaaggagaatgaccaatacattttcacagggcagcccctcaacaatgatgaggaccacgcccattggaccgaagcgaagatgcttctggacaacatcaatacccctgagggcatcattcccgccctgtttgaacctgagcgggaaaaatccgctgccatcgatggagagtatagactcaagggcgagagccgcaaaacattcgtcgaactgatgcggagaggggaccttcccgtgtggctggctcacaaggttgcctctgagggaattaaatacaccgatcgcaagtggtgctttgacggccagcggaacaatcagatcctcgaagagaacatggatgtggaaatttggacaaaagagggggagaagaagaaactgagaccgcgctggctggacgcccggacgtattccgatcctctcgctcttaaggaattcaaagactttgcggccggaagaaagagcatcgctctggatctggtcaccgagatcggccgcgtgccctctcacctcgcccatagaacacggaatgccctggacaaccttgtcatgctgcacacctccgaacatggcgggcgcgcttacagacacgccgtggaggaactccctgagacaatggagaccctgctgctccttggactgatgattctgctcacgggcggggcgatgctgttccttatcagcggaaaaggcattgggaagacctccatcggactgatttgtgttatcgcctctagcggcatgctctggatggctgaaatccccctgcaatggattgcctccgctatcgtgctggagtttttcatgatggtgctccttattcctgaacccgagaagcagcggacaccgcaggataatcaactggcctatgtcgttatcggcattctgaccctcgcggccatcattgctgccaacgagatggggctgcttgaaacaaccaaacgcgacctgggaatgagcaaggagcctggcgtggtgtctcccacgtcctacctcgatgtcgacctgcaccccgctagcgcctggacactgtacgctgtggccaccacagttatcacccctatgctcagacataccatcgaaaattctacagcgaacgtgagccttgccgctattgccaaccaggctgtcgtgctgatggggctggacaaaggatggccgatctccaagatggatctcggcgtccccctgcttgccctggggtgctattctcaggtgaatcctctcacgctgaccgccgcggttctgctccttattacacactacgctatcattggacccggcctgcaggccaaagctacccgggaggcccaaaagagaacagccgctggcatcatgaagaaccctaccgtggacgggatcatgacgattgatctggaccccgtcatctatgatagcaaatttgaaaagcagctcggacaggtgatgctgcttgttctgtgtgccgtgcagctcctgctgatgcgcacatcctgggcgctctgcgaggcccttaccctggctaccggccctattacaaccctgtgggaggggtctccgggaaaattctggaatacaacgatcgccgtcagcatggctaacatttttcggggctcctacctcgccggggcgggactggccttcagcatcatgaagtctgtgggcaccggcaaaagagggacaggatcccaaggcgaaacccttggggagaagtggaagaaaaagctgaatcagctcagccgcaaagaatttgacctgtataagaaatccggaatcacagaggtggatcggaccgaagctaaggagggcctgaaaagaggggagacgacccatcacgccgtttctcggggaagcgctaagctccagtggttcgtcgaacgcaacatggtgattcccgagggcagagtgatcgaccttggctgtgggcggggaggctggtcctactattgcgccgggctgaagaaagtcacagaagttcgcggatacaccaagggcgggcctggacatgaggaacccgtgcctatgtctacatacggctggaatattgtgaaactgatgagcggcaaggatgtcttctatctccccccggagaaatgtgacaccctgctttgcgatatcggggagtccagcccttctcccacagtggaagagtccagaaccattcgggttctgaagatggtggaaccctggctcaagaacaatcagttttgtatcaaaattctgaacccttacatgcccacggtcatcgagcacctggagcgcctccaaagaaagcacggaggcatgcttgtgcggaatcctctgagccgcaactctacacatgaaatgtattggatctccaatgggaccggaaacattgttgctagcgtgaatatggtctctagactgctcctgaaccggttcaccatgacacacagacgcccgacgatcgagaaagacgtggatcttggcgccgggacccggcatgtgaacgcggaacccgagacacctaatatggacgtcattggagaaagaatcaagcgcattaaagaggagcacaacagcacctggcactacgacgatgaaaatccctataagacatgggcctaccatggctcctatgaggttaaggctaccggctctgccagctccatgatcaacggggtggtgaaactgctcacaaagccttgggacgtcgtgcccatggttacccagatggctatgacggataccacaccgtttggacagcaacgggtgttcaaagaaaaggtcgacaccagaacacctcgcagcatgcccggcacccggagagtgatggggatcacggccgagtggctgtggcgcacactgggacggaataaaaagcctagactctgcacccgcgaagagtttacaaagaaagttcggaccaacgccgcgatgggcgctgtgttcacggaggaaaatcagtgggattccgccaaggccgctgtcgaggacgaagatttttggaaactggtggacagagagcgcgaacttcacaagctggggaaatgtggctcttgcgtttacaacatgatgggaaagagagagaaaaagctcggcgagttcgggaaggccaaaggaagccgggctatttggtacatgtggctgggcgcccgctatcttgaatttgaggcgctggggttcctcaatgaagatcattggttttccagagagaactcttacagcggagtggagggcgaagggctgcacaagctgggctatatcctccgggacatttccaaaatccccggaggcgccatgtacgctgatgacaccgccgggtgggacacaagaattaccgaggatgacctgcataatgaagagaagatcacacagcagatggatcctgaacaccggcaacttgctaacgccatcttcaaactgacctatcagaataaggtcgtgaaggtccagcgccccacaccgaccggaacggtgatggacattatctctagaaaagatcagcggggcagcgggcaagttggaacatacggcctcaacacctttaccaatatggaggcgcagctgattcgccagatggagggggaaggcgtgctttccaaggccgacctggagaaccctcacctccccgaaaaaaagatcacacagtggctggagaccaaaggagtcgaaagactgaagcggatggctattagcggcgatgactgcgtggtgaagcccatcgatgaccgcttcgccaacgctctcctggcccttaatgatatggggaaagttagaaaggacatccctcaatggcagccgtctaaaggatggcatgattggcagcaggtgcccttctgttcccaccattttcacgagctgattatgaaggacggccggaaactcgtcgtgccttgccgcccccaagacgagctgatcgggagagctcggattagccagggagccggctggtctcttcgcgaaacagcgtgtctggggaaggcctatgctcagatgtggtccctcatgtacttccacagacgggatctgcgcctggccagcaacgccatctgctctgctgttcctgtgcattgggtccccacgtccagaaccacatggagcattcacgcccatcaccaatggatgaccacagaggacatgctcaccgtgtggaatcgggtctggatcgaagataacccttggatggaggacaagacgcccgtgaccacatgggaagatgttccgtacctgggcaaaagagaggaccagtggtgtggatcccttattggcctgaccagccgcgcgacatgggctcagaatatccctaccgccatccagcaagtgcggtctctcattgggaacgaggaatttctggattatatgcccagcatgaagagattccgcaaagaggaagagtccgagggagccatctggtga

SEQ ID NO: 20418 - RNA, 9873 nt, synthetic construct
  misc_feature 1..9873: note = derived and/or modified CDS sequence (opt5) from DENV-3__FJ898446__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtacaagggagaagatgccccctgtaaaattcctttcagcaccgaggacggccaagggaaggcgcacaacggacggctgatcacagctaatcccgttgtgaccaaaaaggaggaacccgtcaacattgaggccgaacctccgttcggcgagtccaatatcgtgattgggacgggcgataacgccctgaaaatcaattggtataagaagggatctagcatcggcaaaatgtttgaaacaaccgctagaggggcccgccggatggctattcttggagacaccgcctgggatttcggctccgtggggggagttctcaacagcctgggcaagatggtccatcagatctttgggtctgcgtacacagccctgttctccggcgtgagctgggtgatgaaaattggaatcggcgtcctcctgacctggattgggcttaattctaagaacacaagcatgtccttttcttgcatcgctattggaatcatcacgctgtatctcggcgccgtggttcaggctgacatggggtgtgtgattaattggaaaggaaaggagctgaagtgcggcagcgggatcttcgtcaccaacgaggtgcacacatggaccgaacagtacaaatttcaagccgattcccccaagagactggcgacagccattgctggcgcctgggagaatggagtttgtggcatccgcagcaccacgcggatggaaaaccttctctggaaacagattgctaatgagctgaactatatcctgtgggaaaataacatcaagctcaccgtggtcgtgggggacattatcggagttctggagcagggcaaaagaacacttacccctcagcccatggagctgaagtactcttggaaaacatgggggaaggccaagattgtgaccgccgaaacacaaaactccagcttcatcattgatggacctaatacccccgagtgcccgtctgcttcccgcgcgtggaacgtctgggaagtggaggactatggctttggcgtgttcacgacaaatatctggctcaaactgcgggaagtctacacccagctgtgtgaccatagacttatgagcgccgctgttaaggatgagcgcgccgtgcacgccgacatggggtactggatcgagtcccagaaaaacggatcttggaagctcgaaaaagctagcctgattgaggtgaagacctgcacatggcctaagtcccacaccctgtggtctaatggcgtcctcgaaagcgatatgatcattcccaaatccctggccgggcctatcagccagcataaccaccggcccggatatcatacgcaaacagcgggcccttggcaccttgggaagctggagctcgactttaattactgcgagggaaccacagtggttattaccgaaaactgtggcacaagaggcccctctctgcgcaccacgaccgtgtccgggaaactgatccacgagtggtgctgtcggagctgcacacttccgcctctcagatatatgggagaagatggctgttggtacgggatggagatccggcccatttctgaaaaggaggagaatatggtcaaatccctggtgagcgctggatctggcaaggttgacaacttcaccatgggggtgctgtgcctcgccatcctgtttgaagaggtcatgcgcggaaagttcggcaaaaagcatatgattgccggcgtgttctttacattcgttcttctgctcagcgggcagatcacctggagagatatggctcacacgctgattatgatcggatccaatgccagcgaccggatgggcatgggggtgacatatctggcgcttattgctacctttaaaatccagcccttcctggccctcggatttttcctgagaaagctcacatctcgcgaaaacctgcttctgggcgtcgggctcgccatggctaccaccctgcaactgcctgaggatatcgaacagatggccaatggaattgctcttggcctgatggccctcaaactgatcacacagtttgagacgtaccagctctggaccgcgctgatttcccttacatgtagcaacaccatgttcacactgaccgtggcctggcggacggctacactcatcctggccggcgtgtccctgcttccggtctgccaatctagctccatgagaaagaccgactggctgcccatggctgttgccgccatgggggtgcctcccctccctctgtttattttctctctcaaggataccctgaaacgcagaagctggccccttaatgagggagtgatggctgtcggcctggtgtccatcctggcgtctagcctcctgcggaacgacgttcctatggccgggccccttgtggctggaggcctgctcatcgcctgttatgtcattacagggacctccgccgatctgacagtggaaaaggctgccgacatcacgtgggaggaagaggcggaacagaccggagttagccataacctcatgattacagtggacgatgacggcaccatgcgcatcaaagatgacgagacagagaatattctgaccgtccttctgaagacggctctgctcatcgtgtctggcgtctttccgtactccatccctgccaccctgcttgtgtggcacacatggcagaaacagacccaaagaagcggggttctgtgggatgtgccctctcctcccgaaacacagaaggccgagctcgaagagggagtctaccggattaaacagcagggcatcttcgggaagacccaagtgggagttggcgtgcagaaggagggggtctttcatacaatgtggcacgtgacgcgcggagctgtgctgacctataacggcaaaagactcgaaccgaattgggcctccgttaagaaagacctgattagctacggcgggggatggcggctttctgcgcagtggcaaaagggcgaggaagtccaggtgatcgctgtggagcctgggaaaaaccccaagaatttccagacaatgcctggaaccttccagaccacaacgggcgaaattggggccatcgccctggattttaagcccggaacctccggcagccccattatcaaccgcgagggcaaagtcgtggggctgtatggaaatggcgttgtgacaaagaacgggggatacgtctccggcatcgctcaaaccaatgccgagcctgacgggccgacacccgaactcgaggaagagatgttcaaaaagagaaacctgaccattatggatcttcaccctggcagcggaaaaacgcggaagtatctgcccgctatcgtgcgcgaagccattaagagacggctcagaacactgatcctcgcgcctacccgcgttgtggccgctgagatggaggaagccctgaaaggccttcccattcggtaccagaccacagctaccaagtctgagcatacagggagagaaatcgtcgacctgatgtgccacgccacctttacgatgcgcctgctcagccctgtgcgggttccgaattataacctgatcattatggatgaggcccatttcacagaccccgcttccatcgcggccagaggatacatttctacccgcgtgggcatgggggaagctgccgccatctttatgacagctacccctcccggaacggccgatgcgttccctcagagcaatgctcccattcaggacgaggagcgggacatcccggaaagatcctggaactctggcaatgagtggatcaccgattttgccgggaaaacagtctggttcgtgcctagcattaaggccggcaacgacatcgctaactgtcttcgcaaaaatggaaagaaggtgattcaactgtcccggaaaacctttgatacagaataccagaagaccaaactcaacgactgggatttcgtcgttacaaccgacatctctgagatgggcgccaattttaaggcggatagagtgattgacccccggcgctgcctgaaacccgtgatcctgacggatgggcctgagagagtcattctcgccggacccatgcctgtgacagctgccagcgctgcccagcggcgcggcagagttgggcggaacccgcagaaggaaaatgaccaatatatcttcaccggacagccccttaacaatgatgaggaccacgctcattggaccgaagccaagatgctgctggacaacatcaatacacctgagggcattatccccgcgctcttcgaacctgagagagagaaatccgccgctattgatggggaataccgcctgaagggcgagagccggaaaacctttgtggaacttatgagacgcggagacctgcccgtctggctcgcccacaaggtggcttctgagggcatcaaatatacagatcggaagtggtgcttcgacgggcagagaaacaatcagattctggaagagaacatggatgttgagatctggacgaaagaaggagagaagaagaaactgcgcccgcggtggctcgacgccagaacctactccgatcctcttgccctgaaggaatttaaagacttcgctgcgggccgcaagagcatcgccctggatctcgtgacagagattgggagagtcccctctcacctggctcatcggacccgcaatgcccttgacaacctggtgatgctccacacatccgaacatggaggcagagcctatcggcacgctgtcgaggagctgcctgaaaccatggagacgctgctccttctgggcctgatgatcctcctgaccgggggagccatgctttttctgattagcggcaaagggatcggaaagacatccattggcctcatctgtgtgatcgcgtctagcgggatgctgtggatggccgaaattcccctgcaatggatcgcttccgccattgttctcgagttctttatgatggtgcttctgatccctgagcccgaaaagcagcgcaccccgcaggataatcaactggcttacgtggtcattggaatcctcacactggccgcgattatcgccgctaacgagatgggccttctggaaaccacgaaaagagacctcggcatgagcaaggagcctggggttgtgtctcccacatcctatctggatgtggacctgcaccccgccagcgcttggaccctctacgccgtcgctacaaccgtgatcacccctatgcttcggcatacaattgaaaattctacggccaacgttagcctggcggccatcgctaaccaggccgtggtcctgatgggactcgacaaaggctggccgatttccaagatggatctgggggtgccccttctggctctcggatgctactctcaggtcaatcctctgaccctgacagccgccgtgctccttctgatcacccactatgcgattatcggccccgggctgcaggctaaagccacaagagaggctcaaaagcgcaccgccgccggaatcatgaagaaccctacggttgacggcattatgacaatcgatctcgaccccgtgatttacgatagcaaattcgagaagcagctgggccaggtcatgcttctggtgctctgtgctgttcagctgctgctcatgcggacctcctgggccctttgcgaagcgctgaccctggccacagggcctatcaccacactctgggagggatctccgggcaaattttggaatacgaccattgctgtgagcatggccaacatcttcagagggtcctatctggctggagccggccttgcgtttagcatcatgaagtctgtcgggacaggaaaacgcggcaccggctcccaaggggaaacactgggagagaagtggaagaaaaagctcaatcagctgagccggaaagaattcgacctgtacaagaaatccggcattaccgaggtggatagaacggaggccaaggaagggctcaaacggggagagatcacccatcacgctgtgtctcgcggcagcgccaagcttcagtggtttgttgaaagaaacatggtcattcccgaggggcgggtgatcgacctgggatgtggccgcggcgggtggtcctattactgcgctggactgaagaaagtgacagaagtcagaggctataccaaggggggacctggccatgaggagcccgttcctatgtctacatacgggtggaatattgtgaaactcatgagcggaaaggatgtgttctacctgcccccggaaaaatgtgacacccttctgtgcgatatcggcgagtccagcccttctcccacagtcgaagagtcccggaccattcgcgtgctcaagatggttgagccctggctgaagaacaatcagttctgtatcaaagtgctgaacccttatatgcccacggtcatcgaacacctcgagagacttcaacggaagcacggcgggatgctggtgcgcaatcctctgagcagaaactctacacatgaaatgtactggatttccaatggaaccggcaacatcgttgccagcgtgaatatggtctctcggctcctgcttaacagatttaccatgacacaccgccggccgacgattgagaaagacgtggatctgggggctggaaccagacatgtgaacgccgaacccgagacacctaatatggacgtcatcggcgagcgcattaagcggatcaaagaagagcacaacagcacctggcactatgacgatgaaaatccctacaagacatgggcgtatcatgggtcctacgaggttaaggccaccggatctgctagctccatgatcaacggcgtggtgaaactcctgacaaagccttgggacgtcgtgcccatggttacccagatggccatgacggataccacaccgttcggccagcaaagagtgtttaaagaaaaggtcgacacccgcacacctcggagcatgcccgggaccagacgcgtgatgggaattacggctgagtggctgtggcggacactcggcagaaataaaaagcctcgcctgtgcacccgggaggaattcacaaagaaagttagaaccaacgccgccatgggggcggtgtttacggaggaaaatcagtgggattccgctaaggccgccgtcgaggacgaagatttctggaaacttgtggaccgcgagagagagctgcacaagctcggaaaatgtggctcttgcgtttataacatgatggggaagcgggaaaaaaagctgggcgagtttggaaaggctaaaggcagccgcgccatctggtacatgtggcttggggctagatacctggaattcgaggccctcggatttctgaatgaggatcattggttctcccgggaaaactcttatagcggcgtggagggggaaggactgcacaagctcggctacattctgagagacatctccaaaattcccgggggcgcgatgtatgccgatgacaccgctggatgggacacacggatcaccgaggatgaccttcataatgaagagaagatcacacagcagatggatcctgagcaccgccaactggccaacgctatttttaaactcacctaccagaataaggtcgtgaaggtccagagacccacaccgaccggcacggtgatggacatcatttctcggaaagatcagcgcgggagcggacaagttggcacatatgggctgaacaccttcaccaatatggaagcccagcttatcagacagatggagggagaaggcgtgctgtccaaggcggacctcgagaaccctcacctgcccgaaaaaaagattacacagtggctggagaccaaaggggtcgagcggctcaagcgcatggccatcagcggcgatgactgcgtggtgaagcccatcgatgacagatttgctaacgccctgcttgctctgaatgatatgggaaaagttcggaaggacattcctcaatggcagccgtctaaaggctggcatgattggcagcaggtgcccttctgttcccaccatttccacgaactcatcatgaaggacgggcgcaaactggtcgtgccttgcagaccccaagacgagcttattggacgggcccgcatcagccagggcgctgggtggtctctgagagaaacagcctgtctcggaaaggcgtacgcccagatgtggtccctgatgtattttcaccggcgcgatctgagactcgctagcaacgccatttgctctgccgttcctgtgcattgggtccccacgtcccggaccacatggagcatccacgctcatcaccaatggatgaccacagaggacatgctgaccgtgtggaatagagtctggattgaagataacccttggatggaggacaagacgcccgtgaccacatgggagaatgttccgtaccttggcaaacgcgaagatcagtggtgtgggtccctgatcggcctcaccagccgggccacatgggcgcagaacatccctaccgctattcagcaagtgagatctctgatcggaaatgaggaattccttgactacatgcccagcatgaagcgctttcggaaagaggaggaatccgagggcgccatttggtga

SEQ ID NO: 20419 - RNA, 9873 nt, synthetic construct
  misc_feature 1..9873: note = derived and/or modified CDS sequence (opt5) from DENV-3__GU131844__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagctcattgagggcaaagttgtgcagtatgaaaatctgaagtacacagtcatcatcaccgtgcacacaggggaccagcatcaggttggaaacgagacgcaaggcgtgaccgctgaaattacaccccaggcctctaccacagaggctatcctgcctgaatatggcaccctcgggctggagtgctcccccagaacgggacttgacttcaatgagatgattctgctcaccatgaaaaacaaggcctggatggtccaccggcagtggtttttcgatctgcctcttccctggacaagcggcgccaccacagaaaccccgacgtggaatcgcaaagagctgctcgtgacatttaagaacgctcatgcgaaaaagcaagaagtcgtggttctggggtctcaggagggagccatgcacaccgctctgacaggcgccaccgaaatccagaattccgggggcaccagcattttcgccggacacctcaagtgtagactgaaaatggacaagcttgagctgaaaggcatgtcttacgctatgtgcacaaacacgtttgtgctcaagaaagaggtctccgaaacccagcatgggacaatcctgatcaaggtggagtacaagggagaagatgccccttgtaaaattcccttcagcaccgaggacggccaagggaaggcgcacaacggacggctgatcacagctaatcctgttgtgaccaaaaaggaggaacccgtcaacattgaggccgaaccccctttcggcgagtccaatatcgtgattgggacgggcgataacgcccttaaaatcaattggtataagaagggatctagcatcggcaaaatgtttgaagctacagccagaggggctcgccggatggccattctcggagacaccgcgtgggatttcggctccgtggggggagttctgaacagcctgggcaagatggtccatcagatctttgggtctgcctacaccgctctcttctccggcgtgagctgggtgatgaaaattggaatcggcgtcctgcttacatggattgggctgaattctaagaacaccagcatgtccttttcttgcatcgccattggaatcatcacactctatctgggcgctgtggttcaggccgacatggggtgtgtgattaattggaaaggaaaggagctgaagtgcggcagcgggatcttcgtcacgaacgaggtgcacacctggacagaacagtacaaatttcaagcggattccccgaagagacttgccaccgctattgccggcgcttgggagaatggagtttgtggcatccgcagcacaacccggatggaaaacctcctgtggaaacagattgccaatgagctgaactatatcctctgggaaaataacgtgaagctgacggtcgtggttggggacatcattggagtgcttgagcagggcaaaagaaccctgacaccccagcctatggagctcaagtactcttggaaaacctgggggaaggccaagatcgtcacagctgaaacccaaaactccagcttcattatcgatggacccaatacacctgagtgcccctctgcgtcccgcgcctggaacgtgtgggaagtggaggactatggctttggcgtcttcaccacgaatatttggctgaaactgcgggaagtttacacacagctttgtgaccatagactcatgagcgctgccgtgaaggatgagcgcgccgtgcacgctgacatggggtactggatcgagtcccagaaaaacggatcttggaagctggaaaaagccagcctgatcgaggtcaagacctgcacctggccgaagtcccacacactctggtctaatggcgtgctggaaagcgatatgattatccctaaatcccttgcggggcccattagccagcataaccaccggcctggatatcatacccaaacggctggcccctggcacctggggaagctcgagctggactttaattactgcgagggaacaaccgttgtgatcacagaaaactgtggcaccagaggcccttctctgcgcacaaccacggtctccgggaaacttattcacgagtggtgctgtcggagctgcaccctccccccgctgagatatatgggagaagatggctgttggtacgggatggagatccggcctatctctgaaaaggaggagaatatggtgaaatccctggttagcgccggatctggcaaggtggacaacttcacaatgggggtcctctgcctggccattctttttgaagaggtgatgcgcggaaagttcggcaaaaagcatatgatcgctggcgttttctttaccttcgtgctgctcctgagcgggcagattacatggagagatatggcccacaccctgatcatgattggatccaatgcgagcgaccggatgggcatgggggtcacgtatcttgctctgatcgccacatttaaaattcagcccttcctcgccctgggatttttcctcagaaagctgacctctcgcgaaaaccttctgctcggcgtggggctggctatggccacaaccctgcaacttcccgaggatatcgaacagatggctaatggaatcgccctgggcctcatggcgctgaaactcattacccagtttgagacataccagctgtggacggcccttatctccctgacctgtagcaacacaatgttcaccctcacagtggcttggcggaccgccacgctgattctggctggcgtctcccttctgcctgtttgccaatctagctccatgagaaagacagactggctcccgatggccgtggccgctatgggggtgccccctctgcccctctttatcttctctctgaaggatacccttaaacgcagaagctggcctctgaatgagggagtcatggcggtgggcctggtttccattctcgcctctagcctgcttcggaacgacgtgcccatggctgggcctctggtcgccggaggcctcctgatcgcctgttatgtgatcaccgggacatccgctgatctcaccgttgaaaaggccgcggacattacatgggaggaagaggctgaacagacgggagtgagccataacctgatgatcaccgtcgacgatgacggcacaatgcgcattaaagatgacgagaccgagaatatccttacagtgctgctgaagaccgccctcctgattgtctctggcgtgtttccctactccatcccggccacgcttctggtttggcacacctggcagaaacagacacaaagaagcggggtgctctgggatgtcccttctccccctgaaacccagaaggctgagctggaagagggagtgtaccggatcaaacagcagggcattttcgggaagacacaagttggagtgggcgtccagaaggagggggtgtttcataccatgtggcacgtgacacgcggagccgttctcacgtataacggcaaaagactggaacccaattgggcgtccgtcaagaaagaccttatcagctacggcgggggatggcggctgtctgctcagtggcaaaagggcgaggaagtgcaggtgattgccgtcgagccggggaaaaaccctaagaatttccagaccatgcccggaacattccagaccaccacaggcgaaatcggggccattgctctggattttaagcctggaacgtccggcagccccatcattaaccgcgagggcaaagtggttgggctctatggaaatggcgtggtcaccaagaacgggggatacgtgtccggcatcgcccaaacaaatgctgagcccgacgggcctaccccggaactggaggaagagatgttcaaaaagagaaaccttacaatcatggatctgcaccccggcagcggaaaaacccggaagtatctccctgccattgttcgcgaagcgatcaagagacggctgagaacgctcattctggcccccacacgcgtggtcgctgccgagatggaggaagctcttaaaggcctgcctatccggtaccagaccaccgccacaaagtctgagcataccgggagagaaattgtggacctgatgtgccacgccacatttaccatgcgcctcctgagccccgttcgggtgcctaattataaccttatcatcatggatgaggctcatttcacggacccggcgtccattgccgctagaggatacatctctacacgcgtcggcatgggggaagccgccgctatttttatgaccgccacaccccctggaaccgcggatgctttcccccagagcaatgcccctatccaggacgaggagcgggacattcccgaaagatcctggaactctggcaatgagtggatcacggattttgccgggaaaaccgtgtggttcgtgccgagcatcaaggctggcaacgacattgccaactgtctgcgcaaaaatggaaagaaggtcatccaactctcccggaaaacatttgataccgaataccagaagacaaaactgaacgactgggatttcgttgtgaccacagacatttctgagatgggcgcgaattttaaggccgatagagtgatcgaccctcggcgctgcctgaaacccgtcattctcaccgatgggcccgagagagtgatccttgctggacctatgcccgttacggccgctagcgccgctcagcggcgcggcagagtggggcggaaccctcagaaggaaaatgaccaatatattttcacaggacagccgctgaacaatgatgaggaccacgcccattggaccgaagcgaagatgctgctcgacaacatcaatacccccgagggcatcattcctgccctgttcgaacccgagagagagaaatccgctgccatcgatggggaataccgccttaagggcgagagccggaaaacatttgtcgaactgatgagacgcggagacctccctgtgtggctggctcacaaggttgcctctgagggcattaaatataccgatcggaagtggtgcttcgacgggcagagaaacaatcagatcctggaagagaacatggatgtggagatttggacaaaagaaggagagaagaagaaactccgcccccggtggcttgacgccagaacgtactccgatccgctggctctgaaggaatttaaagacttcgcggccggccgcaagagcatcgctctcgatctggtcaccgagatcgggagagtgccttctcaccttgcccatcggacacgcaatgccctggacaacctcgtcatgctgcacacctccgaacatggaggcagagcttatcggcacgccgtggaggagctgcccgaaacaatggagaccctccttctgctgggcctcatgattctgcttacggggggagcgatgctgtttctcatcagcggcaaagggattggaaagacctccatcggcctgatttgtgttatcgcctctagcgggatgctgtggatggctgaaatccctctccaatggattgcctccgctatcgtgcttgagttctttatgatggtgctgctgattcccgagcctgaaaagcagcgcacaccccaggataatcaactcgcctacgtcgttatcggaattctgacccttgcggccatcattgctgccaacgagatgggcctgctcgaaacaaccaaaagagacctgggcatgagcaaggagccgggggtggtgtctcctacgtcctatctggatgtcgacctccaccccgctagcgcctggacactttacgctgtggccaccacagttatcacccccatgctgcggcataccatcgaaaattctacagcgaacgtgagcctggccgctattgccaaccaggctgtcgtgctcatgggactggacaaaggctggcctatctccaagatggatcttggggtcccgctgctcgccctgggatgctactctcaggtgaatcccctgacgctcaccgccgcggttcttctgctgattacacactatgctatcattggccctgggctccaggccaaagctaccagagaggcccaaaagcgcacagccgctggaatcatgaagaaccccaccgtggacggcatcatgacgattgatctggaccctgtcatctacgatagcaaattcgagaagcagcttggccaggtgatgctgctcgttctgtgtgccgcgcagctgctccttatgcggacatcctgggccctgtgcgaagctctgaccctcgccaccgggcccattacaaccctgtgggagggatctcctggcaaattttggaatacaacgatcgctgtgagcatggccaacattttcagagggtcctatcttgcgggagccggcctggcttttagcatcatgaagtctgtcgggaccggaaaacgcggcacaggctcccaaggggaaaccctcggagagaagtggaagaaaaagctgaatcagctgagccggaaagaattcgacctctacaagaaatccggcatcacagaggtggatagaaccgaggccaaggaagggcttaaacggggagagattacgcatcacgctgtgtctcgcggcagcgccaagctgcagtggtttgttgaaagaaacatggtcatcccggaggggcgggtgattgacctgggatgtggccgcggcgggtggtcctattactgcgctggactcaagaaagtgaccgaagtcagaggctatacaaaggggggacccggccatgaggagcctgttcccatgtctacctacgggtggaatatcgtgaaactgatgagcggaaaggatgtgttctaccttcctcccgaaaaatgtgacacactgctctgcgatattggcgagtccagcccgtctcctaccgtcgaagagtcccggacaatccgcgtgctgaagatggttgagccctggctgaagaacaatcagttctgtattaaagtgctcaacccctatatgcctaccgtcatcgaacaccttgagagactgcaacggaagcacggcgggatgctggtgcgcaatcccctcagcagaaactctacgcatgaaatgtactggatctccaatggaacaggcaacattgttgccagcgtgaatatggtctctcggctgcttctgaacagatttaccatgacccaccgccggcctacaatcgagaaagacgtggatctcggggcgggaacgagacatgtgaacgccgaaccggagacccccaatatggacgtcattggcgagcgcatcaagcggattaaagaagagcacaacagcacatggcactatgacgatgaaaatccttacaagacctgggcttatcatgggtcctacgaggttaaggccacaggatctgctagctccatgatcaacggcgtggtgaaactgctgaccaagccctgggacgtcgtgcctatggttacacagatggccatgaccgatacgacccccttcggccagcaaagagtgtttaaagaaaaggtcgacacacgcaccccgcggagcatgcctgggacaagacgcgtgatgggaatcaccgccgagtggctctggcggacgctgggcagaaataaaaagccccgcctttgcacacgggaggaattcaccaagaaagttagaacaaacgcggctatgggggccgtgtttaccgaggaaaatcagtgggattccgccaaggctgccgtcgaggacgaagatttctggaaactggtggaccgcgagagagagctccacaagctgggaaaatgtggctcttgcgtttataacatgatggggaagcgggaaaaaaagcttggcgagtttggaaaggctaaaggcagccgcgccatttggtacatgtggctgggggcgagatacctcgaattcgaggccctgggatttctgaatgaggatcattggttctcccgggaaaactcttatagcggcgtggagggggaaggactccacaagctgggctacatccttagagacatttccaaaatccctgggggcgctatgtatgccgatgacacggctggatgggacacccggattacagaggatgacctgcataatgaagagaagatcacccagcagatggatcccgagcaccgccaactcgccaacgcgatctttaaactgacataccagaataaggtcgtgaaggtccagagacctacccccacaggcaccgtgatggacattatctctcggaaagatcagcgcgggagcggacaagttggcacgtatgggcttaacacattcaccaatatggaagcccagctgattagacagatggagggagaaggcgtgctctccaaggctgacctggagaacccgcacctgcctgaaaaaaagatcgcccagtggctcgagaccaaaggggtcgagcggctgaagcgcatggctattagcggcgatgactgcgtggtgaagcccatcgatgacagatttgccaacgctcttctggccctcaatgatatgggaaaagttcggaaggacatcccccaatggcagccttctaaaggctggcatgattggcagcaggtgccgttctgttcccaccatttccacgaactgattatgaaggacgggcgcaaacttgtcgtgccctgcagacctcaagacgagctgatcggacgggcgcgcattagccagggctctgggtggtccctcagagaaacagcctgtctgggaaaggcttacgcccagatgtggagcctgatgtattttcaccggcgcgatctcagactggcctctaacgctatctgctccgccgttcccgtgcattgggtccctaccagccggacaacgtggtccattcacgcgcatcaccaatggatgaccacagaggacatgcttgctgtgtggaatagagtctggatcgaagataacccctggatggaggacaagacccctgtgacaacctgggagaatgttccctacctgggcaaacgcgaagatcagtggtgtgggagcctcattggcctgacgtctcgggccacctgggcccagaacatcccgacagctatccagcaagtgagaagccttattggaaatgaggaattcctggactacatgccttccatgaagcgctttcggaaagaggaggaatctgagggcgccatctggtga

SEQ ID NO: 20420 - RNA, 9873 nt, synthetic construct
  misc_feature 1..9873: note = derived and/or modified CDS sequence (opt5) from DENV-3__GU131849__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccatcgaggctattctgcccgaatatggcacactggggctcgagtgctcccctagaaccggactggacttcaatgagatgatccttctgacgatgaaaaacaaggcctggatggtgcaccggcagtggtttttcgatctccccctgccgtggaccagcggcgccacaaccgaaacacctacctggaatcgcaaagagcttctggtcacgtttaagaacgctcatgcgaaaaagcaagaagtggttgtgctcgggtctcaggagggagccatgcacacagctctgaccggcgccacagaaattcagaattccgggggcaccagcatcttcgccggacacctgaagtgtagactcaaaatggacaagctggagcttaaaggcatgtcttacgctatgtgcaccaacacatttgtcctgaagaaagaggtgtccgaaacgcagcatgggaccatcctcattaaggttgagtaccggggagaagatgccccctgtaagatccctttcagcacagaggacggccaagggaaagcgcacaacggaagactgattaccgctaatcccgtggtcacaaagaaagaggaacccgtgaacatcgaggccgaacctccgttcggcgagtccaatattgtgatcgggatcggcgataacgccctgaagattaattggtataaaaagggatctagcatcggcaagatgtttgaagctaccgcccgcggggctcggagaatggccattcttggagacacggcgtgggatttcggctccgttgggggagtcctcaacagcctgggcaaaatggtgcatcagatctttgggtctgcctacacagctctgttctccggcgtgagctgggtcatgaagattggaatcggcattctcctgacctggatcgggcttaattctaaaaacaccagcatgtccttttcttgcatcgccattggaatcattacactgtatctcggcgctgtggttcaggccgacatggggtgtgtgatcaattggaagggaaaagagctgaagtgcggcagcgggattttcgtcaccaacgaggtgcacacatggacggaacagtacaagtttcaagcggattcccccaaacgcctggccaccgctatcgccggcgcttgggagaatggagtttgtggcatccggagcacaaccagaatggaaaaccttctctggaagcagattgccaatgagctgaactatatcctgtgggaaaataacattaaactcacagtggtcgtgggggacatcattggagttctggagcagggcaagcgcacccttacgcctcagcccatggagctgaaatactcttggaagacctgggggaaagccaagatcgtgacagctgaaacccaaaactccagcttcatcattgatggacctaatacacccgagtgcccgtctgcgtcccgggcctggaacgtctgggaagtggaggactatggctttggcgtgttcaccacaaatatctggctcaagctgagagaagtctacacccagctgtgtgaccatcgccttatgagcgctgccgttaaagatgagcgggccgtgcacgctgacatggggtactggattgagtcccagaagaacggatcttggaaactcgaaaaggccagcctgatcgaggtgaaaacgtgcacatggcctaagtcccacaccctgtggtctaatggcgtcctcgaaagcgatatgattatccccaagtccctggcggggcctatcagccagcataaccacagacccggatatcatacccaaacagctggcccttggcaccttgggaaactggagctcgactttaattactgcgagggaaccacggtggttattacagaaaactgtggcacccgcggcccctctctgcggacaaccacagtgtccgggaagctgatccacgagtggtgctgtagaagctgcacccttccgcctctccggtatatgggagaagatggctgttggtacgggatggagattcgccccatctctgaaaaagaggagaatatggtcaagtccctggtgagcgccggatctggcaaagttgacaacttcacgatgggggtgctgtgcctcgccattctgtttgaagaggtcatgagaggaaagttcggcaagaaacatatgatcgctggcgtgttctttaccttcgttcttctgctcagcgggcagattacatggcgggatatgacccacacactgatcatgatcggatccaatgccagcgacagaatgggcatgggggtgacctatctggcgcttattgctacgtttaagatccagcccttcctggccctcggatttttcctgcgcaaactcacatctcgggaaaacctgcttctgggcgtcgggctcgccatggctaccatgctgcaactgcctgaggatattgaacagatggccaatggaatcgctcttggcctgatggccctcaagctgattacacagtttgagacctaccagctctggaccgcgctgatctcccttacatgtagcaacacgatgttcaccctgacagtggcctggagaaccgctacactcatcctggccggcgtgtccctgcttccggtctgccaatctagctccatgcgcaaaaccgactggctgcccatggctgttgccgccatgggggtgcctcccctccctctgtttattttctctctcaaggatacgctgaagagacggagctggccccttaatgagggagtgatggctgtcggcctggtgtccatcctggcgtctagcctcctgcgcaacgacgttcctatggccgggccccttgtggctggaggcctgctcattgcctgttatgtcatcacagggacctccgccgatctgaccgtggaaaaagctgccgacattacatgggaggaagaggcggaacagaccggagttagccataacctcatgatcacagtggacgatgacggcacgatgagaatcaaggatgacgagaccgagaatattctgacagtccttctgaaaaccgctctgctcatcgtgtctggcgtctttccgtactccattcctgccacactgcttgtgtggcacacctggcagaagcagacgcaacggagcggggttctgtgggatgtgccctctcctcccgaaacccagaaagccgagctcgaagagggagtctaccgcatcaagcagcagggcattttcgggaaaacacaagtgggagttggcgtgcagaaggagggggtctttcataccatgtggcacgtgacaagaggagctgtgctgacctataacggcaagcggctcgaaccgaattgggcctccgttaaaaaggacctgatcagctacggcgggggatggcgcctttctgcgcagtggcaaaaaggcgaggaagtccaggtgattgctgtggagcctgggaagaaccccaaaaatttccagacaacgcctggaaccttccagacaaccaccggcgaaatcggggccatcgccctggattttaagcccggaacatccggcagccccattatcaacagagagggcaaggtcgtggggctgtatggaaatggcgttgtgacgaaaaacgggggatacgtctccggcattgctcaaaccaatgccgagcctgacgggccgacacccgaactcgaggaagagatgttcaagaaacggaacctgaccatcatggatcttcaccctggcagcggaaagacacgcaaatatctgcccgctattatcagagaagccatcaagcggagactccgcaccctgattctcgcgcctacgcgggtggttgccgctgagatggaggaagccctgaagggccttcccatcagataccagacaaccgctaccaaatctgagcatacagggcgcgaaattgtggacctgatgtgccacgccacctttacaatgcggctgctcagccctgtcagagtgccgaattataacctgatcattatggatgaggcccatttcaccgaccccgcttccatcgcggcccgcggatacatctctacgcgggttggcatgggggaagctgccgccatttttatgacagctacccctcccggaacagccgatgcgttccctcagagcaatgctcccatccaggacgaggagagagacattccggaacgctcctggaactctggcaatgagtggatcaccgattttgccgggaagacggtgtggttcgtccctagcattaaagccggcaacgacatcgctaactgtcttcggaagaatggaaaaaaggtgattcaactgtccagaaagacctttgatacagaataccagaaaaccaagctcaacgactgggatttcgtggtcacaaccgacatctctgagatgggcgccaattttaaagcggatcgggttatcgacccccgcagatgcctgaagcccgtgattctgacagatgggcctgagcgggtgatcctcgccggacccatgcctgtcaccgctgccagcgctgcccagcgcagaggccgggtggggagaaacccgcagaaagaaaatgaccaatatattttcacgggacagccccttaacaatgatgaggaccacgctcattggacagaagccaagatgctgctggacaacatcaatacccctgagggcattatccccgcgctcttcgaacctgagcgcgagaagtccgccgctatcgatggggaataccggctgaaaggcgagagcagaaagacctttgttgaacttatgcgccggggagacctgcccgtgtggctcgcccacaaagtcgcttctgagggcattaagtatacagatagaaaatggtgcttcgacgggcagcgcaacaatcagatcctggaagagaacatggatgtggagatttggaccaaggaaggagagaaaaagaagctgcggccgagatggctcgacgcccgcacatactccgatcctcttgccctgaaagaatttaaggacttcgctgcgggcagaaaaagcatcgccctggatctcgttacggagattgggcgggtgccctctcacctggctcatcgcaccagaaatgcccttgacaacctggtcatgctccacacatccgaacatggaggccgggcctatcgccacgctgtggaggagctgcctgaaaccatggagacactgctccttctgggcctgatgatcctcctgaccgggggagccatgctttttctgatcagcggcaaggggattggaaaaacgtccatcggcctcatttgtgtcatcgcgtctagcgggatgctgtggatggccgaaattcccctgcaatggatcgcttccgccattgtgctcgagttctttatgatggttcttctgatccctgagcccgaaaagcagagaaccccgcaggataatcaactggcttacgtggtgatcggaattctcacactggccgcgatcattgccgctaacgagatgggccttctggaaaccacaaagcgggacctcggcatgagcaaagagcctggggtcgtttctcccacctcctatctggatgtggacctgcaccccgccagcgcttggacgctctacgccgtggctacaaccgtcatcacacctatgcttagacataccattgaaaattctaccgccaacgtgagcctggcggccatcgctaaccaggccgttgtgctgatgggactcgacaagggctggccgatctccaaaatggatctgggggtcccccttctggctctcggatgctactctcaggtgaatcctctgacactgacggccgccgtcctccttctgattacccactatgcgatcattggccccgggctgcaggctaaggccacacgcgaggctcaaaaacggaccgccgccggaatcatgaagaaccctacagtggacggcattatgaccatcgatctcgaccccgttatctacgatagcaagttcgagaaacagctgggccaggtgatgcttctggtcctctgtgctgtgcagctgctgctcatgagaacgtcctgggccctttgcgaagcgctgacactggccaccgggcctattaccacactctgggagggatctccgggcaagttttggaataccacaatcgctgttagcatggccaacattttccgcgggtcctatctggctggagccggccttgcgtttagcatcatgaaatctgtggggacgggaaagcggggcaccggctcccaaggggaaacactgggagagaaatggaagaagaaactcaatcagctgagcagaaaggaattcgacctgtacaaaaagtccggcattaccgaggtcgatcggacagaggccaaagaagggctcaagcgcggagagatcacccatcacgctgtgtctagaggcagcgccaaacttcagtggtttgtggaacggaacatggttattcccgaggggcgcgtcatcgacctgggatgtggcagaggcgggtggtcctattactgcgctggactgaagaaggtgacggaagtgcggggctataccaaagggggacctggccatgaggagcccgtccctatgtctacatacgggtggaatatcgttaagctcatgagcggaaaagatgtgttctacctgcccccggaaaagtgtgacacccttctgtgcgatattggcgagtccagcccttctcccacagtggaagagtcccgcaccatcagagtcctcaaaatggtggagccctggctgaagaacaatcagttctgtattaaggttctgaacccttatatgcccacagtgatcgaacacctcgagcggcttcaacgcaaacacggcgggatgctggtcagaaatcctctgagccggaactctacccatgaaatgtactggatttccaatggaacgggcaacatcgtggccagcgttaatatggtgtctagactcctgcttaaccgctttacaatgacccaccggagaccgaccatcgagaaggacgtcgatctgggggctggaacacgccatgtgaacgccgaacccgagacgcctaatatggacgtgattggcgagcggatcaaaagaattaaggaagagcacaacagcacctggcactatgacgatgaaaatccctacaaaacatgggcgtatcatgggtcctacgaggtcaaggccaccggatctgctagctccatgatcaacggcgttgtgaagctcctgacaaaaccttgggacgtggtccccatggtgacccagatggccatgacagataccacgccgttcggccagcaacgcgtttttaaggaaaaagtggacacccggacacctagaagcatgcccgggacccgccgggtcatggagattacagctgagtggctgtggagaaccctcggacgcaataagaaacctcggctgtgcacgagagaagagttcacaaagaaggtgcgcaccaacgccgccatgggcgcggtttttacagaagagaatcagtgggattccgctaaagccgccgtggaagacgaggatttctggaagcttgtcgacagagagcgggaactgcacaaactcgggaagtgtggatcttgcgtgtataacatgatgggcaaacgcgagaagaaactgggggaatttggcaaggctaagggaagcagagccatctggtacatgtggcttggcgctcggtacctggagttcgaggccctcgggtttctgaatgaagatcattggttctccagagagaactcttatagcggagttgaaggcgaggggctgcacaaactcggatacatcctgcgggacatttccaagatccccggcggggcgatgtatgccgatgacaccgctggctgggacacgcgcattaccgaagatgaccttcataatgaggagaaaatcacacagcagatggatcctgaacacagacaactggccaacgctatttttaagctcacctaccagaataaagtggtcaaggtgcagcggcccacaccgaccggaacagtcatggacatcatctctcgcaaggatcagagaggcagcgggcaagtgggaacctatggcctgaacacgttcacaaatatggaggcccagcttattcggcagatggaaggggagggagttctgtccaaagcggacctcgaaaacagccacctgcctgagaagaaaatcacccagtggctggagaccaagggcgtggaacgcctcaaaagaatggccatttctggggatgactgcgtcgtgaagcccatcgatgaccggtttgctaacgccctgcttgctctgaatgatatgggcaaggtgcgcaaagacattccccaatggcagccttccaagggatggcatgattggcagcaggttccgttctgtagccaccatttccacgagctcatcatgaaagacggcagaaagctggtggtcccctgccggcctcaagacgaacttattgggcgcgccagaatctctcagggagctggctggtccctgcgggagacagcctgtctcgggaaagcgtacgcccagatgtggagcctgatgtattttcaccgcagagatctgcggctcgcttctaacgccatctgctccgccgtgcccgttcattgggtgcctaccagcagaacaacgtggtccattcacgctcatcaccaatggatgaccacagaagacatgctgaccgtctggaatcgcgtgtggatcgaggataacccctggatggaggacaagacacctgtcaccacgtgggaaaatgtgccctaccttggaaagcgggaggatcagtggtgtggcagcctgattgggctcacctctagagccacatgggcgcagaacatcccgaccgctattcagcaagttcgcagcctgatcggcaatgaagagttccttgactacatgccttccatgaaacggtttagaaaggaggaagagtctgaaggagccatctggtga

SEQ ID NO: 20421 - RNA, 9873 nt, synthetic construct
  misc_feature 1..9873: note = derived and/or modified CDS sequence (opt5) from DENV-3__GQ868546__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgttgggggagtcctcaacagcctgggcaaaatggtgcatcagatttttgggtctgcctacaccgctctgttctccggcgtgagctgggtcatgaagatcggaattggcatcctcctgacctggattgggcttaattctaaaaacacaagcatgtccttttcttgcatcgccatcggaattatcaccctgtatctcggcgctgtggttcaggccgacatggggtgtgtgattaattggaagggaaaagagctgaagtgcggcagcgggatcttcgtcacaaacgaggtgcacacgtggaccgaacagtacaagtttcaagcggattcccccaaacgcctggccacagctattgccggcgcttgggagaatggagtttgtggcatccggagcaccacaagaatggaaaaccttctctggaagcagatcgccaatgagctgaactatattctgtgggaaaataacatcaaactcaccgtggtcgtgggggacattatcggagttctggagcagggcaagcgcacgcttacccctcagcccatggagctgaaatactcttggaagacatgggggaaagccaagattgtgaccgctgaaacacaaaactccagcttcatcatcgatggacctaatacccccgagtgcccgtctgcgtcccgggcctggaacgtctgggaagtggaggactatggctttggcgtgttcacaaccaatatttggctcaagctgagagaagtctacacgcagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacatgcacctggcctaagtcccacaccctgtggtctaatggcgtcctcgaaagcgatatgatcattcccaagtccctggcggggcctatcagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgattcacgagtggtgctgtagaagctgcacgcttccgcctctccggtatatgggagaagatggctgttggtacgggatggagatccgccccatttctgaaaaagaggagaatatggtcaagtccctggtgagcgccggatctggcaaagttgacaacttcaccatgggggtgctgtgcctcgccatcctgtttgaagaggtcatgagaggaaagttcggcaagaaacatatgattgctggcgtgttctttacattcgttcttctgctcagcgggcagatcacctggcgggatatgacacacaccctgattatgatcggatccaatgccagcgacagaatgggcatgggggtgacgtatctggcgcttatcgctacatttaagattcagcccttcctggccctcggatttttcctgcgcaaactcacctctcgggaaaacctgcttctgggcgtcgggctcgccatggctacaaccctgcaactgcctgaggatatcgaacagatggccaatggaattgctcttggcctgatggccctcaagctgatcacccagtttgagacataccagctctggacggcgctgatttcccttacctgtagcaacacaatgttcaccctgacagtggcctggagaaccgctacgctcatcctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccattctggcgtctagcctcctgcgcaacgacgttcctatggccgggccccttgtggctggaggcctgctcatcgcctgttatgtcattaccgggacatccgccgatctgaccgtggaaaaagctgccgacatcacatgggaggaagaggcggaacagacgggagttagccataacctcatgattaccgtggacgatgacggcacaatgagaatcaaggatgacgagaccgagaatatcctgacagtccttctgaaaaccgctctgctcattgtgtctggcgtctttccgtactccatccctgccacgctgcttgtgtggcacacctggcagaagcagacacaacggagcggggttctgtgggatgtgccctctcctcccgaaacccagaaagccgagctcgaagagggagtctaccgcattaagcagcagggcatcttcgggaaaacacaagtgggagttggcgtgcagaaggagggggtctttcataccatgtggcacgtgacaagaggagctgtgctgacgtataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagaccacacctggaaccttccagaccacaacgggcgaaattggggccatcgccctggattttaagcccggaacctccggcagccccatcattaacagagagggcaaggtcgtggggctgtatggaaatggcgttgtgacaaaaaacgggggatacgtctccggcatcgctcaaaccaatgccgagcctgacgggccgacacccgaactcgaggaagagatgttcaagaaacggaacctgaccattatggatcttcaccctggcagcggaaagacgcgcaaatatctgcccgctatcattagagaagccatcaagcggagactccgcacactgatcctcgcgcctacccgggtggttgccgctgagatggaggaagccctgaagggccttcccattagataccagaccacagctaccaaatctgagcatacagggcgcgaaatcgtggacctgatgtgccacgccacctttacgatgcggctgctcagccctgtcagagtgccgaattataacctgattatcatggatgaggcccatttcacagaccccgcttccattgcggcccgcggatacatctctacccgggttggcatgggggaagctgccgccatctttatgacagctacccctcccggaacggccgatgcgttccctcagagcaatgctcccattcaggacgaggagagagacatcccggaacgctcctggaactctggcaatgagtggattaccgattttgccgggaagacagtgtggttcgtccctagcatcaaagccggcaacgacattgctaactgtcttcggaagaatggaaaaaaggtgatccaactgtccagaaagacctttgatacagaataccagaaaaccaagctcaacgactgggatttcgtggtcacaaccgacatttctgagatgggcgccaattttaaagcggatcgggttatcgacccccgcagatgcctgaagcccgtgatcctgacggatgggcctgagcgggtgattctcgccggacccatgcctgtcacagctgccagcgctgcccagcgcagaggccgggtggggagaaacccgcagaaagaaaatgaccaatatatcttcaccggacagccccttaacaatgatgaggaccacgctcattggaccgaagccaagatgctgctggacaacattaatacacctgagggcatcattcccgcgctcttcgaacctgagcgcgagaagtccgccgctatcgatggggaataccggctgaaaggcgagagcagaaagacctttgttgaacttatgcgccggggagacctgcccgtgtggctcgcccacaaagtcgcttctgagggcatcaagtatacagatagaaaatggtgcttcgacgggcagcgcaacaatcagattctggaagagaacatggatgtggagatctggacgaaggaaggagagaaaaagaagctgcggccgagatggctcgacgcccgcacctactccgatcctcttgccctgaaagaatttaaggacttcgctgcgggcagaaaaagcattgccctggatctcgttacagagatcgggcgggtgccctctcacctggctcatcgcaccagaaatgcccttgacaacctggtcatgctccacacatccgaacatggaggccgggcctatcgccacgctgtggaggagctgcctgaaaccatggagacgctgctccttctgggcctgatgattctcctgaccgggggagccatgctttttctgatcagcggcaaggggatcggaaaaacatccattggcctcatctgtgtcattgcgtctagcgggatgctgtggatggccgaaatccccctgcaatggattgcttccgccatcgtgctcgagttctttatgatggttcttctgattcctgagcccgaaaagcagagaaccccgcaggataatcaactggcttacgtggtgatcggaatcctcacactggccgcgattatcgccgctaacgagatgggccttctggaaaccacgaagcgggacctcggcatgagcaaagagcctggggtcgtttctcccacatcctatctggatgtggacctgcaccccgccagcgcttggaccctctacgccgtggctacaaccgtcattacccctatgcttagacatacaatcgaaaattctacggccaacgtgagcctggcggccattgctaaccaggccgttgtgctgatgggactcgacaagggctggccgatctccaaaatggatctgggggtcccccttctggctctcggatgctactctcaggtgaatcctctgaccctgacagccgccgtcctccttctgatcacccactatgcgattatcggccccgggctgcaggctaaggccacacgcgaggctcaaaaacggaccgccgccggaattatgaagaaccctacggtggacggcatcatgacaattgatctcgaccccgttatctacgatagcaagttcgagaaacagctgggccaggtgatgcttctggtcctctgtgctgtgcagctgctgctcatgagaacctcctgggccctttgcgaagcgctgaccctggccacagggcctatcaccacactctgggagggatctccgggcaagttttggaatacgaccattgctgttagcatggccaacatcttccgcgggtcctatctggctggagccggccttgcgtttagcattatgaaatctgtggggacaggaaagcggggcaccggctcccaaggggaaacactgggagagaaatggaagaagaaactcaatcagctgagcagaaaggaattcgacctgtacaaaaagtccggcatcaccgaggtcgatcggacggaggccaaagaagggctcaagcgcggagagattacccatcacgctgtgtctagaggcagcgccaaacttcagtggtttgtggaacggaacatggttatccccgaggggcgcgtcattgacctgggatgtggcagaggcgggtggtcctattactgcgctggactgaagaaggtgacagaagtgcggggctataccaaagggggacctggccatgaggagcccgtccctatgtctacatacgggtggaatatcgttaagctcatgagcggaaaagatgtgttctacctgcccccggaaaagtgtgacacccttctgtgcgatatcggcgagtccagcccttctcccacagtggaagagtcccgcaccattagagtcctcaaaatggtggagccctggctgaagaacaatcagttctgtatcaaggttctgaacccttatatgcccacggtgattgaacacctcgagcggcttcaacgcaaacacggcgggatgctggtcagaaatcctctgagccggaactctacacatgaaatgtactggatctccaatggaaccggcaacattgtggccagcgttaatatggtgtctagactcctgcttaaccgctttaccatgacacaccggagaccgacgatcgagaaggacgtcgatctgggggctggaacccgccatgtgaacgccgaacccgagacacctaatatggacgtgatcggcgagcggattaaaagaatcaaggaagagcacaacagcacctggcactatgacgatgaaaatccctacaaaacatgggcgtatcatgggtcctacgaggtcaaggccaccggatctgctagctccatgattaacggcgttgtgaagctcctgacaaaaccttgggacgtggtccccatggtgacccagatggccatgacggataccacaccgttcggccagcaacgcgtttttaaggaaaaagtggacacccggacacctagaagcatgcccgggacccgccgggtcatggagatcacggctgagtggctgtggagaacactcggacgcaataagaaacctcggctgtgcaccagagaagagttcacaaagaaggtgcgcaccaacgccgccatgggcgcggtttttacggaagagaatcagtgggattccgctaaagccgccgtggaagacgaggatttctggaagcttgtcgacagagagcgggaactgcacaaactcgggaagtgtggatcttgcgtgtataacatgatgggcaaacgcgagaagaaactgggggaatttggcaaggctaagggaagcagagccatttggtacatgtggcttggcgctcggtacctggagttcgaggccctcgggtttctgaatgaagatcattggttctccagagagaactcttatagcggagttgaaggcgaggggctgcacaaactcggatacatcctgcgggacatctccaagattcccggcggggcgatgtatgccgatgacaccgctggctgggacacacgcatcaccgaagatgaccttcataatgaggagaaaattacacagcagatggatcctgaacacagacaactggccaacgctatctttaagctcacctaccagaataaagtggtcaaggtgcagcggcccacaccgaccggaacggtcatggacattatctctcgcaaggatcagagaggcagcgggcaagtgggaacatatggcctgaacaccttcaccaatatggaggcccagcttatccggcagatggaaggggagggagttctgtccaaagcggacctcgaaaaccctcacctgcccgagaagaaaattacacagtggctggagaccaagggcgtggaacgcctcaaaagaatggccatcagcggggatgactgcgtcgtgaagcccattgatgaccggtttgctaacgccctgcttgctctgaatgatatgggcaaggtgcgcaaagacatccctcaatggcagccgtctaagggatggcatgattggcagcaggttcccttctgttcccaccatttccacgagctcattatgaaagacggcagaaagctggtggtcccttgccggccccaagacgaacttatcgggcgcgccagaattagccagggagctggctggtctctgcgggagacagcctgtctcgggaaagcgtacgcccagatgtggtccctgatgtattttcaccgcagagatctgcggctcgctagcaacgccatctgctctgccgtgcctgttcattgggtgcccacgtccagaaccacatggagcatccacgctcatcaccaatggatgaccacagaagacatgctgaccgtctggaatcgcgtgtggattgaggataacccttggatggaggacaagacgcccgtcaccacatgggaaaatgtgccgtaccttggaaagcgggaggatcagtggtgtggctccctgatcgggctcaccagcagagccacatgggcgcagaacattcctaccgctatccagcaagttcgctctctgattggcaatgaagagttccttgactacatgcccagcatgaaacggtttagaaaggaggaagagtccgaaggagccatctggtga

SEQ ID NO: 20422 - RNA, 9873 nt, synthetic construct
  misc_feature 1..9873: note = derived and/or modified CDS sequence (opt5) from DENV-3__GU131850__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcattaagaaagaggaacccgtgaacatcgaggccgaacctccgttcggcgagtccaatattgtgatcgggatcggcgataacgccctgaagattaattggtataaaaagggatctagcatcggcaagatgtttgaagctaccgcccgcggggctcggagaatggccattcttggagacacggcgtgggatttcggctccgttgggggagtcctcaacagcctgggcaaaatggtgcatcagatctttgggtctgcctacacagctctgttctccggcgtgagctgggtcatgaagattggaatcggcattctcctgacctggatcgggcttaattctaaaaacaccagcatgtccttttcttgcatcgccattggaatcattacactgtatctcggcgctgtggttcaggccgacatcgggtgtgtgattaattggaagggaaaagagctgaagtgcggcagcgggatcttcgtcaccaacgaggtgcacacatggacggaacagtacaagtttcaagcggattcccccaaacgcctggccaccgctatcgccggcgcttgggagaatggagtttgtggcattcggagcacaaccagaatggaaaaccttctctggaagcagatcgccaatgagctgaactatattctgtgggaaaataacatcaaactcacagtggtcgtgggggacattatcggagttctggagcagggcaagcgcacccttacgcctcagcccatggagctgaaatactcttggaagacctgggggaaagccaagatcgtgacagctgaaacccaaaactccagcttcattatcgatggacctaatacacccgagtgcccgtctgcgtcccgggcctggaacgtctgggaagtggaggactatggctttggcgtgttcaccacaaatatttggctcaagctgagagaagtctacacccagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacgtgcacatggcctaagtcccacaccctgtggtctaatggcgtcctcgaaagcgatatgatcatccccaagtccctggcggggcctattagccagcataaccacagacccggatatcatacccaaacagctggcccttggcaccttgggaaactggagctcgactttaattactgcgagggaaccacggtggttatcacagaaaactgtggcacccgcggcccctctctgcggacaaccacagtgtccgggaagctgattcacgagtggtgctgtagaagctgcacccttccgcctctccggtatatgggagaagatggctgttggtacgggatggagatccgccccatttctgaaaaagaggagaatatggtcaagtccctggtgagcgccggatctggcaaagttgacaacttcacgatgggggtgctgtgcctcgccatcctgtttgaagaggtcatgagaggaaagttcggcaagaaacatatgattgctggcgtgttctttaccttcgttcttctgctcagcgggcagatcacatggcgggatatgacccacacactgatcatgattggatccaatgccagcgacagaatgggcatgggggtgacctatctggcgcttatcgctacgtttaagattcagcccttcctggccctcggatttttcctgcgcaaactcacatctcgggaaaacctgcttctgggcgtcgggctcgccatggctaccacactgcaactgcctgaggatatcgaacagatggccaatggaattgctcttggcctgatggccctcaagctgatcacccagtttgagacctaccagctctggacagcgctgatctcccttacgtgtagcaacaccatgttcacactgaccgtggcctggagaacagctaccctcattctggccggcgtgtccctgcttccggtctgccaatctagctccatgcgcaaaacggactggctgcccatggctgttgccgccatgggggtgcctcccctccctctgtttatcttctctctcaaggatacactgaagagacggagctggccccttaatgagggagtgatggctgtcggcctggtgtccattctggcgtctagcctcctgcgcaacgacgttcctatggccgggccccttgtggctggaggcctgctcatcgcctgttatgtcattaccgggacctccgccgatctgacagtggaaaaagctgccgacatcacctgggaggaagaggcggaacagacaggagttagccataacctcatgatcacggtggacgatgacggcaccatgagaattaaggatgacgagacagagaatatcctgaccgtccttctgaaaacagctctgctcattgtgtctggcgtctttccgtactccatccctgccaccctgcttgtgtggcacacgtggcagaagcagacccaacggagcggggttctgtgggatgtgccctctcctcccgaaacacagaaagccgagctcgaagagggagtctaccgcattaagcagcagggcatcttcgggaaaacccaagtgggagttggcgtgcagaaggagggggtctttcatacaatgtggcacgtgaccagaggagctgtgctgacatataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagacgatgcctggaaccttccagacaaccaccggcgaaatcggggccattgccctggattttaagcccggaacatccggcagccccatcattaacagagagggcaaggtcgtggggctgtatggaaatggcgttgtgacgaaaaacgggggatacgtctccggcatcgctcaaaccaatgccgagcctgacgggccgacacccgaactcgaggaagagatgttcaagaaacggaacctgaccattatggatcttcaccctggcagcggaaagacacgcaaatatctgcccgctatcatcagagaagccattaagcggagactccgcaccctgatcctcgcgcctacgcgggtggttgccgctgagatggaggaagccctgaagggccttcccattagataccagacaaccgctaccaaatctgagcatacagggcgcgaaatcgtggacctgatgtgccacgccacctttacaatgcggctgctcagccctgtcagagtgccgaattataacctgattatcatggatgaggcccatttcaccgaccccgcttccatcgcggcccgcggatacatttctacgcgggttggcatgggggaagctgccgccatctttatgacagctacccctcccggaacagccgatgcgttccctcagagcaatgctcccattcaggacgaggagagagacatcccggaacgctcctggaactctggcaatgagtggattaccgattttgtggggaagacggtctggttcgtgcctagcatcaaagccggcaacgacattgccaactgtcttcggaagaatggaaaaaaggtgatccaactgtccagaaagacctttgatacagaataccagaaaaccaagctcaacgactgggatttcgtcgttacaaccgacatctctgagatgggcgctaattttaaagccgatcgggtgattgacccccgcagatgcctgaagcccgtgatcctgacagatgggcctgagcgggtcattctcgcgggacccatgcctgtgaccgccgctagcgccgctcagcgcagaggccgggttgggagaaacccgcagaaagaaaatgaccaatatatcttcacgggacagccccttaacaatgatgaggaccacgcccattggacagaagctaagatgctgctggacaacattaatacccctgagggcatcatccccgccctcttcgaacctgagcgcgagaagtccgcggccattgatggggaataccggctgaaaggcgagagcagaaagacctttgtggaacttatgcgccggggagacctgcccgtctggctcgctcacaaagtggcctctgagggcatcaagtatacagatagaaaatggtgcttcgacgggcagcgcaacaatcagattctggaagagaacatggatgttgagatctggaccaaggaaggagagaaaaagaagctgcggccgagatggctcgacgctcgcacatactccgatcctcttgccctgaaagaatttaaggacttcgccgctggcagaaaaagcattgcgctggatctcgtgacggagatcgggcgggtcccctctcacctggcccatcgcaccagaaatgctcttgacaacctggtgatgctccacacatccgaacatggaggccgggcctatcgccacgccgtcgaggagctgcctgaaaccatggagacactgctccttctgggcctgatgatcctcctgaccgggggagctatgctttttctgattagcggcaaggggatcggaaaaacgtccattggcctcatctgtgtgattgcctctagcgggatgctgtggatggcggaaatccccctgcaatggattgcctccgctatcgttctcgagttctttatgatggtgcttctgatccctgagcccgaaaagcagagaaccccgcaggataatcaactggcctacgtggtcattggaatcctcacactggctgccattatcgcggccaacgagatgggccttctggaaaccacaaagcgggacctcggcatgagcaaagagcctggggttgtgtctcccaattcctatctggatgtggacctgcaccccgctagcgcctggaccctctacgctgtcgccacgacagtgattacccctatgcttagacatacaatcgaaaactctaccgctaacgttagcctggccgcgatcgccaatcaggctgtggtcctgatgggactcgacaagggctggccgatttccaaaatggatctgggggtgccccttctggccctcggatgctactctcaggtcaaccctctgaccctgacagctgccgtgctccttctgatcacgcactatgccattatcggccccgggctgcaggcgaaggctacccgcgaggcccaaaaacggacagctgccggaattatgaagaatcctaccgttgacggcatcatgacaatcgatctcgaccccgtgatttacgatagcaagttcgagaaacagctgggccaggtcatgcttctggtgctctgtgccgttcagctgctgctcatgagaacctcctgggctctttgcgaagccctgacgctggcgacagggcctatcaccaccctctgggagggatctccgggcaagttttggaacacaaccattgccgtgagcatggctaatatcttccgcgggtcctatctggccggagctggccttgcctttagcattatgaaatctgtcgggacaggaaagcggggcacgggctcccaaggggaaaccctgggagagaaatggaagaagaaactcaaccagctgagcagaaaggaattcgacctgtacaaaaagtccggcatcacagaggtggatcggaccgaggcgaaagaagggctcaagaaaggagagattacacatcacgccgtgtctcgcggcagcgctaagcttcagtggtttgttgaaagaaatatggtcatccccgaggggcgggtgatcgacctgggatgtggccgcggcgggtggtcctattactgcgccggactgaagaaagtgaccgaagtcagaggctatacgaaggggggacctggccatgaggagcccgttcctatgtctacctacgggtggaacattgtgaaactcatgagcggaaaggatgtgttctacctgcccccggaaaaatgtgacacacttctgtgcgatatcggcgagtccagcccttctcccaccgtcgaagagtcccggacaattcgcgtgctcaagatggttgagccctggctgaagaataaccagttctgtatcaaagtgctgaatccttatatgcccaccgtcattgaacacctcgagagacttcaacggaagcacggcgggatgctggtgcgcaaccctctgagcagaaattctacacatgaaatgtactggatctccaacggaaccggcaatatcgttgctagcgtgaacatggtctctcggctcctgcttaacagatttacgatgacacaccgccggccgaccattgagaaagacgtggatctgggggccggaaccagacatgtgaatgctgaacccgagacacctaacatggacgtcatcggcgagcgcattaagcggatcaaagaagagcacaatagcacgtggcactatgacgatgaaaacccctacaagacctgggcctatcatgggtcctacgaggttaaggcgacaggatctgccagctccatgattaatggcgtggtgaaactcctgaccaagccttgggacgtcgtgcccatggttacacagatggctatgaccgatacaaccccgttcggccagcaaagagtgtttaaagaaaaggtcgacacgcgcacccctcggagcatgcccgggacaagacgcgtgatgggaatcaccgccgagtggctgtggcggacactcggcagaaacaaaaagcctcgcctgtgcacccgggaggaattcacgaagaaagttagaacaaatgctgccatgggggccgtgtttaccgaggaaaaccagtgggattccgcgaaggctgccgtcgaggacgaagatttctggaaacttgtggaccgcgagagagagctgcacaagctcggaaaatgtggctcttgcgtttataatatgatggggaagcgggaaaaaaagctgggcgagtttggaaaggccaaaggcagccgcgctatctggtacatgtggcttggggccagatacctggaattcgaggctctcggatttctgaacgaggatcattggttctcccgggaaaattcttatagcggcgtggagggggaaggactgcacaagctcggctacattctgagagacatctccaaaattcccgggggcgccatgtatgcggatgacacagccggatgggacacccggatcacggaggatgaccttcataacgaagagaagattacccagcagatggatcctgagcaccgccaactggctaatgccatctttaaactcacataccagaacaaggtcgtgaaggtccagagacccaccccgacaggcaccgtgatggacatcatttctcggaaagatcagcgcgggagcggacaagttggcacatatgggctgaataccttcacgaacatggaagctcagcttatcagacagatggagggagaaggcgtgctgtccaaggccgacctcgagaaccctcacctgcccgaaaaaaagattacacagtggctggagaccaaaggggtcgagcggctcaagcgcatggcgatcagcggcgatgactgcgtggtgaagcccattgatgacagatttgccaatgctctgcttgccctgaacgatatgggaaaagttcggaaggacatccctcaatggcagccgtctaaaggctggcatgattggcagcaggtgcccttctgttcccaccatttccacgaactcattatgaaggacgggcgcaaactggtcgtgccttgcagaccccaagacgagcttatcggacgggctcgcatcagccagggcgccgggtggtctctgagagaaaccgcttgtctcggaaaggcctacgcgcagatgtggtccctgatgtattttcaccggcgcgatctgagactcgccagcaatgctatttgctctgccgttcctgtgcattgggtccccacatcccggaccacatggagcatccacgcccatcaccaatggatgacgaccgaggacatgctgacagtgtggaacagagtctggattgaagataatccttggatggaggacaagacccccgtgacaacctgggagaacgttccgtaccttggcaaacgcgaagatcagtggtgtgggtccctgatcggcctcacgagccgggctacctgggcccagaatattcctacagcgatccagcaagtgagatctctgatcggaaacgaggaattccttgactacatgcccagcatgaagcgctttcggaaagaggaggaatccgagggcgctatttggtga

SEQ ID NO: 20423 - RNA, 9873 nt, synthetic construct
  misc_feature 1..9873: note = derived and/or modified CDS sequence (opt5) from DENV-3__GU131851__SS-prME
  source 1..9873: mol_type = other RNA
accagcctgtgcctcgtgatgatcctgcccgccgctcttgccttccacctgacatccagagacggcgagcctcatatgattgtcgggaagaacgaacggggaaaatctctcctgtttaagacggcgagcggcatcaatatgtgtacccttattgctatggatctgggggagatgtgcgacgatacagttacctacaaatgtccgcacatcacagaagtggagcccgaagacattgattgctggtgtaacctcacctccacatgggtgacctatggaacgtgcaatcaggccggcgagcgcagacgggacaagcgctctgtcgccctggctcctcatgtggggatgggactggataccagaacacaaacctggatgagcgccgagggcgcttggcggcaggttgaaaaagtggagacatgggccctccgccaccccggcttcaccatcctggcgctttttctggcccattacatcgggacgtccctcacacagaaggtcgtgattttcatcctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccattgagggcaaagtggtccagtatgaaaatctcaagtacacagtgatcatcaccgttcatacaggggaccagcaccaggtgggaaacgagacgcaaggcgtcaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtgcatagacagtggctctttgatctgccccttccgtggacaagcggcgccaccacagaaacccctacgtggaatcggaaagagctgctcgtcacattcaagaacgctcacgcgaaaaagcaagaagtggttgtgctggggtctcaggagggagccatgcacaccgctctgacaggcgccaccgaaatccagaattccgggggcaccagcatttttgccggacatctcaagtgtcgcctgaaaatggacaagcttgagctgaaaggcatgtcttacgctatgtgcacaaacacgttcgtcctcaagaaagaggtgtccgaaacccagcacgggacaatcctgatcaaggttgagtacagaggagaagatgccccctgtaagattccttttagcaccgaggacggccaagggaaagcgcataacggacggctgatcacagctaatcccgtggtcaccaagaaagaggaacccgtgaacattgaggccgaacctccgttcggcgagtccaatatcgtgattgggatcggcgataacgcccttaagatcaattggtataaaaagggatctagcattggcaagatgttcgaagctacggccagaggggctcgccggatggccatcctcggagacacagcgtgggattttggctccgttgggggagtcctgaacagcctgggcaaaatggtgcaccagattttcgggtctgcctacaccgctctcttttccggcgtgagctgggtcatgaagatcggaattggcatcctgcttacctggattgggctgaattctaaaaacacaagcatgtccttctcttgcatcgccatcggaattatcaccctctatctgggcgctgtggttcaggccgacatggggtgtgtgattaattggaagggaaaagagctgaagtgcggcagcgggatctttgtcacaaacgaggtgcatacgtggaccgaacagtacaagttccaagcggattcccccaaaagacttgccacagctattgccggcgcttgggagaatggagtttgtggcatccgcagcaccacacggatggaaaacctcctgtggaagcagatcgccaatgagctgaactatattctctgggaaaataacatcaaactgaccgtggtcgtgggggacattatcggagttcttgagcagggcaagagaacgctgacccctcagcccatggagctcaaatactcttggaagacatgggggaaagccaagattgtgaccgctgaaacacaaaactccagctttatcatcgatggacctaatacccccgagtgcccgtctgcgtcccgcgcctggaacgtctgggaagtggaggactatggcttcggcgtgtttacaaccaatatttggctgaagctgcgggaagtctacacgcagctttgtgaccacagactcatgagcgctgccgttaaagatgagcgcgccgtgcacgctgacatggggtactggatcgagtcccagaagaacggatcttggaaactggaaaaggccagcctgattgaggtgaaaacatgcacctggcctaagtcccataccctctggtctaatggcgtcctggaaagcgatatgatcattcccaagtcccttgcggggcctatcagccagcacaaccatcggcccggatatcacacacaaaccgctggcccttggcacctggggaaactcgagctggacttcaattactgcgagggaacgacagtggttatcaccgaaaactgtggcacaagaggcccctctctgcgcaccacaaccgtgtccgggaagcttattcatgagtggtgctgtcggagctgcacgctcccgcctctgagatatatgggagaagatggctgttggtacgggatggagatccggcccatttctgaaaaagaggagaatatggtcaagtccctggtgagcgccggatctggcaaagttgacaactttaccatgggggtgctctgcctggccatccttttcgaagaggtcatgcgcggaaagtttggcaagaaacacatgattgctggcgtgttcttcacatttgttctgctcctgagcgggcagatcacctggagagatatgacacataccctgattatgatcggatccaatgccagcgaccggatgggcatgggggtgacgtatcttgcgctgatcgctacattcaagattcagccctttctcgccctgggattctttctcagaaaactgacctctcgcgaaaaccttctgctcggcgtcgggctggccatggctacaaccctgcaacttcctgaggatatcgaacagatggccaatggaattgctctgggcctcatggccctgaagctcatcacccagttcgagacataccagctgtggacggcgcttatttccctgacctgtagcaacacaatgtttaccctcacagtggcctggcggaccgctacgctgatcctggccggcgtgtcccttctgccggtctgccaatctagctccatgagaaaaacagactggctccccatggctgttgccgccatgggggtgcctcccctgcctctcttcatcttttctctgaaggatacccttaagcgcagaagctggcccctgaatgagggagtgatggctgtcggcctggtgtccattctcgcgtctagcctgcttcggaacgacgttcctatggccgggcccctggtggctggaggcctcctgatcgcctgttatgtcattaccgggacatccgccgatctcaccgtggaaaaagctgccgacatcacatgggaggaagaggcggaacagacgggagttagccacaacctgatgattaccgtggacgatgacggcacaatgcgcatcaaggatgacgagaccgagaatatccttacagtcctgctgaaaaccgctctcctgattgtgtctggcgtcttcccgtactccatccctgccacgcttctggtgtggcatacctggcagaagcagacacaaagaagcggggttctctgggatgtgccctctcctcccgaaacccagaaagccgagctggaagagggagtctaccggattaagcagcagggcatctttgggaaaacacaagtgggagttggcgtgcagaaggagggggtcttccacaccatgtggcacgtgacacgcggagctgtgctcacgtataacggcaagagactggaaccgaattgggcctccgttaaaaaggaccttattagctacggcgggggatggcggctgtctgcgcagtggcaaaaaggcgaggaagtccaggtgatcgctgtggagcctgggaagaaccccaaaaattttcagaccacacctggaaccttccagaccacaacgggcgaaattggggccatcgccctggatttcaagcccggaacctccggcagccccatcattaaccgcgagggcaaggtcgtggggctctatggaaatggcgttgtgacaaaaaacgggggatacgtctccggcatcgctcaaaccaatgccgagcctgacgggccgacacccgaactggaggaagagatgtttaagaaaagaaaccttaccattatggatctgcatcctggcagcggaaagacgcggaaatatctccccgctatcattcgcgaagccatcaagagacggctgagaacactcatcctggcgcctacccgcgtggttgccgctgagatggaggaagcccttaagggcctgcccattcggtaccagaccacagctaccaaatctgagcacacagggagagaaatcgtggacctgatgtgccatgccaccttcacgatgcgcctcctgagccctgtccgggtgccgaattataaccttattatcatggatgaggcccactttacagaccccgcttccattgcggccagaggatacatctctacccgcgttggcatgggggaagctgccgccatcttcatgacagctacccctcccggaacggccgatgcgtttcctcagagcaatgctcccattcaggacgaggagcgggacatcccggaaagatcctggaactctggcaatgagtggattaccgatttcgccgggaagacagtgtggtttgtccctagcatcaaagccggcaacgacattgctaactgtctgcgcaagaatggaaaaaaggtgatccaactctcccggaagaccttcgatacagaataccagaaaaccaagctgaacgactgggattttgtggtcacaaccgacatttctgagatgggcgccaatttcaaagcggatagagttatcgacccccggcgctgcctgaagcccgtgatcctcacggatgggcctgagagagtgattcttgccggacccatgcctgtcacagctgccagcgctgcccagcggcgcggcagagtggggcggaacccgcagaaagaaaatgaccaatatatctttaccggacagcccctgaacaatgatgaggaccatgctcactggaccgaagccaagatgctgctcgacaacattaatacacctgagggcatcattcccgcgctgttcgaacctgagagagagaagtccgccgctatcgatggggaataccgccttaaaggcgagagccggaagaccttcgttgaactgatgagacgcggagacctccccgtgtggctggcccacaaagtcgcttctgagggcatcaagtatacagatcggaaatggtgctttgacgggcagagaaacaatcagattctggaagagaacatggatgtggagatctggacgaaggaaggagagaaaaagaagctccgcccgcggtggcttgacgccagaacctactccgatcctctggccctgaaagaattcaaggactttgctgcgggccgcaaaagcattgccctcgatctggttacagagatcgggagagtgccctctcatcttgctcaccggacccgcaatgccctggacaacctcgtcatgctgcatacatccgaacacggaggcagagcctatcggcacgctgtggaggagctgcctgaaaccatggagacgctccttctgctgggcctcatgattctgcttaccgggggagccatgctgttcctcatcagcggcaaggggatcggaaaaacatccattggcctgatctgtgtcattgcgtctagcgggatgctgtggatggccgaaatccccctccaatggattgcttccgccatcgtgcttgagtttttcatgatggttctgctgattcctgagcccgaaaagcagcgcaccccgcaggataatcaactcgcttacgtggtgatcggaatcctgacacttgccgcgattatcgccgctaacgagatgggcctgctcgaaaccacgaagagagacctgggcatgagcaaagagcctggggtcgtttctcccacatcctatctggatgtggacctccatcccgccagcgcttggaccctttacgccgtggctacaaccgtcattacccctatgctgcggcacacaatcgaaaattctacggccaacgtgagcctggcggccattgctaaccaggccgttgtgctcatgggactggacaagggctggccgatctccaaaatggatcttggggtccccctgctcgctctgggatgctactctcaggtgaatcctctgaccctcacagccgccgtccttctgctgatcacccattatgcgattatcggccccgggctccaggctaaggccacaagagaggctcaaaaacgcaccgccgccggaattatgaagaaccctacggtggacggcatcatgacaattgatctggaccccgttatctacgatagcaagtttgagaaacagcttggccaggtgatgctgctcgtcctgtgtgctgtgcagctgctccttatgcggacctcctgggccctgtgcgaagcgctgaccctcgccacagggcctatcaccacactgtgggagggatctccgggcaagttctggaatacgaccattgctgttagcatggccaacatctttagagggtcctatcttgctggagccggcctggcgttcagcattatgaaatctgtggggacaggaaagcgcggcaccggctcccaaggggaaacactcggagagaaatggaagaagaaactgaatcagctgagccggaaggaatttgacctctacaaaaagtccggcatcaccgaggtcgatagaacggaggccaaagaagggcttaagcggggagagattacccaccatgctgtgtctcgcggcagcgccaaactgcagtggttcgtggaaagaaacatggttatccccgaggggcgggtcattgacctgggatgtggccgcggcgggtggtcctattactgcgctggactcaagaaggtgacagaagtgagaggctataccaaagggggacctggccacgaggagcccgtccctatgtctacatacgggtggaatatcgttaagctgatgagcggaaaagatgtgttttaccttcccccggaaaagtgtgacaccctgctctgcgatatcggcgagtccagcccttctcccacagtggaagagtcccggaccattcgcgtcctgaaaatggtggagccctggctgaagaacaatcagttctgtatcaaggttctcaacccttatatgcccacggtgattgaacaccttgagagactgcaacggaaacatggcgggatgctggtccgcaatcctctcagcagaaactctacacacgaaatgtactggatctccaatggaaccggcaacattgtggccagcgttaatatggtgtctcggctgcttctgaacagattcaccatgacacatcgccggccgacgatcgagaaggacgtcgatctcggggctggaaccagacacgtgaacgccgaacccgagacacctaatatggacgtgatcggcgagcgcattaaacggatcaaggaagagcacaacagcacctggcattatgacgatgaaaatccctacaaaacatgggcgtatcacgggtcctacgaggtcaaggccaccggatctgctagctccatgattaacggcgttgtgaagctgctgacaaaaccttgggacgtggtccccatggtgacccagatggccatgacggataccacaccgtttggccagcaaagagttttcaaggaaaaagtggacacccgcacacctcggagcatgcccgggaccagacgcgtcatggagatcacggctgagtggctctggcggacactgggaagaaataagaaacctcgcctttgcacccgggaagagtttacaaagaaggtgagaaccaacgccgccatgggcgcggttttcacggaagagaatcagtgggattccgctaaagccgccgtggaagacgaggatttttggaagctggtcgaccgcgagagagaactccataaactggggaagtgtggatcttgcgtgtataacatgatgggcaaacgggagaagaaacttggggaattcggcaaggctaagggaagccgcgccatttggtacatgtggctgggcgctagatacctcgagtttgaggccctggggttcctgaatgaagatcactggttttcccgggagaactcttatagcggagttgaaggcgaggggctccataaactgggatacatccttagagacatctccaagattcccggcggggcgatgtatgccgatgacaccgctggctgggacacacggatcaccgaagatgacctgcacaatgaggagaaaattacacagcagatggatcctgaacaccgccaactcgccaacgctatcttcaagctgacctaccagaataaagtggtcaaggtgcagagacccacaccgaccggaacggtcatggacattatctctcggaaggatcagcgcggcagcgggcaagtgggaacatatggccttaacacctttaccaatatggaggcccagctgatcagacagatggaaggggagggagttctctccaaagcggacctggaaaaccctcatctgcccgagaagaaaattacacagtggctcgagaccaagggcgtggaacggctgaaacgcatggccatcagcggggatgactgcgtcgtgaagcccattgatgacagattcgctaacgcccttctggctctcaatgatatgggcaaggtgcggaaagacatccctcaatggcagccgtctaagggatggcacgattggcagcaggttcccttttgttcccatcacttccacgagctgattatgaaagacggccgcaagcttgtggtcccttgcagaccccaagacgaactgatcgggcgggcccgcattagccagggagctggctggtctctcagagagacagcctgtctggggaaagcgtacgcccagatgtggtccctgatgtatttccatcggcgcgatctcagactggctagcaacgccatctgctctgccgtgcctgttcactgggtgcccacgtcccggaccacatggagcatccatgctcaccatcaatggatgaccacagaagacatgcttaccgtctggaatagagtgtggattgaggataacccttggatggaggacaagacgcccgtcaccacatgggaaaatgtgccgtacctgggaaagcgcgaggatcagtggtgtggctccctcatcgggctgaccagccgggccacatgggcgcagaacattcctaccgctatccagcaagttagatctcttattggcaatgaagagtttctggactacatgcccagcatgaaacgcttccggaaggaggaagagtccgaaggagccatctggtga

SEQ ID NO: 20424 - RNA, 9873 nt, synthetic construct
  misc_feature 1..9873: note = derived and/or modified CDS sequence (opt5) from DENV-3__GQ868547__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgttgggggagtcctcaacagcctgggcaaaatggtgcatcagatttttgggtctgcctacaccgctctgttctccggcgtgagctgggtcatgaagatcggaattggcatcctcctgacctggattgggcttaattctaaaaacacaagcatgtccttttcttgcatcgccatcggaattatcaccctgtatctcggcgctgtggttcaggccgacatggggtgtgtgattaattggaagggaaaagagctgaagtgcggcagcgggatcttcgtcacaaacgaggtgcacacgtggaccgaacagtacaagtttcaagcggattcccccaaacgcctggccacagctattgccggcgcttgggagaatggagtttgtggcatccggagcaccacaagaatggaaaaccttctctggaagcagatcgccaatgagctgaactatattctgtgggaaaataacatcaaactcaccgtggtcgtgggggacattatcggagttctggagcagggcaagcgcacgcttacccctcagcccatggagctgaaatactcttggaagacatgggggaaagccaagatggtgaccgctgaaacacaaaactccagcttcattatcgatggacctaatacccccgagtgcccgtctgcgtcccgggcctggaacgtctgggaagtggaggactatggctttggcgtgttcacaaccaatatctggctcaagctgagagaagtccatacgcagctgtgtgaccaccgccttatgagcgctgccgttaaagatgagcgggccgtgcacgctgacatggggtactggattgagtcccagaagaacggatcttggaaactcgaaaaggccagcctgatcgaggtgaaaacatgcacctggcctaagtcccataccctgtggtctaatggcgtcctcgaaagcgatatgattatccccaagtccctggcggggcctattagccagcacaaccatagacccggataccacacacaaaccgctggcccttggcaccttgggaaactggagctcgactttaattattgcgagggaacgacagtggttatcaccgaaaactgtggcacacgcggcccctctctgcggaccacaaccgtgtccgggaagctgatccatgagtggtgctgtagaagctgcacgcttccgcctctccggtacatgggagaagatggctgttggtatgggatggagattcgccccatctctgaaaaagaggagaatatggtcaagtccctggtgagcgccggatctggcaaagttgacaacttcaccatgggggtgctgtgcctcgccattctgtttgaagaggtcatgagaggaaagttcggcaagaaacacatgatcgctggcgtgttctttacattcgttcttctgctcagcgggcagattacctggcgggatatgacacataccctgatcatgattggatccaatgccagcgacagaatgggcatgggggtgacgtacctggcgcttatcgctacatttaagatccagcccttcctggccctcggatttttcctgcgcaaactcacctctcgggaaaacctgcttctgggcgtcgggctcgccatggctacaaccctgcaactgcctgaggatattgaacagatggccaatggaatcgctcttggcctgatggccctcaagctgattacccagtttgagacatatcagctctggacggcgctgatctcccttacctgtagcaacacaatgttcaccctgacagtggcctggagaaccgctacgctcattctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccatcctggcgtctagcctcctgcgcaacgacgttcctatggccgggccccttgtggctggaggcctgctcattgcctgttacgtcatcaccgggacatccgccgatctgaccgtggaaaaagctgccgacattacatgggaggaagaggcggaacagacgggagttagccacaacctcatgatcaccgtggacgatgacggcacaatgagaattaaggatgacgagaccgagaatatcctgacagtccttctgaaaaccgctctgctcatcgtgtctggcgtctttccgtattccattcctgccacgctgcttgtgtggcatacctggcagaagcagacacaacggagcggggttctgtgggatgtgccctctcctcccgaaacccagaaagccgagctcgaagagggagtctaccgcatcaagcagcagggcattttcgggaaaacacaagtgggagttggcgtgcagaaggagggggtctttcacaccatgtggcacgtgacaagaggagctgtgctgacgtacaacggcaagcggctcgaaccgaattgggcctccgttaaaaaggacctgatcagctatggcgggggatggcgcctttctgcgcagtggcaaaaaggcgaggaagtccaggtgattgctgtggagcctgggaagaaccccaaaaatttccagaccacacctggaaccttccagaccacaacgggcgaaatcggggccattgccctggattttaagcccggaacctccggcagccccatcatcaacagagagggcaaggtcgtggggctgtacggaaatggcgttgtgacaaaaaacgggggatatgtctccggcattgctcaaaccaatgccgagcctgacgggccgacacccgaactcgaggaagagatgttcaagaaacggaacctgaccatcatggatcttcatcctggcagcggaaagacgcgcaaatacctgcccgctattatcagagaagccattaagcggagactccgcacactgatcctcgcgcctacccgggtggttgccgctgagatggaggaagccctgaagggccttcccatcagatatcagaccacagctaccaaatctgagcacacagggcgcgaaattgtggacctgatgtgccatgccacctttacgatgcggctgctcagccctgtcagagtgccgaattacaacctgatcattatggatgaggcccacttcacagaccccgcttccatcgcggcccgcggatatatttctacccgggttggcatgggggaagctgccgccatctttatgacagctacccctcccggaacggccgatgcgttccctcagagcaatgctcccatccaggacgaggagagagacattccggaacgctcctggaactctggcaatgagtggatcaccgattttgccgggaagacagtgtggttcgtccctagcattaaagccggcaacgacatcgctaactgtcttcggaagaatggaaaaaaggtgattcaactgtccagaaagacctttgatacagaataccagaaaaccaagctcaacgactgggatttcgtggtcacaaccgacatctctgagatgggcgccaattttaaagcggatcgggttattgacccccgcagatgcctgaagcccgtgatcctgacggatgggcctgagcgggtgatcctcgccggacccatgcctgtcacagctgccagcgctgcccagcgcagaggccgggtggggagaaacccgcagaaagaaaatgaccaatacattttcaccggacagccccttaacaatgatgaggaccatgctcactggaccgaagccaagatgctgctggacaacatcaatacacctgagggcattatccccgcgctcttcgaacctgagcgcgagaagtccgccgctattgatggggaatatcggctgaaaggcgagagcagaaagacctttgttgaacttatgcgccggggagacctgcccgtgtggctcgcccacaaagtcgcttctgagggcatcaagtacacagatagaaaatggtgcttcgacgggcagcgcaacaatcagatcctggaagagaacatggatgtggagatttggacgaaggaaggagagaaaaagaagctgcggccgagatggctcgacgcccgcacctattccgatcctcttgccctgaaagaatttaaggacttcgctgcgggcagaaaaagcatcgccctggatctcgttacagagattgggcgggtgccctctcatctggctcaccgcaccagaaatgcccttgacaacctggtcatgctccatacatccgaacacggaggccgggcctaccgccacgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcaatggatcgcttccgccattgtgctcgagttctttatgatggttcttctgatccctgagcccgaaaagcagagaaccccgcaggataatcaactggcttatgtggtgattggaatcctcacactggccgcgatcattgccgctaacgagatgggccttctggaaaccacgaagcgggacctcggcatgagcaaagagcctggggtcgtttctcccacatcctacctggatgtggacctgcatcccgccagcgcttggaccctctatgccgtggctacaaccgtcatcacccctatgcttagacacacaattgaaaattctacggccaacgtgagcctggcggccatcgctaaccaggccgttgtgctgatgggactcgacaagggctggccgatttccaaaatggatctgggggtcccccttctggctctcggatgctactctcaggtgaatcctctgaccctgacagccgccgtcctccttctgatcacccattacgcgatcattggccccgggctgcaggctaaggccacacgcgaggctcaaaaacggaccgccgccggaatcatgaagaaccctacggtggacggcattatgacaatcgatctcgaccccgttatttatgatagcaagttcgagaaacagctgggccaggtgatgcttctggtcctctgtgctgtgcagctgctgctcatgagaacctcctgggccctttgcgaagcgctgaccctggccacagggcctatcaccacactctgggagggatctccgggcaagttttggaatacgaccatcgctgttagcatggccaacattttccgcgggtcctacctggctggagccggccttgcgtttagcatcatgaaatctgtggggacaggaaagcggggcaccggctcccaaggggaaacactgggagagaaatggaagaagaaactcaatcagctgagcagaaaggaattcgacctgtataaaaagtccggcattaccgaggtcgatcggacggaggccaaagaagggctcaagcgcggagagatcacccaccatgctgtgtctagaggcagcgccaaacttcagtggtttgtggaacggaacatggttattcccgaggggcgcgtcatcgacctgggatgtggcagaggcgggtggtcctactattgcgctggactgaagaaggtgacagaagtgcggggctacaccaaagggggacctggccacgaggagcccgtccctatgtctacatatgggtggaatattgttaagctcatgagcggaaaagatgtgttctacctgcccccggaaaagtgtgacacccttctgtgcgatatcggcgagtccagcccttctcccacagtggaagagtcccgcaccatcagagtcctcaaaatggtggagccctggctgaagaacaatcagttctgtattaaggttctgaacccttacatgcccacggtgatcgaacacctcgagcggcttcaacgcaaacatggcgggatgctggtcagaaatcctctgagccggaactctacacacgaaatgtattggatttccaatggaaccggcaacatcgtggccagcgttaatatggtgtctagactcctgcttaaccgctttaccatgacacatcggagaccgacgattgagaaggacgtcgatctgggggctggaacccgccacgtgaacgccgaacccgagacacctaatatggacgtgatcggcgagcggatcaaaagaattaaggaagagcacaacagcacctggcattacgacgatgaaaatccctataaaacatgggcgtaccacgggtcctatgaggtcaaggccaccggatctgctagctccatgatcaacggcgttgtgaagctcctgacaaaaccttgggacgtggtccccatggtgacccagatggccatgacggataccacaccgttcggccagcaacgcgtttttaaggaaaaagtggacacccggacacctagaagcatgcccgggacccgccgggtcatggagattacggctgagtggctgtggagaacactcggacgcaataagaaacctcggctgtgcaccagagaagagttcacaaagaaggtgcgcaccaacgccgccatgggcgcggtttttacggaagagaatcagtgggattccgctaaagccgccgtggaagacgaggatttctggaagcttgtcgacagagagcgggaactgcataaactcgggaagtgtggatcttgcgtgtacaacatgatgggcaaacgcgagaagaaactgggggaatttggcaaggctaagggaagcagagccatctggtatatgtggcttggcgctcggtacctggagttcgaggccctcgggtttctgaatgaagatcactggttctccagagagaactcttacagcggagttgaaggcgaggggctgcataaactcggatatattctgcgggacatctccaagatccccggcggggcgatgtacgccgatgacaccgctggctgggacacacgcattaccgaagatgaccttcacaatgaggagaaaatcacacagcagatggatcctgaacacagacaactggccaacgctatttttaagctcacctatcagaataaagtggtcaaggtgcagcggcccacaccgaccggaacggtcatggacatcatttctcgcaaggatcagagaggcagcgggcaagtgggaacatacggcctgaacaccttcaccaatatggaggcccagcttatccggcagatggaaggggagggagttctgtccaaagcggacctcgaaaaccctcatctgcccgagaagaaaatcacacagtggctggagaccaagggcgtggaacgcctcaaaagaatggccattagcggggatgactgcgtcgtgaagcccatcgatgaccggtttgctaacgccctgcttgctctgaatgatatgggcaaggtgcgcaaagacattcctcaatggcagccgtctaagggatggcacgattggcagcaggttcccttctgttcccatcacttccacgagctcatcatgaaagacggcagaaagctggtggtcccttgccggccccaagacgaacttattgggcgcgccagaatcagccagggagctggctggtctctgcgggagacagcctgtctcgggaaagcgtatgcccagatgtggtccctgatgtactttcatcgcagagatctgcggctcgctagcaacgccatttgctctgccgtgcctgttcactgggtgcccacgtccagaaccacatggagcatccatgctcaccatcaatggatgaccacagaagacatgctgaccgtctggaatcgcgtgtggatcgaggataacccttggatggaggacaagacgcccgtcaccacatgggaaaatgtgccgtatcttggaaagcgggaggatcagtggtgtggctccctgattgggctcaccagcagagccacatgggcgcagaacatccctaccgctattcagcaagttcgctctctgatcggcaatgaagagttccttgactacatgcccagcatgaaacggtttagaaaggaggaagagtccgaaggagccatttggtga

SEQ ID NO: 20425 - RNA, 9873 nt, synthetic construct
  misc_feature 1..9873: note = derived and/or modified CDS sequence (opt5) from DENV-3__GU131857__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgttgggggagtcctcaacagcctgggcaaaatggtgcatcagatttttgggtctgcctacaccgctctgttctccggcgtgagctgggtcatgaagatcggaattggcatcctcctgacctggattgggcttaattctaaaaacacaagcatgtccttttcttgcatcgccatcggaattatcaccctgtatctcggcgctgtggttcaggccgacatggggtgtgtgattaattggaagggaaaagagctgaagtgcggcagcgggatcttcgtcacaaacgaggtgcacacgtggaccgaacagtacaagtttcaagcggattcccccaaacgcctggccacagctattgccggcgcttgggagaatggagtttgtggcatccggagcaccacaagaatggaaaaccttctctggaagcagatcgccaatgagctgaactatattctgtgggaaaataacatcaaactcaccgtggtcgtgggggacattatcggagttctggagcagggcaagcgcacgcttacccctcagcccatggagctgaaatactcttggaagacatgggggaaagccaagattgtgaccgctgaaacacaaaactccagcttcatcatcgatggacctaatacccccgagtgcccgtctgcgtcccgggcctggaacgtctgggaagtggaggactatggctttggcgtgttcacaaccaatatttggctcaagctgagagaagtctacacgcagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacatgcacctggcctaagtcccacaccctgtggtctaatggcgtcctcgaaagcgatatgatcattcccaagtccctggcggggcctatcagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgattcacgagtggtgctgtagaagctgcacgcttccgcctctccggtatatgggagaagatggctgttggtacgggatggagatccgccccatttctgaaaaagaggagaatatggtcaagtccctggtgagcgccggatctggcaaagttgacaacttcaccatgggggtgctgtgcctcgccatcctgtttgaagaggtcatgagaggaaagttcggcaagaaacatatgattgctggcgtgttctttacattcgttcttctgctcagcgggcagatcacctggcgggatatgacacacaccctgattatgatcggatccaatgccagcgacagaatgggcatgggggtgacgtatctggcgcttatcgctacatttaagattcagcccttcctggccctcggatttttcctgcgcaaactcacctctcgggaaaacctgcttctgggcgtcgggctcgccatggctacaaccctgcaactgcctgaggatatcgaacagatggccaatggaattgctcttggcctgatggccctcaagctgatcacccagtttgagacataccagctctggacggcgctgatttcccttacctgtagcaacacaatgttcaccctgacagtggcctggagaaccgctacgctcatcctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccattctggcgtctagcctcctgcgcaacgacgttcctatggccgggccccttgtggctggaggcctgctcatcgcctgttatgtcattaccgggacatccgccgatctgaccgtggaaaaagctgccgacatcacatgggaggaagaggcggaacagacgggagttagccataacctcatgattaccgtggacgatgacggcacaatgagaatcaaggatgacgagaccgagaatatcctgacagtccttctgaaaaccgctctgctcattgtgtctggcgtctttccgtactccatccctgccacgctgcttgtgtggcacacctggcagaagcagacacaacggagcggggttctgtgggatgtgccctctcctcccgaaacccagaaagccgagctcgaagagggagtctaccgcattaagcagcagggcatcttcgggaaaacacaagtgggagttggcgtgcagaaggagggggtctttcataccatgtggcacgtgacaagaggagctgtgctgacgtataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagaccacacctggaaccttccagaccacaacgggcgaaattggggccatcgccctggattttaagcccggaacctccggcagccccatcattaacagagagggcaaggtcgtggggctgtatggaaatggcgttgtgacaaaaaacgggggatacgtctccggcatcgctcaaaccaatgccgagcctgacgggccgacacccgaactcgaggaagagatgttcaagaaacggaacctgaccattatggatcttcaccctggcagcggaaagacgcgcaaatatctgcccgctatcattagagaagccatcaagcggagactccgcacactgatcctcgcgcctacccgggtggttgccgctgagatggaggaagccctgaagggccttcccattagataccagaccacagctaccaaatctgagcatacagggcgcgaaatcgtggacctgatgtgccacgccacctttacgatgcggctgctcagccctgtcagagtgccgaattataacctgattatcatggatgaggcccatttcacagaccccgcttccattgcggcccgcggatacatctctacccgggttggcatgggggaagctgccgccatctttatgacagctacccctcccggaacggccgatgcgttccctcagagcaatgctcccattcaggacgaggagagagacatcccggaacgctcctggaactctggcaatgagtggattaccgattttgtggggaagacagtctggttcgtgcctagcatcaaagccggcaacgacattgccaactgtcttcggaagaatggaaaaaaggtgatccaactgtccagaaagacctttgatacagaataccagaaaaccaagctcaacgactgggatttcgtcgttacaaccgacatttctgagatgggcgctaattttaaagccgatcgggtgatcgacccccgcagatgcctgaagcccgtgatcctgacggatgggcctgagcgggtcattctcgcgggacccatgcctgtgacagccgctagcgccgctcagcgcagaggccgggttgggagaaacccgcagaaagaaaatgaccaatatatcttcaccggacagccccttaacaatgatgaggaccacgcccattggaccgaagctaagatgctgctggacaacattaatacacctgagggcatcattcccgccctcttcgaacctgagcgcgagaagtccgcggccatcgatggggaataccggctgaaaggcgagagcagaaagacctttgtggaacttatgcgccggggagacctgcccgtctggctcgctcacaaagtggcctctgagggcatcaagtatacagatagaaaatggtgcttcgacgggcagcgcaacaatcagattctggaagagaacatggatgttgagatctggacgaaggaaggagagaaaaagaagctgcggccgagatggctcgacgctcgcacctactccgatcctcttgccctgaaagaatttaaggacttcgccgctggcagaaaaagcattgcgctggatctcgtgacagagatcgggcgggtcccctctcacctggcccatcgcaccagaaatgctcttgacaacctggtgatgctccacacatccgaacatggaggccgggcctatcgccacgccgtcgaggagctgcctgaaaccatggagacgctgctccttctgggcctgatgattctcctgaccgggggagctatgctttttctgatcagcggcaaggggatcggaaaaacatccattggcctcatctgtgtgattgcctctagcgggatgctgtggatggcggaaatccccctgcaatggattgcctccgctatcgttctcgagttctttatgatggtgcttctgattcctgagcccgaaaagcagagaaccccgcaggataatcaactggcctacgtggtcatcggaatcctcacactggctgccattatcgcggccaacgagatgggccttctggaaaccacgaagcgggacctcggcatgagcaaagagcctggggttgtgtctcccacatcctatctggatgtggacctgcaccccgctagcgcctggaccctctacgctgtcgccacaaccgtgattacccctatgcttagacatacaatcgaaaattctacggctaacgttagcctggccgcgattgccaaccaggctgtggtcctgatgggactcgacaagggctggccgatctccaaaatggatctgggggtgccccttctggccctcggatgctactctcaggtcaatcctctgaccctgacagctgccgtgctccttctgatcacccactatgccattatcggccccgggctgcaggcgaaggctacacgcgaggcccaaaaacggaccgctgccggaattatgaagaaccctacggttgacggcatcatgacaattgatctcgaccccgtgatctacgatagcaagttcgagaaacagctgggccaggtcatgcttctggtgctctgtgccgttcagctgctgctcatgagaacctcctgggctctttgcgaagccctgaccctggcgacagggcctatcaccacactctgggagggatctccgggcaagttttggaatacgaccattgccgtgagcatggctaacatcttccgcgggtcctatctggccggagctggccttgcctttagcattatgaaatctgtcgggacaggaaagcggggcaccggctcccaaggggaaacactgggagagaaatggaagaagaaactcaatcagctgagcagaaaggaattcgacctgtacaaaaagtccggcatcaccgaggtggatcggacggaggcgaaagaagggctcaagcgcggagagattacccatcacgccgtgtctagaggcagcgctaaacttcagtggtttgttgaacggaacatggtcatccccgaggggcgcgtgattgacctgggatgtggcagaggcgggtggtcctattactgcgccggactgaagaaggtgacagaagtccggggctataccaaagggggacctggccatgaggagcccgttcctatgtctacatacgggtggaatatcgtgaagctcatgagcggaaaagatgtgttctacctgcccccggaaaagtgtgacacccttctgtgcgatatcggcgagtccagcccttctcccacagtcgaagagtcccgcaccattagagtgctcaaaatggttgagccctggctgaagaacaatcagttctgtatcaaggtgctgaacccttatatgcccacggtcattgaacacctcgagcggcttcaacgcaaacacggcgggatgctggtgagaaatcctctgagccggaactctacacatgaaatgtactggatctccaatggaaccggcaacattgttgctagcgtgaatatggtctctagactcctgcttaaccgctttaccatgacacaccggagaccgacgatcgagaaggacgtggatctgggggccggaacccgccatgtgaacgctgaacccgagacacctaatatggacgtcatcggcgagcggattaaaagaatcaaggaagagcacaacagcacctggcactatgacgatgaaaatccctacaaaacatgggcctatcatgggtcctacgaggttaaggcgaccggatctgccagctccatgattaacggcgtggtgaagctcctgacaaaaccttgggacgtcgtgcccatggttacccagatggctatgacggataccacaccgttcggccagcaacgcgtgtttaaggaaaaagtcgacacccggacacctagaagcatgcccgggacccgccgggtgatggagatcacggccgagtggctgtggagaacactcggacgcaataagaaacctcggctgtgcaccagagaagagttcacaaagaaggttcgcaccaacgctgccatgggcgccgtgtttacggaagagaatcagtgggattccgcgaaagctgccgtcgaagacgaggatttctggaagcttgtggacagagagcgggaactgcacaaactcgggaagtgtggatcttgcgtttataacatgatgggcaaacgcgagaagaaactgggggaatttggcaaggccaagggaagcagagctatttggtacatgtggcttggcgcccggtacctggagttcgaggctctcgggtttctgaatgaagatcattggttctccagagagaactcttatagcggagtggaaggcgaggggctgcacaaactcggatacatcctgcgggacatctccaagattcccggcggggccatgtatgcggatgacaccgccggctgggacacacgcatcaccgaagatgaccttcataatgaggagaaaattacacagcagatggatcctgaacacagacaactggctaacgccatctttaagctcacctaccagaataaagtcgtgaaggtccagcggcccacaccgaccggaacggtgatggacattatctctcgcaaggatcagagaggcagcgggcaagttggaacatatggcctgaacaccttcaccaatatggaggctcagcttatccggcagatggaaggggagggagtgctgtccaaagccgacctcgaaaaccctcacctgcccgagaagaaaattacacagtggctggagaccaagggcgtcgaacgcctcaaaagaatggcgatcagcggggatgactgcgtggtgaagcccattgatgaccggtttgccaacgctctgcttgccctgaatgatatgggcaaggttcgcaaagacatccctcaatggcagccgtctaagggatggcatgattggcagcaggtgcccttctgttcccaccatttccacgagctcattatgaaagacggcagaaagctggtcgtgccttgccggccccaagacgaacttatcgggcgcgctagaattagccagggagccggctggtctctgcgggagacagcttgtctcgggaaagcctacgcgcagatgtggtccctgatgtattttcaccgcagagatctgcggctcgccagcaacgctatctgctctgccgttcctgtgcattgggtccccacgtccagaaccacatggagcatccacgcccatcaccaatggatgaccacagaagacatgctgaccgtgtggaatcgcgtctggattgaggataacccttggatggaggacaagacgcccgtgaccacatgggaaaatgttccgtaccttggaaagcgggaggatcagtggtgtggctccctgatcgggctcaccagcagagctacatgggcccagaacattcctaccgcgatccagcaagtgcgctctctgattggcaatgaagagttccttgactacatgcccagcatgaaacggtttagaaaggaggaagagtccgaaggagctatctggtga

SEQ ID NO: 20426 - RNA, 9873 nt, synthetic construct
  misc_feature 1..9873: note = derived and/or modified CDS sequence (opt5) from DENV-3__GU131858__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcattaagaaagaggaacccgtgaacatcgaggccgaacctccgttcggcgagtccaatattgtgatcgggatcggcgataacgccctgaagattaattggtataaaaagggatctagcatcggcaagatgtttgaagctaccgcccgcggggctcggagaatggccattcttggagacacggcgtgggatttcggctccgttgggggagtcctcaacagcctgggcaaaatggtgcatcagatctttgggtctgcctacacagctctgttctccggcgtgagctgggtcatgaagattggaatcggcattctcctgacctggatcgggcttaattctaaaaacaccagcatgtccttttcttgcatcgccattggaatcattacactgtatctcggcgctgtggttcaggccgacatcgggtgtgtgattaattggaagggaaaagagctgaagtgcggcagcgggatcttcgtcaccaacgaggtgcacacatggacggaacagtacaagtttcaagcggattcccccaaacgcctggccaccgctatcgccggcgcttgggagaatggagtttgtggcattcggagcacaaccagaatggaaaaccttctctggaagcagatcgccaatgagctgaactatattctgtgggaaaataacatcaaactcacagtggtcgtgggggacattatcggagttctggagcagggcaagcgcacccttacgcctcagcccatggagctgaaatactcttggaagacctgggggaaagccaagatcgtgacagctgaaacccaaaactccagcttcattatcgatggacctaatacacccgagtgcccgtctgcgtcccgggcctggaacgtctgggaagtggaggactatggctttggcgtgttcaccacaaatatttggctcaagctgagagaagtctacacccagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacgtgcacatggcctaagtcccacaccctgtggtctaatggcgtcctcgaaagcgatatgatcatccccaagtccctggcggggcctattagccagcataaccacagacccggatatcatacccaaacagctggcccttggcaccttgggaaactggagctcgactttaattactgcgagggaaccacggtggttatcacagaaaactgtggcacctctggcccctccctgacaaccacaaccgtgagcgggaagctgattcacgagtggtgctgtcgctcttgcacgcttccgcctctccggtatatgggagaagatggctgttggtacgggatggagatcagacccatttccgaaaaagaggagaatatggtcaagagcctggtgtctgccggaagcggcaaagttgacaacttcaccatgggggtgctgtgcctcgccatcctgtttgaagaggtcatgcggggaaagttcggcaagaaacatatgattgctggcgtgttctttacattcgttcttctgctctccgggcagatcacctggcgcgatatgacacacaccctgatcatgattggaagcaatgcctctgacagaatgggcatgggggtgacgtatctggcgcttatcgctacatttaagattcagcccttcctggccctcggatttttcctgcggaaactcacctccagagaaaacctgcttctgggcgtcgggctcgccatggctacaaccctgcaactgcctgaggatatcgaacagatggccaatggaattgctcttggcctgatggccctcaagctgatcacccagtttgagacataccagctctggacggcgctgatcagccttacctgttccaacacaatgttcaccctgacagtggcctggcgcaccgctacgctcattctggccggcgtgtctctgcttccggtctgccaaagctcctctatgcggaaaacagactggctgcccatggctgttgccgccatgggggtgcctcccctccctctgtttatcttcagcctcaaggataccctgaagagacgctcctggccccttaatgagggagtgatggctgtcggcctggtgtctattctggcgagctccctcctgagaaacgacgttcctatggccgggccccttgtggctggaggcctgctcatcgcctgttatgtcattaccgggacaagcgccgatctgaccgtggaaaaagctgccgacatcacatgggaggaagaggcggaacagacgggagtttctcataacctcatgatcaccgtggacgatgacggcacaatgcggattaaggatgacgagaccgagaatatcctgacagtccttctgaaaaccgctctgctcattgtgtccggcgtctttccgtacagcatccctgccacgctgcttgtgtggcacacctggcagaagcagacacaacgctctggggttctgtgggatgtgccctcccctcccgaaacccagaaagccgagctcgaagagggagtctacagaattaagcagcagggcatcttcgggaaaacacaagtgggagttggcgtgcagaaggagggggtctttcataccatgtggcacgtgacacggggagctgtgctgacgtataacggcaagcgcctcgaaccgaattgggccagcgttaaaaaggacctgatttcttacggcgggggatggagactttccgcgcagtggcaaaaaggcgaggaagtccaggtgatcgctgtggagcctgggaagaaccccaaaaatttccagaccatgcctggaacattccagaccaccacaggcgaaatcggggccattgccctggattttaagcccggaacgagcggctcccccatcattaaccgggagggcaaggtcgtggggctgtatggaaatggcgttgtgaccaaaaacgggggatacgtcagcggcatcgctcaaacaaatgccgagcctgacgggccgacccccgaactcgaggaagagatgttcaagaaacgcaacctgacaattatggatcttcaccctggctctggaaagaccagaaaatatctgcccgctatcatccgggaagccattaagcgcagactccggacgctgatcctcgcgcctacaagagtggttgccgctgagatggaggaagccctgaagggccttcccattcgctaccagaccaccgctacaaaaagcgagcataccgggcgggaaatcgtggacctgatgtgccacgccacatttaccatgagactgctctcccctgtccgcgtgccgaattataacctgattatcatggatgaggcccatttcacggaccccgcttctatcgcggcccggggatacattagcacaagagttggcatgggggaagctgccgccatctttatgaccgctacacctcccggaaccgccgatgcgttccctcagtccaatgctcccattcaggacgaggagcgcgacatcccggaacggtcttggaacagcggcaatgagtggattacggattttgtggggaagaccgtctggttcgtgccttccatcaaagccggcaacgacattgccaactgtcttagaaagaatggaaaaaaggtgatccaactgtctcgcaagacatttgataccgaataccagaaaacaaagctcaacgactgggatttcgtcgttaccacagacatcagcgagatgggcgctaattttaaagccgatcgggtgattgaccccagacggtgcctgaagcccgtgatcctgaccgatgggcctgagcgcgtcattctcgcgggacccatgcctgtgacggccgcttccgccgctcagagacggggccgcgttgggagaaacccgcagaaagaaaatgaccaatatatcttcacaggacagccccttaacaatgatgaggaccacgcccattggaccgaagctaagatgctgctggacaacattaatacccctgagggcatcatccccgccctcttcgaacctgagcgggagaagagcgcggccattgatggggaatacagactgaaaggcgagtctcgcaagacatttgtggaacttatgcggagaggagacctgcccgtctggctcgctcacaaagtggcctccgagggcatcaagtataccgatcgcaaatggtgcttcgacgggcagcggaacaatcagattctggaagagaacatggatgttgagatctggacaaaggaaggagagaaaaagaagctgagaccgcgctggctcgacgctcggacgtacagcgatcctcttgccctgaaagaatttaaggacttcgccgctggcagaaaatctattgcgctggatctcgtgaccgagatcgggcgcgtcccctcccacctggcccatagaacacggaatgctcttgacaacctggtgatgctccacaccagcgaacatggaggccgcgcctatagacacgccgtcgaggagctgcctgaaacaatggagaccctgctccttctgggcctgatgatcctcctgacggggggagctatgctttttctgatttccggcaaggggatcggaaaaacctctattggcctcatctgtgtgattgccagctccgggatgctgtggatggcggaaatccccctgcaatggattgccagcgctatcgttctcgagttctttatgatggtgcttctgatccctgagcccgaaaagcagcggacaccgcaggataatcaactggcctacgtggtcattggaatcctcaccctggctgccattatcgcggccaacgagatgggccttctggaaacaaccaagcgcgacctcggcatgtctaaagagcctggggttgtgtcccccaatagctatctggatgtggacctgcaccccgcttctgcctggacgctctacgctgtcgccacaaccgtgattacacctatgcttagacataccatcgaaaacagcaccgctaacgtttccctggccgcgatcgccaatcaggctgtggtcctgatgggactcgacaagggctggccgatttctaaaatggatctgggggtgccccttctggccctcggatgctacagccaggtcaaccctctgacactgacggctgccgtgctccttctgatcacccactatgccattatcggccccgggctgcaggcgaaggctacacgggaggcccaaaaaagaaccgctgccggaattatgaagaatcctacagttgacggcatcatgaccatcgatctcgaccccgtgatttacgattccaagttcgagaaacagctgggccaggtcatgcttctggtgctctgtgccgttcagctgctgctcatgcgcacgtcttgggctctttgcgaagccctgacactggcgaccgggcctatcaccacactctgggagggaagcccgggcaagttttggaacaccacaattgccgtgtccatggctaatatcttccgggggagctatctggccggagctggccttgccttttctattatgaaatccgtcgggacgggaaagagaggcaccggcagccaaggggaaacactgggagagaaatggaagaagaaactcaaccagctgtcccgcaaggaattcgacctgtacaaaaagtctggcatcaccgaggtggatcggacagaggcgaaagaagggctcaagagaggagagattacccatcacgccgtgagccggggctccgctaaacttcagtggtttgttgaacgcaatatggtcatccccgaggggagagtgatcgacctgggatgtggccggggcgggtggtcttattactgcgccggactgaagaaggtgacggaagtccgcggctataccaaagggggacctggccatgaggagcccgttcctatgagcacatacgggtggaacattgtgaagctcatgtccggaaaagatgtgttctacctgcccccggaaaagtgtgacacccttctgtgcgatatcggcgagagctctccttcccccacagtcgaagagagcagaaccattcgggtgctcaaaatggttgagccctggctgaagaataaccagttctgtatcaaggtgctgaatccttatatgcccacagtcattgaacacctcgagcgccttcaaagaaaacacggcgggatgctggtgcggaaccctctgtctcgcaattccacccatgaaatgtactggatcagcaacggaacgggcaatatcgttgcttctgtgaacatggtcagcagactcctgcttaaccggtttacaatgacccacagacgcccgaccattgagaaggacgtggatctgggggccggaacacggcatgtgaatgctgaacccgagacgcctaacatggacgtcatcggcgagagaattaaacgcatcaaggaagagcacaattccacctggcactatgacgatgaaaacccctacaaaacatgggcctatcatgggtcttacgaggttaaggcgaccggaagcgcctccagcatgattaatggcgtggtgaagctcctgacaaaaccttgggacgtcgtgcccatggttacccagatggctatgacagataccacgccgttcggccagcaacgggtgtttaaggaaaaagtcgacaccagaacacctcgctccatgcccgggacccggagagtgatgggaatcacagccgagtggctgtggcgcaccctcggccggaacaagaaacctagactgtgcacgcgcgaggaattcacaaagaaggttcggaccaatgctgccatgggggccgtgtttacagaggaaaaccagtgggattctgcgaaagctgccgtcgaggacgaagatttctggaagcttgtggacagagagcgcgagctgcacaaactcggaaagtgtggcagctgcgtttataatatgatggggaaaagagaaaagaaactgggcgagtttggaaaggccaagggctcccgggctatctggtacatgtggcttggggcccgctacctggaattcgaggctctcggatttctgaacgaggatcattggttctctagagaaaatagctattccggcgtggagggggaaggactgcacaaactcggctacattctgcgggacatctctaagattcccgggggcgccatgtatgcggatgacaccgccggatgggacacgagaatcaccgaggatgaccttcataacgaagagaaaattacacagcagatggatcctgagcaccggcaactggctaatgccatctttaagctcacctaccagaacaaagtcgtgaaggtccagcgccccacaccgaccggcacagtgatggacatcattagcagaaaggatcagcgggggtccggacaagttggcacctatgggctgaatacgttcacaaacatggaagctcagcttatccgccagatggagggagaaggcgtgctgagcaaagccgacctcgagaaccctcacctgcccgaaaagaaaattacccagtggctggagaccaagggggtcgagagactcaaacggatggcgatctctggcgatgactgcgtggtgaagcccattgatgaccgctttgccaatgctctgcttgccctgaacgatatgggaaaggttagaaaagacatccctcaatggcagccgtccaagggctggcatgattggcagcaggtgcccttctgtagccaccatttccacgaactcattatgaaagacgggcggaagctggtcgtgccttgccgcccccaagacgagcttatcggaagagctcggatctctcagggcgccgggtggtccctgcgcgaaacagcttgtctcggaaaagcctacgcgcagatgtggagcctgatgtattttcacagacgggatctgcgcctcgcctctaatgctatttgctccgccgttcctgtgcattgggtccccaccagcagaacaacgtggtccatccacgcccatcaccaatggatgaccacagaggacatgctgaccgtgtggaaccgggtctggattgaagataatccttggatggaggacaagacacccgtgaccacgtgggagaacgttccgtaccttggcaagagagaagatcagtggtgtgggagcctgatcggcctcacctctcgcgctacatgggcccagaatattcctaccgcgatccagcaagtgcggagcctgatcggaaacgaggaattccttgactacatgccctccatgaaaagatttcgcaaggaggaggaatctgagggcgctatttggtga

SEQ ID NO: 20427 - RNA, 9873 nt, synthetic construct
  misc_feature 1..9873: note = derived and/or modified CDS sequence (opt5) from DENV-3__GQ868548__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagcacgaaaatctcaagtatacagtgatcatcaccgttcatacaggggaccagcaccaggtgggaaacgagacgcaaggcgtcaccgctgaaattacacctcaggcctctaccacagaggctatcctgcccgaatacggcaccctggggctcgagtgctcccctagaacgggactggacttcaatgagatgattcttctgaccatgaaaaacaaggcctggatggtgcatcggcagtggtttttcgatctccccctgccgtggacaagcggcgccaccacagaaacccctacgtggaatcgcaaagagcttctggtcacatttaagaacgctcacgcgaaaaagcaagaagtggttgtgctcgggtctcaggagggagccatgcacaccgctctgacaggcgccaccgaaatccagaattccgggggcaccagcattttcgccggacatctgaagtgtagactcaaaatggacaagctggagcttaaaggcatgtcttatgctatgtgcacaaacacgtttgtcctgaagaaagaggtgtccgaaacccagcacgggacaatcctcatcaaggttgagtaccggggagaagatgccccctgtaagattcctttcagcaccgaggacggccaagggaaagcgcataacggaagactgatcacagctaatcccgtggtcaccaagaaagaggaacccgtgaacattgaggccgaacctccgttcggcgagtccaatatcgtgattgggatcggcgataacgccctgaagatcaattggtacaaaaagggatctagcattggcaagatgtttgaagctacggcccgcggggctcggagaatggccatccttggagacacagcgtgggatttcggctccgttgggggagtcctcaacagcctgggcaaaatggtgcaccagatttttgggtctgcctataccgctctgttctccggcgtgagctgggtcatgaagatcggaattggcatcctcctgacctggattgggcttaattctaaaaacacaagcatgtccttttcttgcatcgccatcggaattatcaccctgtacctcggcgctgtggttcaggccgacatggggtgtgtgattaattggaagggaaaagagctgaagtgcggcagcgggatcttcgtcacaaacgaggtgcatacgtggaccgaacagtataagtttcaagcggattcccccaaacgcctggccacagctattgccggcgcttgggagaatggagtttgtggcatccggagcaccacaagaatggaaaaccttctctggaagcagatcgccaatgagctgaactacattctgtgggaaaataacatcaaactcaccgtggtcgtgggggacattatcggagttctggagcagggcaagcgcacgcttacccctcagcccatggagctgaaatattcttggaagacatgggggaaagccaagattgtgaccgctgaaacacaaaactccagcttcatcatcgatggacctaatacccccgagtgcccgtctgcgtcccgggcctggaacgtctgggaagtggaggactacggctttggcgtgttcacaaccaatatttggctcaagctgagagaagtctatacgcagctgtgtgaccaccgccttatgagcgctgccgttaaagatgagcgggccgtgcacgctgacatggggtactggatcgagtcccagaagaacggatcttggaaactcgaaaaggccagcctgattgaggtgaaaacatgcacctggcctaagtcccataccctgtggtctaatggcgtcctcgaaagcgatatgatcattcccaagtccctggcggggcctatcagccagcacaaccatagacccggataccacacacaaaccgctggcccttggcaccttgggaaactggagctcgactttaattattgcgagggaacgacagtggttatcaccgaaaactgtggcacacgcggcccctctctgcggaccacaaccgtgtccgggaagctgattcatgagtggtgctgtagaagctgcacgcttccgcctctccggtacatgggagaagatggctgttggtatgggatggagatccgccccatttctgaaaaagaggagaatatggtcaagtccctggtgagcgccggatctggcaaagttgacaacttcaccatgggggtgctgtgcctcgccatcctgtttgaagaggtcatgagaggaaagttcggcaagaaacacatgattgctggcgtgttctttacattcgttcttctgctcagcgggcagatcacctggcgggatatgacacataccctgattatgatcggatccaatgccagcgacagaatgggcatgggggtgacgtacctggcgcttatcgctacatttaagattcagcccttcctggccctcggatttttcctgcgcaaactcacctctcgggaaaacctgcttctgggcgtcgggctcgccatggctacaaccctgcaactgcctgaggatatcgaacagatggccaatggaattgctcttggcctgatggccctcaagctgatcacccagtttgagacatatcagctctggacggcgctgatttcccttacctgtagcaacacaatgttcaccctgacagtggcctggagaaccgctacgctcatcctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccattctggcgtctagcctcctgcgcaacgacgttcctatggccgggccccttgtggctggaggcctgctcatcgcctgttacgtcattaccgggacatccgccgatctgaccgtggaaaaagctgccgacatcacatgggaggaagaggcggaacagacgggagttagccacaacctcatgattaccgtggacgatgacggcacaatgagaatcaaggatgacgagaccgagaatatcctgacagtccttctgaaaaccgctctgctcattgtgtctggcgtctttccgtattccatccctgccacgctgcttgtgtggcatacctggcagaagcagacacaacggagcggggttctgtgggatgtgccctctcctcccgaaacccagaaagccgagctcgaagagggagtctaccgcattaagcagcagggcatcttcgggaaaacacaagtgggagttggcgtgcagaaggagggggtctttcacaccatgtggcacgtgacaagaggagctgtgctgacgtacaacggcaagcggctcgaaccgaattgggcctccgttaaaaaggacctgattagctatggcgggggatggcgcctttctgcgcagtggcaaaaaggcgaggaagtccaggtgatcgctgtggagcctgggaagaaccccaaaaatttccagaccacacctggaaccttccagaccacaacgggcgaaattggggccatcgccctggattttaagcccggaacctccggcagccccatcattaacagagagggcaaggtcgtggggctgtacggaaatggcgttgtgacaaaaaacgggggatatgtctccggcatcgctcaaaccaatgccgagcctgacgggccgacacccgaactcgaggaagagatgttcaagaaacggaacctgaccattatggatcttcatcctggcagcggaaagacgcgcaaatacctgcccgctatcattagagaagccatcaagcggagactccgcacactgatcctcgcgcctacccgggtggttgccgctgagatggaggaagccctgaagggccttcccattagatatcagaccacagctaccaaatctgagcacacagggcgcgaaatcgtggacctgatgtgccatgccacctttacgatgcggctgctcagccctgtcagagtgccgaattacaacctgattatcatggatgaggcccacttcacagaccccgcttccattgcggcccgcggatatatctctacccgggttggcatgggggaagctgccgccatctttatgacagctacccctcccggaacggccgatgcgttccctcagagcaatgctcccattcaggacgaggagagagacatcccggaacgctcctggaactctggcaatgagtggattaccgattttgtggggaagacagtctggttcgtgcctagcatcaaagccggcaacgacattgccaactgtcttcggaagaatggaaaaaaggtgatccaactgtccagaaagacctttgatacagaataccagaaaaccaagctcaacgactgggatttcgtcgttacaaccgacatttctgagatgggcgctaattttaaagccgatcgggtgatcgacccccgcagatgcctgaagcccgtgatcctgacggatgggcctgagcgggtcattctcgcgggacccatgcctgtgacagccgctagcgccgctcagcgcagaggccgggttgggagaaacccgcagaaagaaaatgaccaatacatcttcaccggacagccccttaacaatgatgaggaccatgcccactggaccgaagctaagatgctgctggacaacattaatacacctgagggcatcattcccgccctcttcgaacctgagcgcgagaagtccgcggccatcgatggggaatatcggctgaaaggcgagagcagaaagacctttgtggaacttatgcgccggggagacctgcccgtctggctcgctcacaaagtggcctctgagggcatcaagtacacagatagaaaatggtgcttcgacgggcagcgcaacaatcagattctggaagagaacatggatgttgagatctggacgaaggaaggagagaaaaagaagctgcggccgagatggctcgacgctcgcacctattccgatcctcttgccctgaaagaatttaaggacttcgccgctggcagaaaaagcattgcgctggatctcgtgacagagatcgggcgggtcccctctcatctggcccaccgcaccagaaatgctcttgacaacctggtgatgctccatacatccgaacacggaggccgggcctaccgccacgccgtcgaggagctgcctgaaaccatggagacgctgctccttctgggcctgatgattctcctgaccgggggagctatgctttttctgatcagcggcaaggggatcggaaaaacatccattggcctcatctgtgtgattgcctctagcgggatgctgtggatggcggaaatccccctgcaatggattgcctccgctatcgttctcgagttctttatgatggtgcttctgattcctgagcccgaaaagcagagaaccccgcaggataatcaactggcctatgtggtcatcggaatcctcacactggctgccattatcgcggccaacgagatgggccttctggaaaccacgaagcgggacctcggcatgagcaaagagcctggggttgtgtctcccacatcctacctggatgtggacctgcatcccgctagcgcctggaccctctatgctgtcgccacaaccgtgattacccctatgcttagacacacaatcgaaaattctacggctaacgttagcctggccgcgattgccaaccaggctgtggtcctgatgggactcgacaagggctggccgatctccaaaatggatctgggggtgccccttctggccctcggatgctactctcaggtcaatcctctgaccctgacagctgccgtgctccttctgatcacccattacgccattatcggccccgggctgcaggcgaaggctacacgcgaggcccaaaaacggaccgctgccggaattatgaagaaccctacggttgacggcatcatgacaattgatctcgaccccgtgatctatgatagcaagttcgagaaacagctgggccaggtcatgcttctggtgctctgtgccgttcagctgctgctcatgagaacctcctgggctctttgcgaagccctgaccctggcgacagggcctatcaccacactctgggagggatctccgggcaagttttggaatacgaccattgccgtgagcatggctaacatcttccgcgggtcctacctggccggagctggccttgcctttagcattatgaaatctgtcgggacaggaaagcggggcaccggctcccaaggggaaacactgggagagaaatggaagaagaaactcaatcagctgagcagaaaggaattcgacctgtataaaaagtccggcatcaccgaggtggatcggacggaggcgaaagaagggctcaagcgcggagagattacccaccatgccgtgtctagaggcagcgctaaacttcagtggtttgttgaacggaacatggtcatccccgaggggcgcgtgattgacctgggatgtggcagaggcgggtggtcctactattgcgccggactgaagaaggtgacagaagtccggggctacaccaaagggggacctggccacgaggagcccgttcctatgtctacatatgggtggaatatcgtgaagctcatgagcggaaaagatgtgttctacctgcccccggaaaagtgtgacacccttctgtgcgatatcggcgagtccagcccttctcccacagtcgaagagtcccgcaccattagagtgctcaaaatggttgagccctggctgaagaacaatcagttctgtatcaaggtgctgaacccttacatgcccacggtcattgaacacctcgagcggcttcaacgcaaacatggcgggatgctggtgagaaatcctctgagccggaactctacacacgaaatgtattggatctccaatggaaccggcaacattgttgctagcgtgaatatggtctctagactcctgcttaaccgctttaccatgacacatcggagaccgacgatcgagaaggacgtggatctgggggccggaacccgccacgtgaacgctgaacccgagacacctaatatggacgtcatcggcgagcggattaaaagaatcaaggaagagcacaacagcacctggcattacgacgatgaaaatccctataaaacatgggcctaccacgggtcctatgaggttaaggcgaccggatctgccagctccatgattaacggcgtggtgaagctcctgacaaaaccttgggacgtcgtgcccatggttacccagatggctatgacggataccacaccgttcggccagcaacgcgtgtttaaggaaaaagtcgacacccggacacctagaagcatgcccgggacccgccgggtgatggagatcacggccgagtggctgtggagaacactcggacgcaataagaaacctcggctgtgcaccagagaagagttcacaaagaaggttcgcaccaacgctgccatgggcgccgtgtttacggaagagaatcagtgggattccgcgaaagctgccgtcgaagacgaggatttctggaagcttgtggacagagagcgggaactgcataaactcgggaagtgtggatcttgcgtttacaacatgatgggcaaacgcgagaagaaactgggggaatttggcaaggccaagggaagcagagctatttggtatatgtggcttggcgcccggtacctggagttcgaggctctcgggtttctgaatgaagatcactggttctccagagagaactcttacagcggagtggaaggcgaggggctgcataaactcggatatatcctgcgggacatctccaagattcccggcggggccatgtacgcggatgacaccgccggctgggacacacgcatcaccgaagatgaccttcacaatgaggagaaaattacacagcagatggatcctgaacacagacaactggctaacgccatctttaagctcacctatcagaataaagtcgtgaaggtccagcggcccacaccgaccggaacggtgatggacattatctctcgcaaggatcagagaggcagcgggcaagttggaacatacggcctgaacaccttcaccaatatggaggctcagcttatccggcagatggaaggggagggagtgctgtccaaagccgacctcgaaaaccctcatctgcccgagaagaaaattacacagtggctggagaccaagggcgtcgaacgcctcaaaagaatggcgatcagcggggatgactgcgtggtgaagcccattgatgaccggtttgccaacgctctgcttgccctgaatgatatgggcaaggttcgcaaagacatccctcaatggcagccgtctaagggatggcacgattggcagcaggtgcccttctgttcccatcacttccacgagctcattatgaaagacggcagaaagctggtcgtgccttgccggccccaagacgaacttatcgggcgcgctagaattagccagggagccggctggtctctgcgggagacagcttgtctcgggaaagcctatgcgcagatgtggtccctgatgtactttcatcgcagagatctgcggctcgccagcaacgctatctgctctgccgttcctgtgcactgggtccccacgtccagaaccacatggagcatccatgcccaccatcaatggatgaccacagaagacatgctgaccgtgtggaatcgcgtctggattgaggataacccttggatggaggacaagacgcccgtgaccacatgggaaaatgttccgtatcttggaaagcgggaggatcagtggtgtggctccctgatcgggctcaccagcagagctacatgggcccagaacattcctaccgcgatccagcaagtgcgctctctgattggcaatgaagagttccttgactacatgcccagcatgaaacggtttagaaaggaggaagagtccgaaggagctatctggtga

SEQ ID NO: 20428 - RNA, 9873 nt, synthetic construct
  misc_feature 1..9873: note = derived and/or modified CDS sequence (opt5) from DENV-3__GU131861__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgttgggggagtcctcaacagcctgggcaaaatggtgcatcagatttttgggtctgcctacaccgctctgttctccggcgtgagctgggtcatgaagatcggaattggcatcctcctgacctggattgggcttaattctaaaaacacaagcatgtccttttcttgcatcgccatcggaattatcaccctgtatctcggcgctgtggttcaggccgacatggggtgtgtgattaattggaagggaaaagagctgaagtgcggcagcgggatcttcgtcacaaacgaggtgcacacgtggaccgaacagtacaagtttcaagcggattcccccaaacgcctggccacagctattgccggcgcttgggagaatggagtttgtggcatccggagcaccacaagaatggaaaaccttctctggaagcagatcgccaatgagctgaactatattctgtgggaaaataacatcaaactcaccgtggtcgtgggggacattatcggagttctggagcagggcaagcgcacgcttacccctcagcccatggagctgaaatactcttggaagacatgggggaaagccaagattgtgaccgctgaaacacaaaactccagcttcatcatcgatggacctaatacccccgagtgcccgtctgcgtcccgggcctggaacgtctgggaagtggaggactatggctttggcgtgttcacaaccaatatttggctcaagctgagagaagtctacacgcagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacatgcacctggcctaagtcccacaccctgtggtctaatggcgtcctcgaaagcgatatgatcattcccaagtccctggcggggcctatcagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgattcacgagtggtgctgtagaagctgcacgcttccgcctctccggtatatgggagaagatggctgttggtacgggatggagatccgccccatttctgaaaaagaggagaatatggtcaagtccctggtgagcgccggatctggcaaagttgacaacttcaccatgggggtgctgtgcctcgccatcctgtttgaagaggtcatgagaggaaagttcggcaagaaacatatgattgctggcgtgttctttacattcgttcttctgctcagcgggcagatcacctggcgggatatgacacacaccctgattatgatcggatccaatgccagcgacagaatgggcatgggggtgacgtatctggcgcttatcgctacatttaagattcagcccttcctggccctcggatttttcctgcgcaaactcacctctcgggaaaacctgcttctgggcgtcgggctcgccatggctacaaccctgcaactgcctgaggatatcgaacagatggccaatggaattgctcttggcctgatggccctcaagctgatcacccagtttgagacataccagctctggacggcgctgatttcccttacctgtagcaacacaatgttcaccctgacagtggcctggagaaccgctacgctcatcctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccattctggcgtctagcctcctgcgcaacgacgttcctatggccgggccccttgtggctggaggcctgctcatcgcctgttatgtcattaccgggacatccgccgatctgaccgtggaaaaagctgccgacatcacatgggaggaagaggcggaacagacgggagttagccataacctcatgattaccgtggacgatgacggcacaatgagaatcaaggatgacgagaccgagaatatcctgacagtccttctgaaaaccgctctgctcattgtgtctggcgtctttccgtactccatccctgccacgctgcttgtgtggcacacctggcagaagcagacacaacggagcggggttctgtgggatgtgccctctcctcccgaaacccagaaagccgagctcgaagagggagtctaccgcattaagcagcagggcatcttcgggaaaacacaagtgggagttggcgtgcagaaggagggggtctttcataccatgtggcacgtgacaagaggagctgtgctgacgtataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagaccacacctggaaccttccagaccacaacgggcgaaattggggccatcgccctggattttaagcccggaacctccggcagccccatcattaacagagagggcaaggtcgtggggctgtatggaaatggcgttgtgacaaaaaacgggggatacgtctccggcatcgctcaaaccaatgccgagcctgacgggccgacacccgaactcgaggaagagatgttcaagaaacggaacctgaccattatggatcttcaccctggcagcggaaagacgcgcaaatatctgcccgctatcattagagaagccatcaagcggagactccgcacactgatcctcgcgcctacccgggtggttgccgctgagatggaggaagccctgaagggccttcccattagataccagaccacagtgaccaaatctgagcatacagggcgcgaaatcgtcgacctgatgtgccacgctacctttacgatgcggctgctcagccctgtgagagttccgaattataacctgattatcatggatgaggcccatttcacagaccccgcctccattgctgcgcgcggatacatctctacccgggtgggcatgggggaagccgctgccatctttatgacagccacccctcccggaacggctgatgccttccctcagagcaatgcgcccattcaggacgaggagagagacatcccggaacgctcctggaactctggcaatgagtggattaccgattttgctgggaagacagtctggttcgtgcctagcatcaaagccggcaacgacattgccaactgtcttcggaagaatggaaaaaaggtgatccaactgtccagaaagacctttgatacagaataccagaaaaccaagctcaacgactgggatttcgtcgttacaaccgacatttctgagatgggcgctaattttaaagccgatcgggtgatcgacccccgcagatgcctgaagcccgtgatcctgacggatgggcctgagcgggtcattctcgcgggacccatgcctgtgacagccgctagcgccgctcagcgcagaggccgggttgggagaaacccgcagaaagaaaatgaccaatatatcttcaccggacagccccttaacaatgatgaggaccacgcccattggaccgaagctaagatgctgctggacaacattaatacacctgagggcatcattcccgccctcttcgaacctgagcgcgagaagtccgcggccatcgatggggaataccggctgaaaggcgagagcagaaagacctttgtggaacttatgcgccggggagacctgcccgtctggctcgctcacaaagtggcctctgagggcatcaagtatacagatagaaaatggtgcttcgacgggcagcgcaacaatcagattctggaagagaacatggatgttgagatctggacgaaggaaggagagaaaaagaagctgcggccgagatggctcgacgctcgcacctactccgatcctcttgccctgaaagaatttaaggacttcgccgctggcagaaaaagcattgcgctggatctcgtgacagagatcgggcgggtcccctctcacctggcccatcgcaccagaaatgctcttgacaacctggtgatgctccacacatccgaacatggaggccgggcctatcgccacgccgtcgaggagctgcctgaaaccatggagacgctgctccttctgggcctgatgattctcctgaccgggggagctatgctttttctgatcagcggcaaggggatcggaaaaacatccattggcctcatctgtgtgattgcctctagcgggatgctgtggatggcggaaatccccctgcaatggattgcctccgctgttgtgctcgagttctttatgatggtgcttctgatccctgagcccgaaaagcagagaaccccgcaggataatcaactggcctacgtcgttattggaatcctcacactggctgccatcattgcggccaacgagatgggccttctggaaaccacgaagcgggacctcggcatgagcaaagagcctggggtggtgtctcccacatcctatctggatgtcgacctgcaccccgctagcgcctggaccctctacgctgtggccacaaccgttatcacccctatgcttagacatacaattgaaaattctacggctaacgtgagcctggccgcgatcgccaaccaggctgtcgtgctgatgggactcgacaagggctggccgatttccaaaatggatctgggggtcccccttctggccctcggatgctactctcaggtgaatcctctgaccctgacagctgccgttctccttctgatcacccactatgccatcattggccccgggctgcaggcgaaggctacacgcgaggcccaaaaacggaccgctgccggaatcatgaagaaccctacggtggacggcattatgacaatcgatctcgaccccgtcatttacgatagcaagttcgagaaacagctgggccaggtgatgcttctggttctctgtgccgtgcagctgctgctcatgagaacctcctgggctctttgcgaagccctgaccctggcgacagggcctatcaccacactctgggagggatctccgggcaagttttggaatacgaccatcgccgtcagcatggctaacattttccgcgggtcctatctggccggagctggccttgcctttagcatcatgaaatctgtggggacaggaaagcggggcaccggctcccaaggggaaacactgggagagaaatggaagagaaagctcaatcagctgagccggaaagaattcgacctgtacaagaaatccggcattaccgaggtggatcgcacggaggcgaaggaagggctcaaaagaggagagatcacccatcacgccgtttctcggggcagcgctaagcttcagtggtttgtcgaacgcaacatggtgattcccgaggggagagtgatcgacctgggatgtggccggggcgggtggtcctattactgcgccggactgaaaaaggtcacagaagttcgcggctataccaaggggggacctggccatgaggagcccgtgcctatgtctacatacgggtggaatattgtgaaactcatgagcggaaaggatgtcttctacctgcccccggaaaaatgtgacacccttctgtgcgatatcggcgagtccagcccttctcccacagtggaagagtccagaaccatccgggttctcaagatggtggagccctggctgaaaaacaatcagttctgtattaaggtcctgaacccttatatgcccacggtgatcgaacacctcgagcgccttcaaagaaagcacggcgggatgctggttcggaatcctctgagcagaaactctacacatgaaatgtactggatttccaatggaaccggcaacatcgtggctagcgtcaatatggtgtctcgcctcctgcttaaccggtttaccatgacacacagacgcccgacgattgagaaagacgtggatctgggggccggaacccggcatgtcaacgctgaacccgagacacctaatatggacgttatcggcgagagaatcaagaaaattaaggaagagcacaacagcacctggcactatgacgatgaaaatccctacaaaacatgggcctatcatgggtcctacgaggtgaaggcgaccggatctgccagctccatgatcaacggcgtggtcaagctcctgacaaaaccttgggacgtggttcccatggtgacccagatggctatgacggataccacaccgttcggccagcaacgcgtctttaaggaaaaagtggacacccggacacctagaagcatgcccgggacccgccgggttatggagattacggccgagtggctgtggagaacactcggacgcaataagaaacctcggctgtgcaccagagaagagttcacaaagaaggtgcgcaccaacgctgccatgggcgccgtctttacggaagagaatcagtgggattccgcgaaagctgccgtggaagacgaggatttctggaagcttgttgacagagagcgggaactgcacaaactcgggaagtgtggatcttgcgtgtataacatgatgggcaaacgcgagaagaaactgggggaatttggcaaggccaagggaagcagagctatctggtacatgtggcttggcgcccggtacctggagttcgaggctctcgggtttctgaatgaagatcattggttctccagagagaactcttatagcggagtcgaaggcgaggggctgcacaaactcggatacattctgcgggacatctccaagatccccggcggggccatgtatgcggatgacaccgccggctgggacacacgcattaccgaagatgaccttcataatgaggagaaaatcacacagcagatggatcctgaacacagacaactggctaacgccatttttaagctcacctaccagaataaagtggtcaaggtgcagcggcccacaccgaccggaacggttatggacatcatttctcgcaaggatcagagaggcagcgggcaagtgggaacatatggcctgaacaccttcaccaatatggaggctcagcttatccggcagatggaaggggagggagtcctgtccaaagccgacctcgaaaaccctcacctgcccgagaagaaaatcacacagtggctggagaccaagggcgtggaacgcctcaaaagaatggcgattagcggggatgactgcgtggttaagcccatcgatgaccggtttgccaacgctctgcttgccctgaatgatatgggcaaggtgcgcaaagacattcctcaatggcagccgtctaagggatggcatgattggcagcaggtccccttctgttcccaccatttccacgagctcatcatgaaagacggcagaaagctggtggttccttgccggccccaagacgaacttattgggcgcgctagaatcagccagggagccggctggtctctgcgggagacagcttgtctcgggaaagcctacgcgcagatgtggtccctgatgtattttcaccgcagagatctgcggctcgccagcaacgctatttgctctgccgtgcctgtccattgggtgcccacgtccagaaccacatggagcatccacgcccatcaccaatggatgaccacagaagacatgctgaccgtctggaatcgcgtgtggatcgaggataacccttggatggaggacaagacgcccgttaccacatgggaaaatgtgccgtaccttggaaagcgggaggatcagtggtgtggctccctgattgggctcaccagcagagctacatgggcccagaacatccctaccgcgattcagcaagtccgctctctgatcggcaatgaagagttccttgactacatgcccagcatgaaacggtttagaaaggaggaagagtccgaaggagctatttggtga

SEQ ID NO: 20429 - RNA, 9873 nt, synthetic construct
  misc_feature 1..9873: note = derived and/or modified CDS sequence (opt5) from DENV-3__GU131862__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcattaagaaagaggaacccgtgaacatcgaggccgaacctccgttcggcgagtccaatattgtgatcgggatcggcgataacgccctgaagattaattggtataaaaagggatctagcatcggcaagatgtttgaagctaccgcccgcggggctcggagaatggccattcttggagacacggcgtgggatttcggctccgttgggggagtcctcaacagcctgggcaaaatggtgcatcagatctttgggtctgcctacacagctctgttctccggcgtgagctgggtcatgaagattggaatcggcattctcctgacctggatcgggcttaattctaaaaacaccagcatgtccttttcttgcatcgccattggaatcattacactgtatctcggcgctgtggttcaggccgacatcgggtgtgtgattaattggaagggaaaagagctgaagtgcggcagcgggatcttcgtcaccaacgaggtgcacacatggacggaacagtacaagtttcaagcggattcccccaaacgcctggccaccgctatcgccggcgcttgggagaatggagtttgtggcattcggagcacaaccagaatggaaaaccttctctggaagcagatcgccaatgagctgaactatattctgtgggaaaataacatcaaactcacagtggtcgtgggggacattatcggagttctggagcagggcaagcgcacccttacgcctcagcccatggagctgaaatactcttggaagacctgggggaaagccaagatcgtgacagctgaaacccaaaactccagcttcattatcgatggacctaatacacccgagtgcccgtctgcgtcccgggcctggaacgtctgggaagtggaggactatggctttggcgtgttcaccacaaatatttggctcaagctgagagaagtctacacccagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacgtgcacatggcctaagtcccacaccctgtggtctaatggcgtcctcgaaagcgatatgatcatccccaagtccctggcggggcctattagccagcataaccacagacccggatatcatacccaaacagctggcccttggcaccttgggaaactggagctcgactttaattactgcgagggaaccacggtggttatcacagaaaactgtggcacccgcggcccctctctgcggacaaccacagtgtccgggaagctgattcacgagtggtgctgtagaagctgcacccttccgcctctccggtatatgggagaagatggctgttggtacgggatggagatccgccccatttctgaaaaagaggagaatatggtcaagtccctggtgagcgccggatctggcaaagttgacaacttcacgatgggggtgctgtgcctcgccatcctgtttgaagaggtcatgagaggaaagttcggcaagaaacatatgattgctggcgtgttctttaccttcgttcttctgctcagcgggcagatcacatggcgggatatgacccacacactgatcatgattggatccaatgccagcgacagaatgggcatgggggtgacctatctggcgcttatcgctacgtttaagattcagcccttcctggccctcggatttttcctgcgcaaactcacatctcgggaaaacctgcttctgggcgtcgggctcgccatggctaccacactgcaactgcctgaggatatcgaacagatggccaatggaattgctcttggcctgatggccctcaagctgatcacccagtttgagacctaccagctctggacagcgctgatctcccttacgtgtagcaacaccatgttcacactgaccgtggcctggagaacagctaccctcattctggccggcgtgtccctgcttccggtctgccaatctagctccatgcgcaaaacggactggctgcccatggctgttgccgccatgggggtgcctcccctccctctgtttatcttctctctcaaggatacactgaagagacggagctggccccttaatgagggagtgatggctgtcggcctggtgtccattctggcgtctagcctcctgcgcaacgacgttcctatggccgggccccttgtggctggaggcctgctcatcgcctgttatgtcattaccgggacctccgccgatctgacagtggaaaaagctgccgacatcacctgggaggaagaggcggaacagacaggagttagccataacctcatgatcacggtggacgatgacggcaccatgagaattaaggatgacgagacagagaatatcctgaccgtccttctgaaaacagctctgctcattgtgtctggcgtctttccgtactccatccctgccaccctgcttgtgtggcacacgtggcagaagcagacccaacggagcggggttctgtgggatgtgccctctcctcccgaaacacagaaagccgagctcgaagagggagtctaccgcattaagcagcagggcatcttcgggaaaacccaagtgggagttggcgtgcagaaggagggggtctttcatacaatgtggcacgtgaccagaggagctgtgctgacatataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagacgatgcctggaaccttccagacaaccaccggcgaaatcggggccattgccctggattttaagcccggaacatccggcagccccatcattaacagagagggcaaggtcgtggggctgtatggaaatggcgttgtgacgaaaaacgggggatacgtctccggcatcgctcaaaccaatgccgagcctgacgggccgacacccgaactcgaggaagagatgttcaagaaacggaacctgaccattatggatcttcaccctggcagcggaaagacacgcaaatatctgcccgctatcatcagagaagccattaagcggagactccgcaccctgatcctcgcgcctacgcgggtggttgccgctgagatggaggaagccctgaagggccttcccattagataccagacaaccgctaccaaatctgagcatacagggcgcgaaatcgtggacctgatgtgccacgccacctttacaatgcggctgctcagccctgtcagagtgccgaattataacctgattatcatggatgaggcccatttcaccgaccccgcttccatcgcggcccgcggatacatttctacgcgggttggcatgggggaagctgccgccatctttatgacagctacccctcccggaacagccgatgcgttccctcagagcaatgctcccattcaggacgaggagagagacatcccggaacgctcctggaactctggcaatgagtggattaccgattttgtggggaagacggtctggttcgtgcctagcatcaaagccggcaacgacattgccaactgtcttcggaagaatggaaaaaaggtgatccaactgtccagaaagacctttgatacagaataccagaaaaccaagctcaacgactgggatttcgtcgttacaaccgacatctctgagatgggcgctaattttaaagccgatcgggtgattgacccccgcagatgcctgaagcccgtgatcctgacagatgggcctgagcgggtcattctcgcgggacccatgcctgtgaccgccgctagcgccgctcagcgcagaggccgggttgggagaaacccgcagaaagaaaatgaccaatatatcttcacgggacagccccttaacaatgatgaggaccacgcccattggacagaagctaagatgctgctggacaacattaatacccctgagggcatcatccccgccctcttcgaacctgagcgcgagaagtccgcggccattgatggggaataccggctgaaaggcgagagcagaaagacctttgtggaacttatgcgccggggagacctgcccgtctggctcgctcacaaagtggcctctgagggcatcaagtatacagatagaaaatggtgcttcgacgggcagcgcaacaatcagattctggaagagaacatggatgttgagatctggaccaaggaaggagagaaaaagaagctgcggccgagatggctcgacgctcgcacatactccgatcctcttgccctgaaagaatttaaggacttcgccgctggcagaaaaagcattacgctggatctcgtgaccgagatcgggcgggtcccctctcacctggcgcatcgcacaagaaatgcccttgacaacctggtgatgctccacacctccgaacatggaggccgggcttatcgccacgccgtcgaggagctgcctgaaacaatggagaccctgctccttctgggcctgatgatcctcctgacggggggagccatgctttttctgattagcggcaaggggatcggaaaaacctccattggcctcatctgtgtgattgcttctagcgggatgctgtggatggccgaaatccccctgcaatggattgcgtccgccatcgttctcgagttctttatgatggtgcttctgatccctgagcccgaaaagcagagaacaccgcaggataatcaactggcttacgtggtcattggaatcctcaccctggccgctattatcgccgcgaacgagatgggccttctggaaacaaccaagcgggacctcggcatgagcaaagagcctggggttgtgtctcccaattcctatctggatgtggacctgcaccccgccagcgcttggacgctctacgccgtcgctacaaccgtgattacacctatgcttagacataccatcgaaaactctaccgccaacgttagcctggctgccatcgcgaatcaggccgtggtcctgatgggactcgacaagggctggccgatttccaaaatggatctgggggtgccccttctggctctcggatgctactctcaggtcaaccctctgacactgacggccgctgtgctccttctgatcacccactatgccattatcggccccgggctgcaggccaaggcgacacgcgaggctcaaaaacggaccgccgctggaattatgaagaatcctacagttgacggcatcatgaccatcgatctcgaccccgtgatttacgatagcaagttcgagaaacagctgggccaggtcatgcttctggtgctctgtgccgttcagctgctgctcatgagaacgtcctgggccctttgcgaagctctgacactggccaccgggcctatcaccacactctgggagggatctccgggcaagttttggaacaccacaattgcggtgagcatggccaatatcttccgcgggtcctatctggctggagccggccttgcttttagcattatgaaatctgtcgggacgggaaagcggggcaccggctcccaaggggaaacactgggagagaaatggaagaagaaactcaaccagctgagcagaaaggaattcgacctgtacaaaaagtccggcatcaccgaggtggatcggacagaggccaaagaagggctcaagcgcggagagattacccatcacgcggtgtctagaggcagcgccaaacttcagtggtttgttgaacggaatatggtcatccccgaggggcgcgtgatcgacctgggatgtggcagaggcgggtggtcctattactgcgctggactgaagaaggtgacggaagtccggggctataccaaagggggacctggccatgaggagcccgttcctatgtctacatacgggtggaacattgtgaagctcatgagcggaaaagatgtgttctacctgcccccggaaaagtgtgacacccttctgtgcgatatcggcgagtccagcccttctcccacagtcgaagagtcccgcaccattagagtgctcaaaatggttgagccctggctgaagaataaccagttctgtatcaaggtgctgaatccttatatgcccacagtcattgaacacctcgagcggcttcaacgcaaacacggcgggatgctggtgagaaaccctctgagccggaattctacccatgaaatgtactggatctccaacggaacgggcaatatcgttgccagcgtgaacatggtctctagactcctgcttaaccgctttacaatgacccaccggagaccgaccattgagaaggacgtggatctgggggctggaacacgccatgtgaatgccgaacccgagacgcctaacatggacgtcatcggcgagcggattaaaagaatcaaggaagagcacaatagcacctggcactatgacgatgaaaacccctacaaaacatgggcttatcatgggtcctacgaggttaaggccaccggatctgcgagctccatgattaatggcgtggtgaagctcctgacaaaaccttgggacgtcgtgcccatggttacccagatggccatgacagataccacgccgttcggccagcaacgcgtgtttaaggaaaaagtcgacacccggacacctagaagcatgcccgggacccgccgggtgatgggaatcacagctgagtggctgtggaagaccctcggcagaaacaaaaagcctcgcctgtgcacgcgggaggaattcacaaagaaagttagaaccaatgccgctatgggggccgtgtttacagaggaaaaccagtgggattccgccaaggcggctgtcgaggacgaagatttctggaaacttgtggaccgcgagagagagctgcacaagctcggaaaatgtggctcttgcgtttataatatgatggggaagcgggaaaaaaagctgggcgagtttggaaaggccaaaggcagccgcgccatctggtacatgtggcttggggctagatacctggaattcgaggccctcggatttctgaacgaggatcattggttctcccgggaaaattcttatagcggcgtggagggggaaggactgcacaagctcggctacattctgagagacatctccaaaattcccgggggcgctatgtatgccgatgacaccgcgggatgggacacgcggatcaccgaggatgaccttcataacgaagagaagattacacagcagatggatcctgagcaccgccaactggccaatgctatctttaaactcacctaccagaacaaggtcgtgaaggtccagagacccacaccgaccggcacagtgatggacatcatttctcggaaagatcagcgcgggagcggacaagttggcacctatgggctgaatacgttcacaaacatggaagcccagcttatcagacagatggagggagaaggcgtgctgtccaaggctgacctcgagaaccctcacctgcccgaaaaaaagattacccagtggctggagaccaaaggggtcgagcggctcaagcgcatggccatcagcggcgatgactgcgtggtgaagcccattgatgacagatttgcgaatgccctgcttgctctgaacgatatgggaaaagttcggaaggacatccctcaatggcagccgtctaaaggctggcatgattggcagcaggtgcccttctgttcccaccatttccacgaactcattatgaaggacgggcgcaaactggtcgtgccttgcagaccccaagacgagcttatcggacgggcccgcatcagccagggcgctgggtggtctctgagagaaacagcctgtctcggaaaggcttacgcccagatgtggtccctgatgtattttcaccggcgcgatctgagactcgcgagcaatgccatttgctctgctgttcctgtgcattgggtccccacctcccggacaacgtggagcatccacgcccatcaccaatggatgaccacagaggacatgctgaccgtgtggaacagagtctggattgaagataatccttggatggaggacaagacacccgtgaccacgtgggagaacgttccgtaccttggcaaacgcgaagatcagtggtgtgggtccctgatcggcctcaccagccgggccacatgggctcagaatattcctaccgccatccagcaagtgagatctctgatcggaaacgaggaattccttgactacatgcccagcatgaagcgctttcggaaagaggaggaatccgagggcgcgatttggtga

SEQ ID NO: 20430 - RNA, 9873 nt, synthetic construct
  misc_feature 1..9873: note = derived and/or modified CDS sequence (opt5) from DENV-3__GU131865__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgttgggggagtcctcaacagcctgggcaaaatggtgcatcagatttttgggtctgcctacaccgctctgttctccggcgtgagctgggtcatgaagatcggaattggcatcctcctgacctggattgggcttaattctaaaaacacaagcatgtccttttcttgcatcgccatcggaattatcaccctgtatctcggcgctgtggttcaggccgacatggggtgtgtgattaattggaagggaaaagagctgaagtgcggcagcgggatcttcgtcacaaacgaggtgcacacgtggaccgaacagtacaagtttcaagcggattcccccaaacgcctggccacagctattgccggcgcttgggagaatggagtttgtggcatccggagcaccacaagaatggaaaaccttctctggaagcagatcgccaatgagctgaactatattctgtgggaaaataacatcaaactcaccgtggtcgtgggggacattatcggagttctggagcagggcaagcgcacgcttacccctcagcccatggagctgaaatactcttggaagacatgggggaaagccaagattgtgaccgctgaaacacaaaactccagcttcatcatcgatggacctaatacccccgagtgcccgtctgcgtcccgggcctggaacgtctgggaagtggaggactatggctttggcgtgttcacaaccaatatttggctcaagctgagagaagtctacacgcagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacatgcacctggcctaagtcccacaccctgtggtctaatggcgtcctcgaaagcgatatgatcattcccaagtccctggcggggcctatcagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgattcacgagtggtgctgtagaagctgcacgcttccgcctctccggtatatgggagaagatggctgttggtacgggatggagatccgccccatttctgaaaaagaggagaatatggtcaagtccctggtgagcgccggatctggcaaagttgacaacttcaccatgggggtgctgtgcctcgccatcctgtttgaagaggtcatgagaggaaagttcggcaagaaacatatgattgctggcgtgttctttacattcgttcttctgctcagcgggcagatcacctggcgggatatgacacacaccctgattatgatcggatccaatgccagcgacagaatgggcatgggggtgacgtatctggcgcttatcgctacatttaagattcagcccttcctggccctcggatttttcctgcgcaaactcacctctcgggaaaacctgcttctgggcgtcgggctcgccatggctacaaccctgcaactgcctgaggatatcgaacagatggccaatggaattgctcttggcctgatggccctcaagctgatcacccagtttgagacataccagctctggacggcgctgatttcccttacctgtagcaacacaatgttcaccctgacagtggcctggagaaccgctacgctcatcctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccattctggcgtctagcctcctgcgcaacgacgttcctatggccgggccccttgtggctggaggcctgctcatcgcctgttatgtcattaccgggacatccgccgatctgaccgtggaaaaagctgccgacatcacatgggaggaagaggcggaacagacgggagttagccataacctcatgattaccgtggacgatgacggcacaatgagaatcaaggatgacgagaccgagaatatcctgacagtccttctgaaaaccgctctgctcattgtgtctggcgtctttccgtactccatccctgccacgctgcttgtgtggcacacctggcagaagcagacacaacggagcggggttctgtgggatgtgccctctcctcccgaaacccagaaagccgagctcgaagagggagtctaccgcattaagcagcagggcatcttcgggaaaacacaagtgggagttggcgtgcagaaggagggggtctttcataccatgtggcacgtgacaagaggagctgtgctgacgtataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagaccacacctggaaccttccagaccacaacgggcgaaattggggccatcgccctggattttaagcccggaacctccggcagccccatcattaacagagagggcaaggtcgtggggctgtatggaaatggcgttgtgacaaaaaacgggggatacgtctccggcatcgctcaaaccaatgccgagcctgacgggccgacacccgaactcgaggaagagatgttcaagaaacggaacctgaccattatggatcttcaccctggcagcggaaagacgcgcaaatatctgcccgctatcattagagaagccatcaagcggagactccgcacactgatcctcgcgcctacccgggtggttgccgctgagatggaggaagccctgaagggccttcccattagataccagaccacagtgaccaaatctgagcatacagggcgcgaaatcgtcgacctgatgtgccacgctacctttacgatgcggctgctcagccctgtgagagttccgaattataacctgattatcatggatgaggcccatttcacagaccccgcctccattgctgcgcgcggatacatctctacccgggtgggcatgggggaagccgctgccatctttatgacagccacccctcccggaacggctgatgccttccctcagagcaatgcgcccattcaggacgaggagagagacatcccggaacgctcctggaactctggcaatgagtggattaccgattttgctgggaagacagtctggttcgtgcctagcatcaaagccggcaacgacattgccaactgtcttcggaagaatggaaaaaaggtgatccaactgtccagaaagacctttgatacagaataccagaaaaccaagctcaacgactgggatttcgtcgttacaaccgacatttctgagatgggcgctaattttaaagccgatcgggtgatcgacccccgcagatgcctgaagcccgtgatcctgacggatgggcctgagcgggtcattctcgcgggacccatgcctgtgacagccgctagcgccgctcagcgcagaggccgggttgggagaaacccgcagaaagaaaatgaccaatatatcttcaccggacagccccttaacaatgatgaggaccacgcccattggaccgaagctaagatgctgctggacaacattaatacacctgagggcatcattcccgccctcttcgaacctgagcgcgagaagtccgcggccatcgatggggaataccggctgaaaggcgagagcagaaagacctttgtggaacttatgcgccggggagacctgcccgtctggctcgctcacaaagtggcctctgagggcatcaagtatacagatagaaaatggtgcttcgacgggcagcgcaacaatcagattctggaagagaacatggatgttgagatctggacgaaggaaggagagaaaaagaagctgcggccgagatggctcgacgctcgcacctactccgatcctcttgccctgaaagaatttaaggacttcgccgctggcagaaaaagcattgcgctggatctcgtgacagagatcgggcgggtcccctctcacctggcccatcgcaccagaaatgctcttgacaacctggtgatgctccacacatccgaacatggaggccgggcctatcgccacgccgtcgaggagctgcctgaaaccatggagacgctgctccttctgggcctgatgattctcctgaccgggggagctatgctttttctgatcagcggcaaggggatcggaaaaacatccattggcctcatctgtgtgattgcctctagcgggatgctgtggatggcggaaatccccctgcaatggattgcctccgctgttgtgctcgagttctttatgatggtgcttctgatccctgagcccgaaaagcagagaaccccgcaggataatcaactggcctacgtcgttattggaatcctcacactggctgccatcattgcggccaacgagatgggccttctggaaaccacgaagcgggacctcggcatgagcaaagagcctggggtggtgtctcccacatcctatctggatgtcgacctgcaccccgctagcgcctggaccctctacgctgtggccacaaccgttatcacccctatgcttagacatacaattgaaaattctacggctaacgtgagcctggccgcgatcgccaaccaggctgtcgtgctgatgggactcgacaagggctggccgatttccaaaatggatctgggggtcccccttctggccctcggatgctactctcaggtgaatcctctgaccctgacagctgccgttctccttctgatcacccactatgccatcattggccccgggctgcaggcgaaggctacacgcgaggcccaaaaacggaccgctgccggaatcatgaagaaccctacggtggacggcattatgacaatcgatctcgaccccgtcatttacgatagcaagttcgagaaacagctgggccaggtgatgcttctggttctctgtgccgtgcagctgctgctcatgagaacctcctgggctctttgcgaagccctgaccctggcgacagggcctatcaccacactctgggagggatctccgggcaagttttggaatacgaccatcgccgtcagcatggctaacattttccgcgggtcctatctggccggagctggccttgcctttagcatcatgaaatctgtggggacaggaaagcggggcaccggctcccaaggggaaacactgggagagaaatggaagagaaagctcaatcagctgagccggaaagaattcgacctgtacaagaaatccggcattaccgaggtggatcgcacggaggcgaaggaagggctcaaaagaggagagatcacccatcacgccgtttctcggggcagcgctaagcttcagtggtttgtcgaacgcaacatggtgattcccgaggggagagtgatcgacctgggatgtggccggggcgggtggtcctattactgcgccggactgaaaaaggtcacagaagttcgcggctataccaaggggggacctggccatgaggagcccgtgcctatgtctacatacgggtggaatattgtgaaactcatgaccggaaaggatgtcttctacctgcccccggaaaaatgtgacacacttctgtgcgatatcggcgagagctcccctagccccaccgtggaagagtctagaacgatccgggttctcaagatggtggagccctggctgaaaaacaatcagttctgtattaaggtcctgaacccttatatgcccacagtgatcgaacacctcgagcgccttcaaagaaagcacggcgggatgctggttcggaatcctctgtccagaaacagcacccatgaaatgtactggatttctaatggaaccggcaacatcgtggcttccgtcaatatggtgagccgcctcctgcttaaccggtttacaatgacgcacagacgcccgaccattgagaaagacgtggatctgggggccggaacacggcatgtcaacgctgaacccgagacccctaatatggacgttatcggcgagagaatcaagcgcattaaagaagagcacaactctacatggcactatgacgatgaaaatccctacaagacctgggcctatcatgggagctacgaggtgaaagcgacaggatccgcctctagcatgatcaacggcgtggtcaagctcctgaccaagccttgggacgtggttcccatggtgacgcagatggctatgaccgatacaaccccgttcggccagcaacgggtctttaaagaaaaggtggacacaagaacccctcgctccatgcccgggacgcggagagttatggagattacagccgagtggctgtggcgcaccctcggacggaataaaaagcctagactgtgcacacgcgaagagttcaccaaaaaggtgagaacgaacgctgccatgggcgccgtctttaccgaagagaatcagtgggatagcgcgaaggctgccgtggaagacgaggatttctggaaacttgttgaccgggagcgcgaactgcacaagctcgggaaatgtggatcctgcgtgtataacatgatgggcaagagagagaaaaagctgggggaatttggcaaagccaagggatctcgggctatctggtacatgtggcttggcgccagatacctggagttcgaggctctcgggtttctgaatgaagatcattggttcagccgggagaactcctattctggagtcgaaggcgaggggctgcacaagctcggatacattctgcgcgacatcagcaaaatccccggcggggccatgtatgcggatgacacagccggctgggacaccagaattacagaagatgaccttcataatgaggagaagatcacccagcagatggatcctgaacaccggcaactggctaacgccatttttaaactcacataccagaataaggtggtcaaagtgcagcgccccaccccgacgggaacagttatggacatcatttccagaaaggatcagcggggctctgggcaagtgggaacctatggcctgaacaccttcacaaatatggaggtccagcttatccgccagatggaaggggagggagtgctgagcaaggctgacctcgaaaaccctcacctgcccgagaaaaagatcacccagtggctggagacaaaaggcgtggaaagactcaagcggatggccatttccggggatgactgcgttgtgaaacccatcgatgaccgctttgcgaacgccctgcttgctctgaatgatatgggcaaggtcagaaaggacattcctcaatggcagccgagcaaaggatggcatgattggcagcaggtgcccttctgttctcaccatttccacgagctcatcatgaaggacggccggaaactggttgtgccttgccgcccccaagacgaacttattgggagagcccggatctcccagggagctggctggagcctgcgcgagacggcctgtctcgggaaggcttacgcccagatgtggtctctgatgtattttcacagacgggatctgagactcgcgtccaacgccatttgcagcgctgtccctgtgcattgggtccccacctctcgcacaacctggtccatccacgcccatcaccaatggatgacaaccgaagacatgctgacggtgtggaatcgggtttggatcgaggataacccttggatggaggacaaaacccccgtgacaacctgggaaaatgtcccgtaccttggaaagagagaggatcagtggtgtggcagcctgattgggctcacatcccgcgccacctgggctcagaacatccctacggccattcagcaagtgcggagcctgatcggcaatgaagagttccttgactacatgccctctatgaagagatttcgcaaagaggaagagagcgaaggagcgatttggtga

SEQ ID NO: 20431 - RNA, 9873 nt, synthetic construct
  misc_feature 1..9873: note = derived and/or modified CDS sequence (opt5) from DENV-3__GU131866__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacagacggtctgtggccctggctcctcacgtcgggatgggactggatacccgcacacaaacctggatgagcgccgagggcgcttggagacaggtggaaaaggttgagacatgggccctccggcatcccggcttcaccatcctggcgctttttctggcccactacatcgggacgtccctcacacagaaagtggtcattttcatcctgcttatgctggtgaccccttctatgacaatgcgctgtgttggagtgggcaacagagactttgtcgaagggctcagcggagctacctgggtggatgtggtcctggagcatggcgggtgcgttaccacaatggccaagaataagcccacgctggacattgagctccagaaaaccgaagctacacaactggccacccttcggaagctgtgtatcgagggaaaaattacaaacatcaccacggattcccgctgccctacacagggcgaagcggtgctcccggaggaacaggaccagaattatgtgtgtaagcacacctacgtcgatagaggctgggggaacggatgcggcctgttcgggaaaggaagccttgtgacctgcgccaagtttcaatgtctggagctcattgagggcaaggttgtgcagtatgaaaatctgaaatacacagtcatcatcaccgtgcacacaggggaccagcatcaggttggaaacgagacgcaaggcgtgaccgctgaaattacaccccaggcctctaccacagaggctatcctgcctgaatatggcaccctcgggctggagtgctccccccggacgggacttgacttcaatgagatgattctgctcaccatgaagaacaaagcctggatggtccaccgccagtggtttttcgatctgcctcttccctggacaagcggcgccaccacagaaaccccgacgtggaatagaaaggagctgctcgtgacatttaaaaacgctcatgcgaagaaacaagaagtcgtggttctggggtctcaggagggagccatgcacaccgctctgacaggcgccaccgaaatccagaattccgggggcaccagcattttcgccggacacctcaagtgtcggctgaagatggacaaacttgagctgaagggcatgtcttacgctatgtgcacaaacacgtttgtgctcaaaaaggaggtctccgaaacccagcatgggacaatcctgatcaaagtggagtacaagggagaagatgccccttgtaagattcccttcagcaccgaggacggccaagggaaagcgcacaacggaagactgatcacagctaatcctgttgtgaccaagaaagaggaacccgtcaacattgaggccgaaccccctttcggcgagtccaatatcgtgattgggatcggcgataacgcccttaagatcaattggtataaaaagggatctagcattggcaagatgtttgaagctacggcccgcggggctcggagaatggccatcctcggagacacagcgtgggatttcggctccgtggggggagttctgaacagcctgggcaaaatggtccatcagatttttgggtctgcctacaccgctctcttctccggcgtgagctgggtgatgaagatcggaattggcgtcctgcttacctggatcgggctgaattctaaaaacacaagcatgtccttttcttgcattgccatcggaatcattaccctctatctgggcgctgtggttcaggccgacatggggtgtgtgatcaattggaagggaaaagagctgaagtgcggcagcgggattttcgtcacaaacgaggtgcacgcgtggacggaacagtacaagtttcaagccgattccccgaaacgccttgctaccgccatcgctggcgcctgggagaatggagtttgtggcattcggagcacaaccagaatggaaaacctcctgtggaagcagatcgccaatgagctgaactatatcctctgggaaaataacattaaactgacagtggtcgtgggggacatcattggagttcttgagcagggcaagcgcaccctgacgccccagcctatggagctcaaatactcttggaagacctgggggaaagctaagatcgtgacagcggaaacccaaaactccagcttcattatcgatggacccaatacacctgagtgcccctctgcctcccgggcttggaacgtctgggaagtggaggactatggctttggcgtgttcaccacaaatatctggctgaagctgagagaagtctacacccagctttgtgaccatcgcctcatgagcgccgccgttaaagatgagcgggctgtgcacgccgacatggggtactggattgagtcccagaagaacggatcttggaaactggaaaaggcgagcctgatcgaggtgaaaacgtgcacatggccgaagtcccacaccctctggtctaatggcgtcctggaaagcgatatgattatccctaagtcccttgctgggcccattagccagcataaccacagacctggatatcatacccaaacagccggcccctggcacctggggaaactcgagctggactttaattactgcgagggaaccacggtggttatcacagaaaactgtggcacccgcggcccttctctgcggacaaccacagtgtccgggaagcttatccacgagtggtgctgtagaagctgcaccctccccccgctgcggtatatgggagaagatggctgttggtacgggatggagattcgccctatctctgaaaaagaggagaatatggtcaagtccctggtgagcgccggatctggcaaagttgacaacttcacgatgggggtgctctgcctggctattctttttgaagaggtcatgagaggaaagttcggcaagaaacatatgatcgccggcgtgttctttaccttcgttctgctcctgagcgggcagattacatggcgggatatggcgcacaccctgatcatgattggatccaatgctagcgacagaatgggcatgggggtgacatatcttgccctgatcgccacctttaagatccagcccttcctcgctctgggatttttcctccgcaaactgacgtctcgggaaaaccttctgctcggcgtcgggctggccatggctacaaccctgcaacttcccgaggatattgaacagatggccaatggaatcgcgctgggcctcatggccctgaagctcattacacagtttgagacctaccagctgtggaccgctcttatctccctgacatgtagcaacacgatgttcaccctcacagtggcctggagaaccgctacactgattctggccggcgtgtcccttctgcctgtctgccaatctagctccatgcgcaaaaccgactggctcccgatggccgttgctgcgatgggggtgccccctctgcccctctttatcttctctctgaaggatacgcttaagagacggagctggcctctgaatgagggagtgatggccgtcggcctggtgtccatcctcgcttctagcctgcttcgcaacgacgttcccatggccgggcctctggtggccggaggcctcctgattgcttgttatgtcatcacagggacctccgccgatctcaccgtggaaaaagcggctgacattacatgggaggaagaggccgaacagaccggagttagccataacctgatgatcacagtggacgatgacggcacgatgagaattaaggatgacgagaccgagaatatccttacagtcctgctgaaaaccgccctcctgatcgtgtctggcgtctttccctactccattccggctacacttctggtgtggcacacctggcagaagcagacgcaacggagcggggttctctgggatgtgccttctccccctgaaacccagaaagccgagctggaagagggagtctaccgcatcaagcagcagggcattttcgggaaaacacaagtgggagttggcgtgcagaaggagggggtctttcataccatgtggcacgtgacaagaggagcggtgctcacctataacggcaagcggctggaacccaattgggcttccgttaaaaaggaccttatcagctacggcgggggatggcgcctgtctgcccagtggcaaaaaggcgaggaagtccaggtgattgccgtggagccggggaagaaccctaaaaatttccagacaatgcccggaacgttccagaccacaaccggcgaaatcggggctattgccctggattttaagcctggaacctccggcagccccatcatcaacagagagggcaaggtcgtggggctctatggaaatggcgttgtgacaaaaaacgggggatacgtctccggcattgctcaaacgaatgccgagcccgacgggcctaccccggaactggaggaagagatgttcaagaaacggaaccttacaatcatggatctgcaccccggcagcggaaagacccgcaaatatctccctgcgattgtgagagaagccatcaagcggagactgcgcacactcattctggctcccacccgggttgtggccgctgagatggaggaagcccttaagggcctgcctatcagataccagacgacagccaccaaatctgagcataccgggcgcgaaatcgtcgacctgatgtgccacgctacatttaccatgcggctcctgagccccgtgagagttcctaattataaccttattatcatggatgaggcgcatttcacagacccggcctccattgctgcccgcggatacatctctacccgggtgggcatgggggaagccgctgccatttttatgacggcgacaccccctggaaccgctgatgccttcccccagagcaatgcccctatccaggacgaggagagagacatccccgaacgctcctggaactctggcaatgagtggattacagattttgctgggaagaccgtctggttcgtgccgagcatcaaagccggcaacgacattgcgaactgtctgcggaagaatggaaaaaaggtgatccaactctccagaaagacgtttgataccgaataccagaaaacaaagctgaacgactgggatttcgtcgttaccacagacatttctgagatgggcgccaattttaaagctgatcgggtgatcgaccctcgcagatgcctgaagcccgtgattctcaccgatgggcccgagcgggtcatccttgccggacctatgcccgtgacagctgccagcgctgcccagcgcagaggccgggttgggagaaaccctcagaaagaaaatgaccaatatatcttcaccggacagccgctgaacaatgatgaggaccacgcgcattggacggaagccaagatgctgctcgacaacattaatacacccgagggcatcattcctgctctgttcgaacccgagcgcgagaagtccgccgctatcgatggggaataccggcttaaaggcgagagcagaaagacctttgtggaactgatgcgccggggagacctccctgtctggctggcccacaaagtggcctctgagggcattaagtataccgatagaaaatggtgcttcgacgggcagcgcaacaatcagatcctggaagagaacatggatgttgagatctggacaaaggaaggagagaaaaagaagctccggcccagatggcttgacgctcgcacctactccgatccgctggcgctgaaagaatttaaggacttcgccgctggcagaaaaagcattgccctcgatctggtgacagagatcgggcgggtcccttctcaccttgcccatcgcacgagaaatgctctggacaacctcgtgatgctgcacacctccgaacatggaggccgggcctatcgccacgcggtcgaggagctgcccgaaacaatggagaccctccttctgctgggcctcatgattctgcttacagggggagccatgctgtttctcatcagcggcaaggggattggaaaaacctccatcggcctgatctgtgtgattgcttctagcgggatgctgtggatggccgaaatccctctccaatggattgcttccgccatcgttcttgagttctttatgatggtgctgctgattcccgagcctgaaaagcagagaacgccccaggataatcaactcgcgtacgtggtcatcggaattctgacccttgccgctatcatcgccgctaacgagatgggcctgctcgaaacaaccaagcgggacctgggcatgagcaaagagccgggggttgtgtctcctacatcctatctggatgtggacctccaccccgccagcgcttggaccctttacgccgtcgcgacgacagtgattacccccatgctgagacatacaatcgaaaattctaccgccaacgttagcctggctgccattgctaaccaggccgtggtcctcatgggactggacaagggctggcctatctccaaaatggatcttggggtgccgctgctcgccctgggatgctactctcaggtcaatcccctgaccctcacagcggctgtgcttctgctgattacgcactatgccatcatcggccctgggctccaggctaaggccacccgcgaggcccaaaaacggacagctgccggaattatgaagaaccccaccgttgacggcatcatgacaattgatctggaccctgtgatctacgatagcaagttcgagaaacagcttggccaggtcatgctgctcgtgctgtgtgcggttcagctgctccttatgagaacctcctgggccctgtgcgaagctctgacgctcgccacagggcccattaccaccctgtgggagggatctcctggcaagttttggaatacaaccatcgctgtgagcatggccaacatcttccgcgggtcctatcttgcgggagccggcctggcttttagcattatgaaatctgtcgggacaggaaagcggggcacgggctcccaaggggaaaccctcggagagaaatggaagaagaaactgaatcagctgagcagaaaggaattcgacctctacaaaaagtccggcatcacagaggtggatcggaccgaggccaaagaagggcttaagcgcggagagattacacatcacgctgtgtctagaggcagcgccaaactgcagtggtttgttgaacggaacatggtcatcccggaggggcgcgtgattgacctgggatgtggcagaggcgggtggtcctattactgcgctggactcaagaaggtgaccgaagtccggggctatacgaaagggggacccggccatgaggagcctgttcccatgtctacctacgggtggaatatcgtgaagctgatgagcggaaaagatgtgttctaccttcctcccgaaaagtgtgacacactgctctgcgatattggcgagtccagcccgtctcctaccgtcgaagagtcccgcacaatcagagtgctgaaaatggttgagccctggctgaagaacaatcagttctgtatcaaggtgctcaacccctatatgcctaccgtcattgaacaccttgagcggctgcaacgcaaacacggcgggatgctggtgagaaatcccctcagccggaactctacacatgaaatgtactggatctccaatggaaccggcaacattgttgccagcgtgaatatggtctctagactgcttctgaaccgctttacgatgacacaccggagacctaccatcgagaaggacgtggatctcggggcgggaacccgccatgtgaacgccgaaccggagacacccaatatggacgtcattggcgagcggatcaaaagaatcaaggaagagcacaacagcacgtggcactatgacgatgaaaatccttacaaaacctgggcttatcatgggtcctacgaggttaaggccacaggatctgctagctccatgattaacggcgtggtgaagctgctgaccaaaccctgggacgtcgtgcctatggttacacagatggccatgaccgatacaacccccttcggccagcaacgcgtgtttaaggaaaaagtcgacacgcggaccccgagaagcatgcctgggacacgccgggtgatgggaatcaccgccgagtggctctggagaacactgggccgcaataagaaaccccggctttgcaccagagaggaattcacgaagaaggttcgcacaaacgcggctatgggggccgtgtttaccgaggaaaatcagtgggattccgccaaagctgccgtcgaggacgaagatttctggaagctggtggacagagagcgggagctccacaaactgggaaagtgtggctcttgcgtttataacatgatggggaaacgcgaaaagaaacttggcgagtttggaaaggctaagggcagcagagccatttggtacatgtggctgggggcgcggtacctcgaattcgaggccctgggatttctgaatgaggatcattggttctccagagaaaactcttatagcggcgtggagggggaaggactccacaaactgggctacatccttcgggacatttccaagatccctgggggcgctatgtatgccgatgacacagctggatgggacacccgcatcacggaggatgacctgcataatgaagagaaaattacccagcagatggatcccgagcacagaaagctcgccaacgcgatctttaaactgacataccaaaataaggtcgtgaaggtccagcggcctacccccacaggcaccgtgatggacattatctctcgcaaagatcagagagggagcggacaggttggcacatatgggcttaacaccttcacgaatatggaagcccaactgattcggcagatggagggagaaggcgtgctctccaaggctgacctggagaacccgcacctgcctgaaaaaaagatcacacagtggctcgagaccaaaggggtcgagcgcctgaagagaatggccatcagcggcgatgactgcgtggtgaagcccattgatgaccggtttgctaacgcccttctggctctcaatgatatgggaaaagttcgcaaggacatcccccagtggcaaccttctaaaggctggcatgattggcagcaggtgccgttctgttcccaccatttccacgaactgattatgaaggacgggagaaaacttgtcgtgccctgccggcctcaggacgagctgatcggacgcgccagaattagccaaggcgcggggtggtctctccgggaaaccgcctgtctgggaaaggcttacgcccagatgtggtccctgatgtattttcaccgcagagatctccggctggccagcaacgctatctgctctgccgttcccgtgcattgggtccctacatccagaaccacatggagcattcacgcgcatcaccagtggatgacgaccgaggacatgcttacagtgtggaatcgcgtctggatcgaagataacccctggatggaggacaagacccctgtgacaacctgggagaatgttccctacctgggcaaacgggaagatcaatggtgtgggtccctcatcggcctgacgagcagagctacctgggcccagaacattccgacagccatccagcaggtgcgctctcttattggaaatgaggaattcctggactacatgcctagcatgaagcggtttagaaaagaggaggaatccgagggcgctatctggtga

SEQ ID NO: 20432 - RNA, 9873 nt, synthetic construct
  misc_feature 1..9873: note = derived and/or modified CDS sequence (opt5) from DENV-3__GU131868__SS-prME
  source 1..9873: mol_type = other RNA
acacccctgtgcctcatgatgatcctgcctgccgctcttgccttccacctgaccagcagagacggagaaccgcggatgattgtggggaagaacgaacgcggaaaatccctgctgtttaagacggcgtctggcatcaatatgtgtacccttattgctatggatctgggggagatgtgcgacgatacagtgacctacaaatgtccccacatcacagaagttgagcctgaagacattgattgctggtgtaacctcaccagcacatgggtgacctatggaacgtgcaatcaggccggcgagagacggcgcgacaagagatccgtggccctggctccccacgtcgggatgggactggatacccggacacagacctggatgtctgccgagggcgcttggcgccaggtggaaaaagttgagacatgggccctcagacatcctggcttcaccatcctggcgctttttctggcccactacatcgggacgagcctcacacagaaggtggtcattttcatcctgcttatgctggtgaccccctccatgacaatgcggtgtgttggagtgggcaaccgcgactttgtcgaagggctctctggagctacctgggtggatgtggtcctggagcatggcgggtgcgttaccacaatggccaagaataaacctacgctggacattgagctccagaagaccgaagctacacaactggccacccttagaaaactgtgtatcgagggaaagattacaaacatcaccacggatagccggtgcccgacacagggcgaagcggtgctccccgaggaacaggaccagaattatgtgtgtaaacacacctacgtcgatcgcggctgggggaacggatgcggcctgttcgggaagggatcccttgtgacctgcgccaagtttcaatgtctggagctcattgagggcaaagttgtgcagtatgaaaatctgaagtacacagtcatcatcaccgtgcacacaggggaccagcatcaggttggaaacgagacgcaaggcgtgaccgctgaaattacacctcaggccagcaccacagaggctatcctgcccgaatatggcaccctcgggctggagtgctctcctagaacgggacttgacttcaatgagatgattctgctcaccatgaaaaacaaggcctggatggtccaccggcagtggtttttcgatctgccccttccgtggacatccggcgccaccacagaaacccctacgtggaatcgcaaagagctgctcgtgacatttaacaatgctcatgcgaagaaacaagaagtcgtggttctggggagccaggagggagccatgcacaccgctctgacaggcgccaccgaaatccagaactctgggggcacctccattttcgccggacacctcaagtgtagactgaagatggacaaacttgagctgaagggcatgagctacgctatgtgcacaaacacgtttgtgctcaaaaaggaggtctctgaaacccagcatgggacaatcctgatcaaagtggagtacaagggagaagatgccccctgtaagattcctttctccaccgaggacggccaagggaaagcgcacaatggacggctgatcacagctaaccccgttgtgaccaagaaagaggaacccgtcaatattgaggccgaacctccgttcggcgagagcaacatcgtgattgggatcggcgataatgcccttaagatcaactggtataaaaagggatcctctattggcaagatgtttgaagctacggccagaggggctcgccggatggccatcctcggagacacagcgtgggatttcggcagcgtcgggggagttctcaattccctgggcaaaatggtccatcagatttttgggagcgcctacaccgctctcttctctggcgtgtcctgggtgatgaagatcggaattggcgtcctgcttacctggatcgggctgaacagcaaaaatacatctatgagcttttcctgcattgccatcggaatcattaccctctatctgggcgctgtggttcaggccgacatggggtgtgtgatcaactggaagggaaaagagctgaagtgcggctctgggattttcgtcacaaatgaggtgcacacgtggaccgaacagtacaagtttcaagcggatagccccaaaagacttgccacagctatcgccggcgcttgggagaacggagtttgtggcattcgctccaccacacggatggaaaatctcctgtggaagcagatcgccaacgagctgaattatatcctctgggaaaacaacattaaactgaccgtggtcgtgggggacatcattggagttcttgagcagggcaagagaacgctgacccctcagcccatggagctcaaatacagctggaagacatgggggaaagccaagatcgtgaccgctgaaacacaaaattcttccttcattatcgatggacctaacacccccgagtgcccgagcgcgtctcgcgcctggaatgtctgggaagtggaggactatggctttggcgtgttcacaaccaacatctggctgaagctgcgggaagtctacacgcagctttgtgaccatagactcatgtccgctgccgttaaagatgagcgcgccgtgcacgctgacatggggtactggattgagagccagaagaatggatcctggaaactggaaaaggcctctctgatcgaggtgaaaacatgcacctggcctaagagccacaccctctggtccaacggcgtcctggaatctgatatgattatccccaagagccttgcggggcctatttcccagcataatcaccggcccggatatcatacacaaaccgctggcccttggcacctggggaaactcgagctggactttaactactgcgagggaacgacagtggttatcaccgaaaattgtggcacaagaggccccagcctgcgcaccacaaccgtgtctgggaaacttatccacgagtggtgctgtcggtcctgcacgctcccgcctctgagatatatgggagaagatggctgttggtacgggatggagattcggcccatcagcgaaaaagaggagaacatggtcaagtctctggtgtccgccggaagcggcaaagttgacaatttcaccatgggggtgctctgcctggccattctttttgaagaggtcatgcgcggaaagttcggcaagaaacatatgatcgctggcgtgttctttacattcgttctgctcctgtctgggcagattacctggagagatatggcccacacactgatcatgattggaagcaacgcgtccgaccggatgggcatgggggtgacctatcttgctctgatcgccacgtttaagatccagcccttcctcgccctgggatttttcctcagaaaactgacaagccgcgaaaatcttctgctcggcgtcgggctggctatggccaccacactgcaacttcctgaggatattgaacagatggctaacggaatcgccctgggcctcatggcgctgaagctcattacccagtttgagacctaccagctgtggacagcccttatctctctgacgtgttccaataccatgttcacactcaccgtggcttggcggacagccaccctgattctggctggcgtgagccttctgccggtctgccaatcctctagcatgagaaaaacggactggctccccatggccgttgccgctatgggggtgcctcccctgcctctctttatcttctccctgaaggatacacttaagcgcagatcttggcccctgaacgagggagtgatggcggtcggcctggtgagcatcctcgcctcctctctgcttcggaacgacgttcctatggctgggcccctggtggccggaggcctcctgattgcctgttatgtcatcaccgggaccagcgctgatctcacagtggaaaaagccgcggacattacctgggaggaagaggctgaacagacaggagtttcccataatctgatgatcacggtggacgatgacggcaccatgcgcattaaggatgacgagacagagaacatccttaccgtcctgctgaaaacagccctcctgatcgtgagcggcgtctttccgtactctattcctgccacccttctggtgtggcacacgtggcagaagcagacccaaagatccggggttctctgggatgtgcccagccctcccgaaacacagaaagctgagctggaagagggagtctaccggatcaagcagcagggcattttcgggaaaacccaagtgggagttggcgtgcagaaggagggggtctttcatacaatgtggcacgtgacccgcggagccgtgctcacatataatggcaagagactggaaccgaactgggcgtctgttaaaaaggaccttatctcctacggcgggggatggcggctgagcgctcagtggcaaaaaggcgaggaagtccaggtgattgccgtggagcctgggaagaatcccaaaaacttccagacgatgcctggaaccttccagacaaccaccggcgaaatcggggccattgctctggattttaagcccggaacatctggctcccccatcatcaatcgcgagggcaaggtcgtggggctctatggaaacggcgttgtgacgaaaaatgggggatacgtcagcggcattgcccaaaccaaggctgagcctgacgggccgacacccgaactggaggaagagatgttcaaaaagagaaaccttaccatcatggatctgcaccctggctccggaaaaacacggaagtatctccccgccattgtgcgcgaagcgatcaagagacggctgagaaccctcattctggcccctacgcgcgttgtggctgccgagatggaggaagctcttaaaggcctgcccatccggtaccagacaaccgccaccaagagcgagcatacagggagagaaatcgtcgacctgatgtgccacgccacctttacaatgcgcctcctgtctcctgtgcgggttccgaattataaccttattatcatggatgaggctcatttcaccgaccccgcgagcattgccgctagaggatacatctccacgcgcgtgggcatgggggaagcctctgccatttttatgacagctacccctcccggaacagccgatgcgttccctcagagcaatgctcccatccaggacgaggagcgggacatcccggaaagatcctggaactctggcaatgagtggattaccgattttgccgggaaaacggtctggttcgtgcctagcatcaaggccggcaacgacattgctaactgtctgcgcaaaaatggaaagaaggtgatccaactctcccggaaaacctttgatacagaataccagaagaccaaactgaacgactgggatttcgtcgttacaaccgacatttctgagatgggcgccaattttaaggcggatagagtgatcgacccccggcgctgcctgaaacccgtgattctcacagatgggcctgagagagtcatccttgccggacccatgcctgtgaccgctgccagcgctgcccagcggcgcggcagagttgggcggaacccgcagaaggaaaatgaccaatatatcttcacgggacagcccctgaacaatgatgaggaccacgctcattggacagaagccaagatgctgctcgacaacattaatacccctgagggcatcattcccgcgctgttcgaacctgagagagagaaatccgccgctatcgatggggaataccgccttaagggcgagagccggaaaacctttgtggaactgatgagacgcggagacctccccgtctggctggcccacaaggtggcttctgagggcattaaatatacagatcggaagtggtgcttcgacgggcagagaaacaatcagatcctggaagagaacatggatgttgagatctggaccaaagaaggagagaagaagaaactccgcccgcggtggcttgacgccagaacatactccgatcctctggccctgaaggaatttaaagacttcgctgcgggccgcaagagcattgccctcgatctggtgacggagatcgggagagtcccctctcaccttgctcatcggacccgcaatgccctggacaacctcgtgatgctgcacacatccgaacatggaggcagagcctatcggcacgctgtcgaggagctgcctgaaaccatggagacactccttctgctgggcctcatgattctgcttaccgggggagccatgctgtttctcatcagcggcaaagggattggaaagacgtccatcggcctgatctgtgtgattgcgtctagcgggatgctgtggatggccgaaatccccctccaatggattgcttccgccatcgttcttgagttctttatgatggtgctgctgattcctgagcccgaaaagcagcgcaccccgcaggataatcaactcgcttacgtggtcatcggcattctgacacttgccgcgatcatcgccgctaacgagatgggcctgctcgaaaccacaaaaagagacctgggcatgagcaaggagccttctgttgtgtcccccaccagctatctggatgtggacctccaccccgcctctgcttggacgctttacgccgtcgctacaaccgtgattacacctatgctgcggcataccatcgaaaatagcaccgccaacgtttccctggcggccattgctaaccaggccgtggtcctcatggggctggacaaaggatggccgatctctaagatggatcttggcgtgcccctgctcgctctggggtgctacagccaggtcaatcctctgacactcacggccgccgtgttccttctgattacccactatgcgatcatcggacccggcctgcaggctaaagccacaagagaggctcaaaagcgcaccgccgccgggattatgaagaaccctacagttgacggaatcatgaccattgatctcgaccccgtgatctacgattccaaatttgagaagcagctgggccaggtcatgcttctggtgctctgtgctgttcagctgctgctcatgcggacgtcttgggccctttgcgaagcgctgacactggccaccggccctattaccacactctgggaggggagcccgggaaaattctggaataccacaatcgctgtgtccatggccaacatctttagaggcagctatctggctggggccggacttgcgttctctattatgaagtccgtcggcacggggaaacgcggaaccggcagccaaggcgaaacactgggggagaagtggaagaaaaagctcaatcagctgtcccggaaagaatttgacctgtacaagaaatctggaatcaccgaggtggatagaacagaggccaaggaaggcctcaaacgcggggagattacccatcacgctgtgagccggggatccgccaaacttcagtggttcgttgaaagaaacatggtcatccccgagggccgggtgattgacctggggtgtggacgcggcggctggtcttattactgcgctgggctgaagaaagtgacggaagtcagaggatataccaagggcgggcctggacatgaggagcccgttcctatgagcacatacggctggaatatcgtgaaactcatgtccgggaaggatgtgttctacctgcccccggaaaaatgtgacacccttctgtgcgatattggagagagctctccttcccccacagtcgaagagagccggaccatccgcgtgctcaagatggttgagccctggctgaagaacaatcagttttgtatcaaagtgctgaacccttatatgcccacagtcattgaacacctcgagagacttcaacggaagcacggcggcatgctggtgcgcaatcctctgtctagaaactccacccatgaaatgtactggatcagcaatgggacgggaaacattgttgcctctgtgaatatggtcagccggctcctgcttaacagattcacaatgacccaccgccggccgaccatcgagaaagacgtggatctgggcgctgggacaagacatgtgaacgccgaacccgagacgcctaatatggacgtcattggagagcgcatcaagcggatcaaagaagaacacaactccacctggcactatgacgatgaaaatccctacaagacatgggcgtatcatggctcttacgaggttaaggccaccgggagcgcttccagcatgattaacggagtggtgaaactcctgacaaagccttgggacgtcgtgcccatggttacccagatggccatgacagataccacgccgtttggccagcaaagagtgttcaaagaaaaggtcgacacccgcacacctcggtccatgcccggcaccagacgcgtgatggggatcacagctgagtggctgtggcggaccctcggaagaaataaaaagcctcgcctgtgcacgcgggaggaatttacaaagaaagttagaaccaacgccgccatgggcgcggtgttcacagaggaaaatcagtgggattctgctaaggccgccgtcgaggacgaagatttttggaaacttgtggaccgcgagagagagctgcacaagctcgggaaatgtggaagctgcgtttataacatgatgggcaagcgggagaagaagctgggggagttcggcaaggctaaaggatcccgcgccatttggtacatgtggcttggcgctagatacctggaatttgaggccctcgggttcctgaatgaggatcattggttttctcgggaaaacagctattccggagtggagggcgaagggctgcacaagctcggatacatcctgagagacatttctaaaatccccggcggggcgatgtatgccgatgacaccgctggctgggacacgcggatcaccgaggatgaccttcataatgaagagaagattacacagcagatggatcctgagcaccgccaactggccaacgctatcttcaaactcacctaccagaataaggtcgtgaaggtccagagacccacaccgaccggaacagtgatggacattatcagccggaaagatcagcgcggctccgggcaagttggaacctatggcctgaacacgtttacaaatatggaagcccagcttattagacagatggagggggaaggagtgctgagcaaggcggacctcgagaaccctcatctgcccgagaagaagatcacccagtggctggagaccaaaggcgtcgagcggctcaagcgcatggccatctctggggatgactgcgtggtgaagcccattgatgacagattcgctaacgccctgcttgctctgaatgatatgggcaaagttcggaaggacatccctcaatggcagccgtccaaaggatggcatgattggcaacaggtgcccttctgtagccaccattttcacgaactcattatgaaggacggccgcaaactggtcgtgccttgcagaccccaagacgagcttatcgggcgggcccgcatttctcagggagctggctggtccctgagagaaacagcctgtctcgggaaggcgtacgcccagatgtggagcctgatgtatttccaccggcgcgatctgagactcgcttctaacgccatctgctccgccgttcctgtgcattgggtccccaccagccggacaacgtggtccattcacgctcatcaccaatggatgaccacagaggacatgctgaccgtgtggaatagagtctggatcgaagataacccttggatggaggacaagacacccgtgaccacgtgggagaatgttccgtaccttggaaaacgcgaagatcagtggtgtggcagcctgatcgggctcacctctcgggccacatgggcgcagaacattcctaccgctatccagcaagtgagaagcctgattggcaatgaggaatttcttgactacatgccctccatgaagcgcttccggaaagaggaggaatctgagggagccatctggtga

SEQ ID NO: 20433 - RNA, 9873 nt, synthetic construct
  misc_feature 1..9873: note = derived and/or modified CDS sequence (opt5) from DENV-3__GU131869__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacattgcgtgggatttcggctccgttgggggagtcctcaacagcctgggcaaaatggtgcatcagatctttgggtctgcctacacagctctgttctccggcgtgagctgggtcatgaagattggaatcggcattctcctgacctggatcgggcttaattctaaaaacaccagcatgtccttttcttgcatcgccattggaatcattacactgtatctcggcgctgtggttcaggccgacatggggtgtgtgatcaattggaagggaaaagagctgaagtgcggcagcgggattttcgtcaccaacgaggtgcacacatggacggaacagtacaagtttcaagcggattcccccaaacgcctggccaccgctatcgccggcgcttgggagaatggagtttgtggcatccggagcacaaccagaatggaaaaccttctctggaagcagattgccaatgagctgaactatatcctgtgggaaaataacattaaactcacagtggtcgtgggggacatcattggagttctggagcagggcaagcgcacccttacgcctcagcccatggagctgaaatactcttggaagacctgggggaaagccaagatcgtgacagctgaaacccaaaactccagcttcatcattgatggacctaatacacccgagtgcccgtctgcgtcccgggcctggaacgtctgggaagtggaggactatggctttggcgtgttcaccacaaatatctggctcaagctgagagaagtctacacccagctgtgtgaccatcgccttatgagcgctgccgttaaagatgagcgggccgtgcacgctgacatggggtactggattgagtcccagaagaacggatcttggaaactcgaaaaggccagcctgatcgaggtgaaaacgtgcacatggcctaagtcccacaccctgtggtctaatggcgtcctcgaaagcgatatgattatccccaagtccctggcggggcctatcagccagcataaccacagacccggatatcatacccaaacagctggcccttggcaccttgggaaactggagctcgactttaattactgcgagggaaccacggtggttattacagaaaactgtggcacccgcggcccctctctgcggacaaccacagtgtccgggaagctgatccacgagtggtgctgtagaagctgcacccttccgcctctccggtatatgggagaagatggctgttggtacgggatggagattcgccccatctctgaaaaagaggagaatatggtcaagtccctggtgagcgccggatctggcaaagttgacaacttcacgatgggggtgctgtgcctcgccattctgtttgaagaggtcatgagaggaaagttcggcaagaaacatatgatcgctggcgtgttctttaccttcgttcttctgctcagcgggcagattacatggcgggatatgacccacacactgatcatgatcggatccaatgccagcgacagaatgggcatgggggtgacctatctggcgcttattgctacgtttaagatccagcccttcctggccctcggatttttcctgcgcaaactcacatctcgggaaaacctgcttctgggcgtcgggctcgccatggctaccacactgcaactgcctgaggatattgaacagatggccaatggaatcgctcttggcctgatggccctcaagctgattacccagtttgagacctaccagctctggacagcgctgatctcccttacgtgtagcaacaccatgttcacactgaccgtggcctggagaacagctaccctcatcctggccggcgtgtccctgcttccggtctgccaatctagctccatgcgcaaaacggactggctgcccatggctgttgccgccatgggggtgcctcccctccctctgtttattttctctctcaaggatacactgaagagacggagctggccccttaatgagggagtgatggctgtcggcctggtgtccatcctggcgtctagcctcctgcgcaacgacgttcctatggccgggccccttgtggctggaggcctgctcattgcctgttatgtcatcaccgggacctccgccgatctgacagtggaaaaagctgccgacattacctgggaggaagaggcggaacagacaggagttagccataacctcatgatcacggtggacgatgacggcaccatgagaatcaaggatgacgagacagagaatattctgaccgtccttctgaaaacagctctgctcatcgtgtctggcgtctttccgtactccattcctgccaccctgcttgtgtggcacacgtggcagaagcagacccaacggagcggggttctgtgggatgtgccctctcctcccgaaacacagaaagccgagctcgaagagggagtctaccgcatcaagcagcagggcattttcgggaaaacccaagtgggagttggcgtgcagaaggagggggtctttcatacaatgtggcacgtgaccagaggagctgtgctgacatataacggcaagcggctcgaaccgaattgggcctccgttaaaaaggacctgatcagctacggcgggggatggcgcctttctgcgcagtggcaaaaaggcgaggaagtccaggtgattgctgtggagcctgggaagaaccccaaaaatttccagacgacccctggaacattccagaccaccacaggcgaaatcggggccatcgccctggattttaagcccggaacgtccggcagccccattatcaacagagagggcaaggtcgtggggctgtatggaaatggcgttgtgaccaaaaacgggggatacgtctccggcattgctcaaacaaatgccgagcctgacgggccgacccccgaactcgaggaagagatgttcaagaaacggaacctgacaatcatggatcttcaccctggcagcggaaagacccgcaaatatctgcccgctattatcagagaagccatcaagcggagactccgcacgctgattctcgcgcctacacgggtggttgccgctgagatggaggaagccctgaagggccttcccatcagataccagaccaccgctacacgctctgagcataccgggcgggaaattgtggacctgatgtgccacgccacatttaccatgagactgctcagccctgtccgcgtgccgaattataacctgatcattatggatgaggcccatttcacggaccccgcttccatcgcggcccggggatacatctctacaagagttggcatgggggaagctgccgccatttttatgaccgctacacctcccggaaccgccgatgcgttccctcagagcaatgctcccatccaggacgaggagcgcgacattccggaacggtcctggaactctggcaatgagtggatcacggattttgccgggaaaaccgtgtggttcgtccctagcattaaggccggcaacgacatcgctaactgtcttagaaaaaatggaaagaaagtgattcaactgtcccggaagacatttgataccgaataccagaagacaaaactcaacgactgggatttcgtggtcaccacagacatctctgagatgggcgccaattttaaggcggatcgcgttatcgaccccagacggtgcctgaaacccgtgattctgaccgatgggcctgagcgcgtgatcctcgccggacccatgcctgtcacggctgccagcgctgcccagagacggggcagagtggggcgcaacccgcagaaggaaaatgaccaatatattttcacaggacagccccttaacaatgatgaggaccacgctcattggaccgaagccaaaatgctgctggacaacatcaatacccctgagggcattatccccgcgctcttcgaacctgagcgggagaagtccgccgctatcgatggggaatacagactgaagggcgagagccgcaaaacatttgttgaacttatgcggagaggagacctgcccgtgtggctcgcccacaaggtcgcttctgagggcattaaatataccgatcgcaagtggtgcttcgacgggcagcggaacaatcagatcctggaagagaacatggatgtggagatttggacaaaagaaggagagaagaaaaagctgagaccgcgctggctcgacgccagaacgtactccgatcctcttgccctgaaggaatttaaagacttcgctgcgggccggaagagcatcgccctggatctcgttaccgagattgggcgcgtgccctctcacctggctcatagaacacggaatgcccttgacaacctggtcatgctccacacctccgaacatggaggccgcgcctatagacacgctgtggaggagctgcctgaaacaatggagaccctgctccttctgggcctgatgatcctcctgacggggggagccatgctttttctgatcagcggcaaagggattggaaagacctccatcggcctcatttgtgtcatcgcgtctagcgggatgctgtggatggccgaaattcccctgcaatggatcgcttccgccattgtgctcgagttctttatgatggttcttctgatccctgagcccgaaaaacagcggacaccgcaggataatcaactggcttacgtggtgatcggaattctcaccctggccgcgatcattgccgctaacgagatgggccttctggaaacaaccaagagagacctcggcatgagcaaggagcctggggtcgtttctcccacgtcctatctggatgtggacctgcaccccgccagcgcttggacactctacgccgtggctaccacagtcatcacccctatgcttcgccataccattgaaaattctacagccaacgtgagcctggcggccatcgctaaccaggccgttgtgctgatgggactcgacaaaggctggccgatctccaagatggatctgggggtcccccttctggctctcggatgctactctcaggtgaatcctctgacgctgaccgccgccgtcctccttctgattacacactatgcgatcattggccccgggctgcaggctaaagccacccgggaggctcaaaagagaacagccgccggaatcatgaaaaaccctaccgtggacggcattatgacgatcgatctcgaccccgttatctacgatagcaagttcgagaagcagctgggccaggtgatgcttctggtcctctgtgctgtgcagctgctgctcatgcgcacatcctgggccctttgcgaagcgctgaccctggccaccgggcctattacaaccctctgggagggatctccgggcaaattttggaatacaacgatcgctgttagcatggccaacattttccgggggtcctatctggctggagccggccttgcgtttagcatcatgaagtctgtggggaccggaaaaagaggcacaggctcccaaggggaaaccctgggagagaagtggaaaaagaagctcaatcagctgagccggaaagaattcgacctgtacaagaaatccggcattacagaggtcgatcgcaccgaggccaaggaagggctcaaaagaggagagatcacgcatcacgctgtgtctcggggcagcgccaagcttcagtggtttgtggaacgcaacatggttattcccgaggggagagtcatcgacctgggatgtggccggggcgggtggtcctattactgcgctggactgaaaaaggtgaccgaagtgcgcggctatacaaaggggggacctggccatgaggagcccgtccctatgtctacctacgggtggaatatcgttaaactcatgagcggaaaggatgtgttctacctgcccccggaaaaatgtgacacacttctgtgcgatattggcgagtccagcccttctcccaccgtggaagagtccagaacaatccgggtcctcaagatggtggagccctggctgaaaaacaatcagttctgtattaaggttctgaacccttatatgcccaccgtgatcgaacacctcgagcgccttcaaagaaagcacggcgggatgctggtccggaatcctctgagcagaaactctacgcatgaaatgtactggatttccaatggaacaggcaacatcgtggccagcgttaatatggtgtctcgcctcctgcttaaccggtttaccatgacccacagacgcccgacaatcgagaaagacgtcgatctgggggctggaacgcggcatgtgaacgccgaacccgagacccctaatatggacgtgattggcgagagaatcaagcgcattaaagaagagcacaacagcacatggcactatgacgatgaaaatccctacaagacctgggcgtatcatgggtcctacgaggtcaaagccacaggatctgctagctccatgatcaacggcgttgtgaagctcctgaccaagccttgggacgtggtccccatggtgacacagatggccatgaccgatacgaccccgttcggccagcaacgggtttttaaagaaaaggtggacacaagaacccctcgcagcatgcccgggacacggagagtcatggagattaccgctgagtggctgtggcgcacgctcggacggaataaaaagcctagactgtgcacacgcgaagagttcaccaaaaaggtgagaacaaacgccgccatgggcgcggtttttaccgaagagaatcagtgggattccgctaaggccgccgtggaagacgaggatttctggaaacttgtcgaccgggagcgcgaactgcacaagctcgggaaatgtggatcttgcgtgtataacatgatgggcaagagagagaaaaagctgggggaatttggcaaagctaagggaagccgggccatctggtacatgtggcttggcgctagatacctggagttcgaggccctcgggtttctgaatgaagatcattggttctcccgggagaactcttatagcggagttgaaggcgaggggctgcacaagctcggatacatcctgcgcgacatttccaaaatccccggcggggcgatgtatgccgatgacacggctggctgggacaccagaattacagaagatgaccttcataatgaggagaagatcacccagcagatggatcctgaacaccggcaactggccaacgctatttttaaactcacataccagaataaggtggtcaaagtgcagcgccccaccccgacaggaaccgtcatggacatcatctctagaaaggatcagcggggcagcgggcaagtgggaacgtatggcctgaacacattcaccaatatggaggcccagcttattcgccagatggaaggggagggagttctgtccaaggcggacctcgaaaaccctcacctgcccgagaaaaagatcacccagtggctggagacaaaaggcgtggaaagactcaagcggatggccattagcggggatgactgcgtcgtgaaacccatcgatgaccgctttgctaacgccctgcttgctctgaatgatatgggcaaggtgagaaaggacattcctcaatggcagccgtctaaaggatggcatgattggcagcaggttcccttctgttcccaccatttccacgagctcatcatgaaggacggccggaaactggtggtcccttgccgcccccaagacgaacttattgggagagcccggatcagccagggagctggctggtctctgcgcgagaccgcctgtctcgggaaggcgtacgcccagatgtggtccctgatgtattttcacagacgggatctgagactcgctagcaacgccatctgctctgccgtgcctgttcattgggtgcccacatcccgcacgacctggagcattcacgctcatcaccaatggatgacaaccgaagacatgctgacagtctggaatcgggtgtggatcgaggataacccttggatggaggacaaaacccccgtcacgacctgggaaaatgtgccgtaccttggaaagagagaggatcagtggtgtggctccctgattgggctcacaagccgcgccacctgggcgcagaacatccctacagctattcagcaagttcggtctctgatcggcaatgaagagttccttgactacatgcccagcatgaagagatttcgcaaagaggaagagtccgaaggagccatctggtga

SEQ ID NO: 20434 - RNA, 9873 nt, synthetic construct
  misc_feature 1..9873: note = derived and/or modified CDS sequence (opt5) from DENV-3__GU131870__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtaccggggagaagatgccccctgtaagattcctttcagcaccgaggacggccaagggaaagcgcacaacggaagactgatcacagctaatcccgttgtgaccaagaaagaggaacccgtcaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgtggggggagttctcaacagcctgggcaaaatggtccatcagatttttgggtctgcctacaccgctctgttctccggcgtgagctgggtgatgaagatcggaattggcatcctcctgacctggattgggcttaattctaaaaacacaagcatgtccttttcttgcatcgccatcggaattatcaccctgtatctcggcgctgtcgtgcaggccgacatggggtgtgttattaattggaagggaaaagagctgaagtgcggcagcgggatcttcgtgacaaacgaggtccacacgtggaccgaacagtacaagtttcaagcggattcccccaaacgcctggccacagctattgccggcgcttgggagaatggagtgtgtggcatccggagcaccacaagaatggaaaaccttctctggaagcagatcgccaatgagctgaaccatattctgtgggaaaataacatcaaactcaccgttgtggtcggggacattatcggagtgctggagcagggcaagcgcacgcttacccctcagcccatggagctgaaatattcttggaagacatgggggaaagccaagattgttaccgctgaaacacaaaactccagcttcatcatcgatggacctaatacccccgagtgcccgtctgcgtcccgggcctggaacgtgtgggaagtcgaggactacggctttggcgtgttcacaaccaatatttggctcaagctgagagaagtgtatacgcagctgtgtgaccaccgccttatgagcgctgccgtcaaagatgagcgggccgttcacgctgacatggggtactggatcgagtcccagaagaacggatcttggaaactcgaaaaggccagcctgattgaggtgaaaacatgcacctggcctaagtcccataccctgtggtctaatggcgtgctcgaaagcgatatgatcattcccaagtccctggcggggcctatcagccagcacaaccatagacccggataccacacacaaaccgctggcccttggcaccttgggaaactggagctcgactttaattattgcgagggaacgacagtcgtgatcaccgaaaactgtggcacacgcggcccctctctgcggaccacaaccgtttccgggaagctgattcatgagtggtgctgtagaagctgcacgcttccgcctctccggtacatgggagaagatggctgttggtatgggatggagatccgccccatttctgaaaaagaggagaatatggtgaagtccctggtcagcgccggatctggcaaagtggacaacttcaccatgggggttctgtgcctcgccatcctgtttgaagaggtgatgagaggaaagttcggcaagaaacacatgattgctggcgtcttctttacattcgtgcttctgctcagcgggcagatcacctggcgggatatgacacataccctgattatgatcggatccaatgccagcgacagaatgggcatgggggttacgtacctggcgcttatcgctacatttaagattcagcccttcctggccctcggatttttcctgcgcaaactcacctctcgggaaaacctgcttctgggcgtggggctcgccatggctacaaccctgcaactgcctgaggatatcgaacagatggccaatggaattgctcttggcctgatggccctcaagctgatcacccagtttgagacatatcagctctggacggcgctgatttcccttacctgtagcaacacaatgttcaccctgacagtcgcctggagaaccgctacgctcatcctggccggcgtgtccctgcttccggtgtgccaatctagctccatgcgcaaaacagactggctgcccatggctgtcgccgccatgggggttcctcccctccctctgtttatcttctctctcaaggataccctgaagagacggagctggccccttaatgagggagtgatggctgtgggcctggtctccattctggcgtctagcctcctgcgcaacgacgtgcctatggccgggccccttgttgctggaggcctgctcatcgcctgttacgtgattaccgggacatccgccgatctgatcgtcgaaaaagctgccgacattacctgggaggaagaggcggaacagacaggagtgagccacaacctcatgatcacggttgacgatgacggcaccatgagaatcaaggatgacgagacagagaatattctgaccgtgcttctgaaaacagctctgctcatcgtctctggcgtgtttccgtattccattcctgccaccctgcttgtctggcatacgtggcagaagcagacccaacggagcggggtgctgtgggatgttccctctcctcccgaaacacagaaagccgagctcgaagagggagtgtaccgcatcaagcagcagggcattttcgggaaaacccaagtcggagtgggcgttcagaaggagggggtgtttcacacaatgtggcacgtcaccagaggagctgtgctgacatacaacggcaagcggctcgaaccgaattgggcctccgtgaaaaaggacctgatcagctatggcgggggatggcgcctttctgcgcagtggcaaaaaggcgaggaagttcaggtcattgctgtggagcctgggaagaaccccaaaaatttccagacgatgcctggaaccttccagacaaccaccggcgaaatcggggccatcgccctggattttaagcccggaacatccggcagccccattatcaacagagagggcaaggtggtcgggctgtacggaaatggcgtggttacgaaaaacgggggatatgtgtccggcattgctcaaaccaatgccgagcctgacgggccgacacccgaactcgaggaagagatgttcaagaaacggaacctgaccatcatggatcttcatcctggcagcggaaagacacgcaaatacctgcccgctattatcagagaagccatcaagcggagactccgcaccctgattctcgcgcctacgcgggtcgtggccgctgagatggaggaagccctgaagggccttcccatcagatatcagacaaccgctaccaaatctgagcacacagggcgcgaaattgttgacctgatgtgccatgccacctttacaatgcggctgctcagccctgtgagagtcccgaattacaacctgatcattatggatgaggcccacttcaccgaccccgcttccatcgcggcccgcggatatatctctacgcgggtgggcatgggggaagctgccgccatttttatgacagctacccctcccggaacagccgatgcgttccctcagagcaatgctcccatccaggacgaggagagagacattccggaacgctcctggaactctggcaatgagtggatcaccgattttgccgggaagacggtttggttcgtgcctagcattaaagccggcaacgacatcgctaactgtcttcggaagaatggaaaaaaggtcattcaactgtccagaaagacctttgatacagaataccagaaaaccaagctcaacgactgggatttcgtggtgacaaccgacatctctgagatgggcgccaattttaaagcggatcgggtcatcgacccccgcagatgcctgaagcccgttattctgacagatgggcctgagcgggtgatcctcgccggacccatgcctgtgaccgctgccagcgctgcccagcgcagaggccgggtcgggagaaacccgcagaaagaaaatgaccaatacattttcacgggacagccccttaacaatgatgaggaccatgctcactggacagaagccaagatgctgctggacaacatcaatacccctgagggcattatccccgcgctcttcgaacctgagcgcgagaagtccgccgctatcgatggggaatatcggctgaaaggcgagagcagaaagacctttgtggaacttatgcgccggggagacctgcccgtttggctcgcccacaaagtggcttctgagggcattaagtacacagatagaaaatggtgcttcgacgggcagcgcaacaatcagatcctggaagagaacatggatgtcgagatttggaccaaggaaggagagaaaaagaagctgcggccgagatggctcgacgcccgcacatattccgatcctcttgccctgaaagaatttaaggacttcgctgcgggcagaaaaagcatcgccctggatctcgtgacggagattgggcgggttccctctcatctggctcaccgcaccagaaatgcccttgacaacctggtgatgctccatacatccgaacacggaggccgggcctaccgccacgctgtcgaggagctgcctgaaaccatggagacactgctccttctgggcctgatgatcctcctgaccgggggagccatgctttttctgatcagcggcaaggggattggaaaaacgtccatcggcctcatttgtgtgatcgcgtctagcgggatgctgtggatggccgaaattcccctgcaatggatcgcttccgccattgtcctcgagttctttatgatggtgcttctgatccctgagcccgaaaagcagagaaccccgcaggataatcaactggcttatgttgtgatcggaattctcacactggccgcgatcattgccgctaacgagatgggccttctggaaaccacaaagcgggacctcggcatgagcaaagagcctggggtggtctctcccacctcctacctggatgttgacctgcatcccgccagcgcttggacgctctatgccgtggctacaaccgtgatcacacctatgcttagacacaccattgaaaattctaccgccaacgtcagcctggcggccatcgctaaccaggccgtggttctgatgggactcgacaagggctggccgatctccaaaatggatctgggggtgccccttctggctctcggatgctactctcaggtcaatcctctgacactgacggccgccgtgctccttctgattacccattacgcgatcattggccccgggctgcaggctaaggccacacgcgaggctcaaaaacggaccgccgccggaatcatgaagaaccctacagtcgacggcattatgaccatcgatctcgaccccgtgatctatgatagcaagttcgagaaacagctgggccaggttatgcttctggtgctctgtgctgtccagctgctgctcatgagaacgtcctgggccctttgcgaagcgctgacactggccaccgggcctattaccacactctgggagggatctccgggcaagttttggaataccacaatcgctgtgagcatggccaacattttccgcgggtcctacctggctggagccggccttgcgtttagcatcatgaaatctgttgggacgggaaagcggggcaccggctcccaaggggaaacactgggagagaaatggaagaagaaactcaatcagctgagcagaaaggaattcgacctgtataaaaagtccggcattaccgaggtggatcggacagaggccaaagaagggctcaagcgcggagagatcacccaccatgctgtctctagaggcagcgccaaacttcagtggtttgtggaacggaacatggtgattcccgaggggcgcgttatcgacctgggatgtggcagaggcgggtggtcctactattgcgctggactgaagaaggtcacggaagtgcggggctacaccaaagggggacctggccacgaggagcccgtgcctatgtctacatatgggtggaatatcgtcaagctcatgagcggaaaagatgttttctacctgcccccggaaaagtgtgacacccttctgtgcgatattggcgagtccagcccttctcccacagtggaagagtcccgcaccatcagagtgctcaaaatggtcgagccctggctgaagaacaatcagttctgtattaaggtgctgaacccttacatgcccacagttatcgaacacctcgagcggcttcaacgcaaacatggcgggatgctggtgagaaatcctctgagccggaactctacccacgaaatgtattggatttccaatggaacgggcaacatcgtcgccagcgtgaatatggtttctagactcctgcttaaccgctttacaatgacccatcggagaccgaccatcgagaaggacgtggatctgggggctggaacacgccacgtcaacgccgaacccgagacgcctaatatggacgtgattggcgagcggatcaaaagaattaaggaagagcacaacagcacctggcattacgacgatgaaaatccctataaaacatgggcgtaccacgggtcctatgaggtgaaggccaccggatctgctagctccatgatcaacggcgtcgttaagctcctgacaaaaccttgggacgtggtgcccatggtcacccagatggccatgacagataccacgccgttcggccagcaacgcgtgtttaaggaaaaagttgacacccggacacctagaagcatgcccgggacccgccgggtgatgggaattacagctgagtggctgtggagaaccctcggccgcaataagaaacctcggctgtgcacgagagaggaattcacaaagaaggtccgcaccaacgccgccatgggggcggtgtttacagaggaaaatcagtgggattccgctaaagccgccgttgaggacgaagatttctggaagcttgtggacagagagcgggagctgcataaactcggaaagtgtggctcttgcgtctacaacatgatggggaaacgcgaaaagaaactgggcgagtttggaaaggctaagggcagcagagccatctggtatatgtggcttggggctcggtacctggaattcgaggccctcggatttctgaatgaggatcactggttctccagagaaaactcttacagcggcgtggagggggaaggactgcataaactcggctatatcctgcgggacatttccaagatccccgggggcgcgatgtacgccgatgacaccgctggatgggacacgcgcattaccgaggatgaccttcacaatgaagagaaaatcacacagcagatggatcctgagcacagacaactggccaacgctatttttaagctcacctatcagaataaagttgtgaaggtccagcggcccacaccgaccggcacagtgatggacatcatctctcgcaaggatcagagagggagcggacaagtcggcacctacgggctgaacacgttcacaaatatggaagcccagcttattcggcagatggagggagaaggcgtgctgtccaaagcggacctcgagaaccctcatctgcccgaaaagaaaatcacccagtggctggagaccaagggggttgagcgcctcaaaagaatggccattagcggcgatgactgcgtggtcaagcccatcgatgaccggtttgctaacgccctggtggctcttaatgatatgggaaaggtgcgcaaagacattcctcaatggcagccgtctaagggctggcacgattggcagcaggttcccttctgttcccatcacttccacgaactgatcatgaaagacgggagaaagctcgtggtcccttgccggccccaagacgagctgattggacgcgccagaatcagccagggcgctgggtggtctcttcgggaaacagcctgtctgggaaaagcgtatgcccagatgtggtccctcatgtactttcatcgcagagatctgcggctggctagcaacgccatctgctctgccgtgcctgttcactgggtgcccacctccagaacaacgtggagcattcatgctcaccatcaatggatgaccacagaggacatgctcaccgtctggaatcgcgtgtggatcgaagataacccttggatggaggacaagacacccgtcaccacgtgggagaatgtgccgtatctgggcaagcgggaagatcagtggtgtgggtcccttattggcctgaccagcagagccacatgggcgcagaacatccctaccgctattcagcaagttcgctctctcatcggaaatgaggaattcctggactacatgcccagcatgaaacggtttagaaaggaggaggaatccgagggcgccatctggtga

SEQ ID NO: 20435 - RNA, 9873 nt, synthetic construct
  misc_feature 1..9873: note = derived and/or modified CDS sequence (opt5) from DENV-3__GU131871__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaaccggcgccacaaccgaaacgcctacatggaatcgcaaagagcttctggtcacctttaagaacgctcatgcgaaaaagcaagaagtggttgtgctcgggagccaggagggagccatgcacacagctctgaccggcgccaccgaaatccagaattctgggggcacatccattttcgccggacacctgaagtgtagactcaaaatggacaagctggagcttaaaggcatgagctacgctatgtgcacgaacacctttgtcctgaagaaagaggtgtctgaaacacagcatgggaccatcctcatcaaggttgagtaccggggagaagatgccccctgtaagattcctttctccacagaggacggccaagggaaagcgcacaacggaagactgatcaccgctaatcccgtggtcacgaagaaagaggaacccgtgaacattgaggccgaacctccgttcggcgagagcaatatcgtgattgggatcggcgataacgccctgaagatcaattggtataaaaagggatcctctattggcaagatgtttgaagctacagcccgcggggctcggagaatggccatccttggagacaccgcgtgggatttcggcagcgttgggggagtcctcaactccctgggcaaaatggtgcatcagatttttgggagcgcctacaccgctctgttctctggcgtgtcctgggtcatgaagatcggaattggcatcctcctgacatggattgggcttaatagcaaaaacacctctatgagcttttcctgcatcgccatcggaattatcacactgtatctcggcgctgtggttcaggccgacatggggtgtgtgattaattggaagggaaaagagctgaagtgcggctctgggatcttcgtcacgaacgaggtgcacacctggacagaacagtacaagtttcaagcggatagccccaaacgcctggccaccgctattgccggcgcttgggagaatggagtttgtggcatccggtccacaaccagaatggaaaaccttctctggaagcagatcgccaatgagctgaactatattctgtgggaaaataacatcaaactcacggtggtcgtgggggacattatcggagttctggagcagggcaagcgcacccttacacctcagcccatggagctgaaatacagctggaagacctgggggaaagccaagattgtgacagctgaaacccaaaactcttccttcatcatcgatggacctaatacacccgagtgcccgagcgcgtctcgggcctggaacgtctgggaagtggaggactatggctttggcgtgttcaccacgaatatttggctcaagctgagagaagtctacacacagctgtgtgaccatcgccttatgtccgctgccgttaaagatgagcgggccgtgcacgctgacatggggtactggatcgagagccagaagaacggatcctggaaactcgaaaaggcctctctgattgaggtgaaaacctgcacctggcctaagagccacacactgtggtccaatggcgtcctcgaatctgatatgatcattcccaagagcctggcggggcctatctcccagcataaccacagacccggatatcatacccaaacggctggcccttggcaccttgggaaactggagctcgactttaattactgcgagggaacaaccgtggttatcacagaaaactgtggcacccgcggccccagcctgcggacaaccacggtgtctgggaagctgattcacgagtggtgctgtagatcctgcacccttccgcctctccggtatatgggagaagatggctgttggtacgggatggagatccgccccattagcgaaaaagaggagaatatggtcaagtctctggtgtccgccggaagcggcaaagttgacaacttcacaatgggggtgctgtgcctcgccatcctgtttgaagaggtcatgagaggaaagttcggcaagaaacatatgattgctggcgtgttctttaccttcgttcttctgctctctgggcagatcacatggcgggatatgacccacacgctgattatgatcggaagcaatgcctccgacagaatgggcatgggggtgacatatctggcgcttatcgctacctttaagattcagcccttcctggccctcggatttttcctgcgcaaactcacaagccgggaaaacctgcttctgggcgtcgggctcgccatggctaccaccctgcaactgcctgaggatatcgaacagatggccaatggaattgctcttggcctgatggccctcaagctgatcacacagtttgagacgtaccagctctggaccgcgctgatttctcttacatgttccaacaccatgttcacactgaccgtggcctggagaacggctacactcatcctggccggcgtgagcctgcttccggtctgccaatcctctagcatgcgcaaaaccgactggctgcccatggctgttgccgccatgggggtgcctcccctccctctgtttatcttctccctcaaggataccctgaagagacggtcttggccccttaatgagggagtgatggctgtcggcctggtgagcattctggcgtcctctctcctgcgcaacgacgttcctatggccgggccccttgtggctggaggcctgctcatcgcctgttatgtcattacagggaccagcgccgatctgacagtggaaaaagctgccgacatcacgtgggaggaagaggcggaacagaccggagtttcccataacctcatgattacagtggacgatgacggcaccatgagaatcaaggatgacgagacagagaatatcctgaccgtccttctgaaaacggctctgctcattgtgagcggcgtctttccgtactctatccctgccaccctgcttgtgtggcacacatggcagaagcagacccaacggtccggggttctgtgggatgtgcccagccctcccgaaacacagaaagccgagctcgaagagggagtctaccgcattaagcagcagggcatcttcgggaaaacccaagtgggagttggcgtgcagaaggagggggtctttcatacaatgtggcacgtgacgagaggagctgtgctgacctataacggcaagcggctcgaaccgaattgggcctctgttaaaaaggacctgatttcctacggcgggggatggcgccttagcgcgcagtggcaaaaaggcgaggaagtccaggtgatcgctgtggagcctgggaagaaccccaaaaatttccagacaacccctggaaccttccagacaacgaccggcgaaattggggccatcgccctggattttaagcccggaacatctggctcccccatcattaacagagagggcaaggtcgtggggctgtatggaaatggcgttgtgaccaaaaacgggggatacgtcagcggcatcgctcaaacaaatgccgagcctgacgggccgacccccgaactcgaggaagagatgttcaagaaacggaacctgacgattatggatcttcaccctggctccggaaagacacgcaaatatctgcccgctatcattagagaagccatcaagcggagactccgcaccctgatcctcgcgcctacccgggtggttgccgctgagatggaggaagccctgaagggccttcccattagataccagacaaccgctacaaaaagcgagcataccgggcgcgaaatcgtggacctgatgtgccacgccacgtttacaatgcggctgctctctcctgtcagagtgccgaattataacctgattatcatggatgaggcccatttcaccgaccccgctagcattgcggcccgcggatacatctccacacgggttggcatgggggaagctgccgccatctttatgaccgctacgcctcccggaaccgccgatgcgttccctcagtctaatgctcccattcaggacgaggagagagacatcccggaacgcagctggaactccggcaatgagtggattacagattttgccgggaagaccgtgtggttcgtcccttctatcaaagccggcaacgacattgctaactgtcttcggaagaatggaaaaaaggtgatccaactgagcagaaagacatttgataccgaataccagaaaacaaagctcaacgactgggatttcgtggtcaccacggacatttccgagatgggcgccaattttaaagcggatcgggttatcgacccccgcagatgcctgaagcccgtgatcctgacagatgggcctgagcgggtgattctcgccggacccatgcctgtcaccgctgcctctgctgcccagcgcagaggccgggtggggagaaacccgcagaaagaaaatgaccaatatatcttcaccggacagccccttaacaatgatgaggaccacgctcattggacagaagccaagatgctgctggacaacattaatacccctgagggcatcattcccgcgctcttcgaacctgagcgcgagaagagcgccgctatcgatggggaataccggctgaaaggcgagtccagaaagacatttgttgaacttatgcgccggggagacctgcccgtgtggctcgcccacaaagtcgctagcgagggcatcaagtatacggatagaaaatggtgcttcgacgggcagcgcaacaatcagattctggaagagaacatggatgtggagatctggaccaaggaaggagagaaaaagaagctgcggccgagatggctcgacgcccgcacatactctgatcctcttgccctgaaagaatttaaggacttcgctgcgggcagaaaatccattgccctggatctcgttaccgagatcgggcgggtgcccagccacctggctcatcgcacaagaaatgcccttgacaacctggtcatgctccacacctctgaacatggaggccgggcctatcgccacgctgtggaggagctgcctgaaacgatggagaccctgctccttctgggcctgatgattctcctgacagggggagccatgctttttctgatctccggcaaggggatcggaaaaaccagcattggcctcatctgtgtcattgcgtcctctgggatgctgtggatggccgaaatccccctgcaatggattgctagcgccatcgtgctcgagttctttatgatggttcttctgattcctgagcccgaaaagcagagaacaccgcaggataatcaactggcttacgtggtgatcggaatcctcaccctggccgcgattatcgccgctaacgagatgggccttctggaaacgacaaagcgggacctcggcatgtccaaagagcctggggtcgttagccccacctcttatctggatgtggacctgcaccccgcctccgcttggacactctacgccgtggctaccaccgtcattacacctatgcttagacatacgatcgaaaatagcaccgccaacgtgtctctggcggccattgctaaccaggccgttgtgctgatgggactcgacaagggctggccgatcagcaaaatggatctgggggtcccccttctggctctcggatgctactcccaggtgaatcctctgacactgaccgccgccgtcctccttctgatcacacactatgcgattatcggccccgggctgcaggctaaggccacccgcgaggctcaaaaacggacggccgccggaattatgaagaaccctacagtggacggcatcatgaccattgatctcgaccccgttatctacgattctaagttcgagaaacagctgggccaggtgatgcttctggtcctctgtgctgtgcagctgctgctcatgagaaccagctgggccctttgcgaagcgctgacactggccaccgggcctatcacaacgctctgggagggatccccgggcaagttttggaataccacaattgctgtttctatggccaacatcttccgcgggagctatctggctggagccggccttgcgttttccattatgaaaagcgtggggaccggaaagcggggcacaggctctcaaggggaaaccctgggagagaaatggaagagaaagctcaatcagctgtcccggaaagaattcgacctgtacaagaaaagcggcatcacggaggtcgatcgcaccgaggccaaggaagggctcaaaagaggagagattacacatcacgctgtgtcccggggctctgccaagcttcagtggtttgtggaacgcaacatggttatccccgaggggagagtcattgacctgggatgtggccggggcgggtggagctattactgcgctggactgaaaaaggtgaccgaagtgcgcggctatacaaaggggggacctggccatgaggagcccgtccctatgtccacctacgggtggaatatcgttaaactcatgtctggaaaggatgtgttctacctgcccccggaaaaatgtgacacacttctgtgcgatatcggcgagagctcccctagccccaccgtggaagagtctagaacgattcgggtcctcaagatggtggagccctggctgaaaaacaatcagttctgtatcaaggttctgaacccttatatgcccacagtgattgaacacctcgagcgccttcaaagaaagcacggcgggatgctggtccggaatcctctgtccagaaacagcacccatgaaatgtactggatctctaatggaaccggcaacattgtggcctccgttaatatggtgagccgcctcctgcttaaccggtttacaatgacgcacagacgcccgaccatcgagaaagacgtcgatctgggggctggaacacggcatgtgaacgccgaacccgagacccctaatatggacgtgatcggcgagagaattaagcgcatcaaagaagagcacaactctacatggcactatgacgatgaaaatccctacaagacctgggcgtatcatgggagctacgaggtcaaagccacaggatccgcttctagcatgattaacggcgttgtgaagctcctgaccaagccttgggacgtggtccccatggtgacgcagatggccatgaccgatacaaccccgttcggccagcaacgggtttttaaagaaaaggtggacacaagaacccctcgctccatgcccgggacgcggagagtcatggagatcacagctgagtggctgtggcgcaccctcggacggaataaaaagcctagactgtgcacacgcgaagagttcaccaaaaaggtgagaacgaacgccgccatgggcgcggtttttaccgaagagaatcagtgggatagcgctaaggccgccgtggaagacgaggatttctggaaacttgtcgaccgggagcgcgaactgcacaagctcgggaaatgtggatcctgcgtgtataacatgatgggcaagagagagaaaaagctgggggaatttggcaaagctaagggatctcgggccatttggtacatgtggcttggcgctagatacctggagttcgaggccctcgggtttctgaatgaagatcattggttcagccgggagaactcctattctggagttgaaggcgaggggctgcacaagctcggatacatcctgcgcgacatcagcaaaattcccggcggggcgatgtatgccgatgacacagctggctgggacaccagaatcacagaagatgaccttcataatgaggagaagattacccagcagatggatcctgaacaccggcaactggccaacgctatctttaaactcacataccagaataaggtggtcaaagtgcagcgccccaccccgacgggaacagtcatggacattatctccagaaaggatcagcggggctctgggcaagtgggaacctatggcctgaacaccttcacaaatatggaggcccagcttatccgccagatggaaggggagggagttctgagcaaggcggacctcgaaaaccctcacctgcccgagaaaaagattacccagtggctggagacaaaaggcgtggaaagactcaagcggatggccatctccggggatgactgcgtcgtgaaacccattgatgaccgctttgctaacgccctgcttgctctgaatgatatgggcaaggtgagaaaggacatccctcaatggcagccgagcaaaggatggcatgattggcagcaggttcccttctgttctcaccatttccacgagctcattatgaaggacggccggaaactggtggtcccttgccgcccccaagacgaacttatcgggagagcccggatttcccagggagctggctggagcctgcgcgagacggcctgtctcgggaaggcgtacgcccagatgtggtctctgatgtattttcacagacgggatctgagactcgcttccaacgccatctgcagcgccgtgcctgttcattgggtgcccacctctcgcacaacctggtccatccacgctcatcaccaatggatgacaaccgaagacatgctgacggtctggaatcgggtgtggattgaggataacccttggatggaggacaaaacccccgtcacaacctgggaaaatgtgccgtaccttggaaagagagaggatcagtggtgtggcagcctgatcgggctcacatcccgcgccacctgggcgcagaacattcctacggctatccagcaagttcggagcctgattggcaatgaagagttccttgactacatgccctctatgaagagatttcgcaaagaggaagagagcgaaggagccatctggtga

SEQ ID NO: 20436 - RNA, 9873 nt, synthetic construct
  misc_feature 1..9873: note = derived and/or modified CDS sequence (opt5) from DENV-3__GU131872__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgttgggggagtcctcaacagcctgggcaaaatggtgcatcagatttttgggtctgcctacaccgctctgttctccggcgtgagctgggtcatgaagatcggaattggcatcctcctgacctggattgggcttaattctaaaaacacaagcatgtccttttcttgcatcgccatcggaattatcaccctgtatctcggcgctgtggttcaggccgacatggggtgtgtgattaattggaagggaaaagagctgaagtgcggcagcgggatcttcgtcacaaacgaggtgcacacgtggaccgaacagtacaagtttcaagcggattcccccaaacgcctggccacagctattgccggcgcttgggagaatggagtttgtggcatccggagcaccacaagaatggaaaaccttctctggaagcagatcgccaatgagctgaactatattctgtgggaaaataacatcaaactcaccgtggtcgtgggggacattatcggagttctggagcagggcaagcgcacgcttacccctcagcccatggagctgaaatactcttggaagacatgggggaaagccaagatggtgaccgctgaaacacaaaactccagcttcattatcgatggacctaatacccccgagtgcccgtctgcgtcccgggcctggaacgtctgggaagtggaggactatggctttggcgtgttcacaaccaatatctggctcaagctgagagaagtctacacgcagctgtgtgaccatcgccttatgagcgctgccgttaaagatgagcgggccgtgcacgctgacatggggtactggattgagtcccagaagaacggatcttggaaactcgaaaaggccagcctgatcgaggtgaaaacatgcacctggcctaagtcccacaccctgtggtctaatggcgtcctcgaaagcgatatgattatccccaagtccctggcggggcctattagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgatccacgagtggtgctgtagaagctgcacgcttccgcctctccggtatatgggagaagatggctgttggtacgggatggagattcgccccatctctgaaaaagaggagaatatggtcaagtccctggtgagcgccggatctggcaaagttgacaacttcaccatgggggtgctgtgcctcgccattctgtttgaagaggtcatgagaggaaagttcggcaagaaacatatgatcgctggcgtgttctttacattcgttcttctgctcagcgggcagattacctggcgggatatgacacacaccctgatcatgattggatccaatgccagcgacagaatgggcatgggggtgacgtatctggcgcttatcgctacatttaagatccagcccttcctggccctcggatttttcctgcgcaaactcacctctcgggaaaacctgcttctgggcgtcgggctcgccatggctacaaccctgcaactgcctgaggatattgaacagatggccaatggaatcgctcttggcctgatggccctcaagctgattacccagtttgagacataccagctctggacggcgctgatctcccttacctgtagcaacacaatgttcaccctgacagtggcctggagaaccgctacgctcattctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccatcctggcgtctagcctcctgcgcaacgacgttcctatggccgggccccttgtggctggaggcctgctcattgcctgttatgtcatcaccgggacatccgccgatctgaccgtggaaaaagctgccgacattacatgggaggaagaggcggaacagacgggagttagccataacctcatgatcaccgtggacgatgacggcacaatgagaattaaggatgacgagaccgagaatatcctgacagtccttctgaaaaccgctctgctcatcgtgtctggcgtctttccgtactccattcctgccacgctgcttgtgtggcacacctggcagaagcagacacaacggagcggggttctgtgggatgtgccctctcctcccgaaacccagaaagccgagctcgaagagggagtctaccgcatcaagcagcagggcattttcgggaaaacacaagtgggagttggcgtgcagaaggagggggtctttcataccatgtggcacgtgacaagaggagctgtgctgacgtataacggcaagcggctcgaaccgaattgggcctccgttaaaaaggacctgatcagctacggcgggggatggcgcctttctgcgcagtggcaaaaaggcgaggaagtccaggtgattgctgtggagcctgggaagaaccccaaaaatttccagaccacacctggaaccttccagaccacaacgggcgaaatcggggccattgccctggattttaagcccggaacctccggcagccccatcatcaacagagagggcaaggtcgtggggctgtatggaaatggcgttgtgacaaaaaacgggggatacgtctccggcattgctcaaaccaatgccgagcctgacgggccgacacccgaactcgaggaagagatgttcaagaaacggaacctgaccatcatggatcttcaccctggcagcggaaagacgcgcaaatatctgcccgctattatcagagaagccattaagcggagactccgcacactgatcctcgcgcctacccgggtggttgccgctgagatggaggaagccctgaagggccttcccatcagataccagaccacagctaccaaatctgagcatacagggcgcgaaattgtggacctgatgtgccacgccacctttacgatgcggctgctcagccctgtcagagtgccgaattataacctgatcattatggatgaggcccatttcacagaccccgcttccatcgcggcccgcggatacatttctacccgggttggcatgggggaagctgccgccatctttatgacagctacccctcccggaacggccgatgcgttccctcagagcaatgctcccatccaggacgaggagagagacattccggaacgctcctggaactctggcaatgagtggatcaccgattttgccgggaagacagtgtggttcgtccctagcattaaagccggcaacgacatcgctaactgtcttcggaagaatggaaaaaaggtgattcaactgtccagaaagacctttgatacagaataccagaaaaccaagctcaacgactgggatttcgtggtcacaaccgacatctctgagatgggcgccaattttaaagcggatcgggttattgacccccgcagatgcctgaagcccgtgatcctgacggatgggcctgagcgggtgatcctcgccggacccatgcctgtcacagctgccagcgctgcccagcgcagaggccgggtggggagaaacccgcagaaagaaaatgaccaatatattttcaccggacagccccttaacaatgatgaggaccacgctcattggaccgaagccaagatgctgctggacaacatcaatacacctgagggcattatccccgcgctcttcgaacctgagcgcgagaagtccgccgctattgatggggaataccggctgaaaggcgagagcagaaagacctttgttgaacttatgcgccggggagacctgcccgtgtggctcgcccacaaagtcgcttctgagggcatcaagtatacagatagaaaatggtgcttcgacgggcagcgcaacaatcagatcctggaagagaacatggatgtggagatttggacgaaggaaggagagaaaaagaagctgcggccgagatggctcgacgcccgcacctactccgatcctcttgccctgaaagaatttaaggacttcgctgcgggcagaaaaagcatcgccctggatctcgttacagagattgggcgggtgccctctcacctggctcatcgcaccagaaatgcccttgacaacctggtcatgctccacacatccgaacatggaggccgggcctatcgccacgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcaatggatcgcttccgccattgtgctcgagttctttatgatggttcttctgatccctgagcccgaaaagcagagaaccccgcaggataatcaactggcttacgtggtgattggaatcctcacactggccgcgatcattgccgctaacgagatgggccttctggaaaccacgaagcgggacctcggcatgagcaaagagcctggggtcgtttctcccacatcctatctggatgtggacctgcaccccgccagcgcttggaccctctacgccgtggctacaaccgtcatcacccctatgcttagacatacaattgaaaattctacggccaacgtgagcctggcggccatcgctaaccaggccgttgtgctgatgggactcgacaagggctggccgatttccaaaatggatctgggggtcccccttctggctctcggatgctactctcaggtgaatcctctgaccctgacagccgccgtcctccttctgatcacccactatgcgatcattggccccgggctgcaggctaaggccacacgcgaggctcaaaaacggaccgccgccggaatcatgaagaaccctacggtggacggcattatgacaatcgatctcgaccccgttatttacgatagcaagttcgagaaacagctgggccaggtgatgcttctggtcctctgtgctgtgcagctgctgctcatgagaacctcctgggccctttgcgaagcgctgaccctggccacagggcctatcaccacactctgggagggatctccgggcaagttttggaatacgaccatcgctgttagcatggccaacattttccgcgggtcctatctggctggagccggccttgcgtttagcatcatgaaatctgtggggacaggaaagcggggcaccggctcccaaggggaaacactgggagagaaatggaagaagaaactcaatcagctgagcagaaaggaattcgacctgtacaaaaagtccggcattaccgaggtcgatcggacggaggccaaagaagggctcaagcgcggagagatcacccatcacgctgtgtctagaggcagcgccaaacttcagtggtttgtggaacggaacatggttattcccgaggggcgcgtcatcgacctgggatgtggcagaggcgggtggtcctattactgcgctggactgaagaaggtgacagaagtgcggggctataccaaagggggacctggccatgaggagcccgtccctatgtctacatacgggtggaatattgttaagctcatgagcggaaaagatgtgttctacctgcccccggaaaagtgtgacacccttctgtgcgatatcggcgagtccagcccttctcccacagtggaagagtcccgcaccatcagagtcctcaaaatggtggagccctggctgaagaacaatcagttctgtattaaggttctgaacccttatatgcccacggtgatcgaacacctcgagcggcttcaacgcaaacacggcgggatgctggtcagaaatcctctgagccggaactctacacatgaaatgtactggatttccaatggaaccggcaacatcgtggccagcgttaatatggtgtctagactcctgcttaaccgctttaccatgacacaccggagaccgacgattgagaaggacgtcgatctgggggctggaacccgccatgtgaacgccgaacccgagacacctaatatggacgtgatcggcgagcggatcaaaagaattaaggaagagcacaacagcacctggcactatgacgatgaaaatccctacaaaacatgggcgtatcatgggtcctacgaggtcaaggccaccggatctgctagctccatgatcaacggcgttgtgaagctcctgacaaaaccttgggacgtggtccccatggtgacccagatggccatgacggataccacaccgttcggccagcaacgcgtttttaaggaaaaagtggacacccggacacctagaagcatgcccgggacccgccgggtcatggagattacggctgagtggctgtggagaacactcggacgcaataagaaacctcggctgtgcaccagagaagagttcacaaagaaggtgcgcaccaacgccgccatgggcgcggtttttacggaagagaatcagtgggattccgctaaagccgccgtggaagacgaggatttctggaagcttgtcgacagagagcgggaactgcacaaactcgggaagtgtggatcttgcgtgtataacatgatgggcaaacgcgagaagaaactgggggaatttggcaaggctaagggaagcagagccatctggtacatgtggcttggcgctcggtacctggagttcgaggccctcgggtttctgaatgaagatcattggttctccagagagaactcttatagcggagttgaaggcgaggggctgcacaaactcggatacattctgcgggacatctccaagatccccggcggggcgatgtatgccgatgacaccgctggctgggacacacgcattaccgaagatgaccttcataatgaggagaaaatcacacagcagatggatcctgaacacagacaactggccaacgctatttttaagctcacctaccagaataaagtggtcaaggtgcagcggcccacaccgaccggaacggtcatggacatcatttctcgcaaggatcagagaggcagcgggcaagtgggaacatatggcctgaacaccttcaccaatatggaggcccagcttatccggcagatggaaggggagggagttctgtccaaagcggacctcgaaaaccctcacctgcccgagaagaaaatcacacagtggctggagaccaagggcgtggaacgcctcaaaagaatggccattagcggggatgactgcgtcgtgaagcccatcgatgaccggtttgctaacgccctgcttgctctgaatgatatgggcaaggtgcgcaaagacattcctcaatggcagccgtctaagggatggcatgattggcagcaggttcccttctgttcccaccatttccacgagctcatcatgaaagacggcagaaagctggtggtcccttgccggccccaagacgaacttattgggcgcgccagaatcagccagggagctggctggtctctgcgggagacagcctgtctcgggaaagcgtacgcccagatgtggtccctgatgtattttcaccgcagagatctgcggctcgctagcaacgccatttgctctgccgtgcctgttcattgggtgcccacgtccagaaccacatggagcatccacgctcatcaccaatggatgaccacagaagacatgctgaccgtctggaatcgcgtgtggatcgaggataacccttggatggaggacaagacgcccgtcaccacatgggaaaatgtgccgtaccttggaaagcgggaggatcagtggtgtggctccctgattgggctcaccagcagagccacatgggcgcagaacatccctaccgctattcagcaagttcgctctctgatcggcaatgaagagttccttgactacatgcccagcatgaaacggtttagaaaggaggaagagtccgaaggagccatttggtga

SEQ ID NO: 20437 - RNA, 9873 nt, synthetic construct
  misc_feature 1..9873: note = derived and/or modified CDS sequence (opt5) from DENV-3__GU131873__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagctcattgagggcaaagttgtgcagtatgaaaatctgaagtacacagtcgtgatcaccgttcacacaggggaccagcatcaggtgggaaacgagacgcaaggcatcaccgctgaaattacaccccaggcctctaccacagaggctatcctgcctgaatatggcaccctcgggctggagtgctcccccagaacgggacttgacttcaatgagatgattctgctcaccatgaaaaacaaggcctggatggtccaccggcagtggtttttcgatctgcctcttccctggacaagcggcgccaccacagaaaccccgacgtggaatcgcaaagagctgctcgtgacatttaagaacgctcatgcgaaaaagcaagaagtcgtggttctggggtctcaggagggagccatgcacaccgctctgacaggcgccaccgaaatccagaattccgggggcaccagcattttcgccggacacctcaagtgtagactgaaaatggacaagcttgagctgaaaggcatgtcttacgctatgtgcacaaacacgtttgtgctcaagaaagaggtctccgaaacccagcatgggacaatcctgatcaaggtggagtacaagggagaagatgccccttgtaaaattcccttcagcaccgaggacggccaagggaaggcgcacaacggacggctgatcacagctaatcctgttgtgaccaaaaaggaggaacccgtcaacattgaggccgaaccccctttcggcgagtccaatatcgtgattgggatcggcgataacgcccttaaaatcaattggtataagaagggatctagcattggcaaaatgtttgaagctacggccagaggggctcgccggatggccatcctcggagacacagcgtgggatttcggctccgtggggggagttctgaacagcctgggcaagatggtccatcagatttttgggtctgcctacaccgctctcttctccggcgtgagctgggtgatgaaaatcggaattggcgtcctgcttacctggatcgggctgaattctaagaacacaagcatgtccttttcttgcattgccatcggaatcattaccctctatctgggcgctgtggttcaggccgacatggggtgtgtgatcaattggaaaggaaaggagctgaagtgcggcagcgggattttcgtcacaaacgaggtgcacacgtggaccgaacagtacaaatttcaagcggattccccgaagagacttgccacagctatcgccggcgcttgggagaatggagtttgtggcattcgcagcaccacacggatggaaaacctcctgtggaaacagatcgccaatgagctgaactatatcctctgggaaaataacattaagctgaccgtggtcgtgggggacatcattggagttcttgagcagggcaaaagaacgctgaccccccagcctatggagctcaagtactcttggaaaacatgggggaaggccaagatcgtgaccgctgaaacacaaaactccagcttcattatcgatggacccaatacccctgagtgcccctctgcgtcccgcgcctggaacgtctgggaagtggaggactatggctttggcgtgttcacaaccaatatctggctgaaactgcgggaagtctacacgcagctttgtgaccatagactcatgagcgctgccgttaaggatgagcgcgccgtgcacgctgacatggggtactggattgagtcccagaaaaacggatcttggaagctggaaaaagccagcctgatcgaggtgaagacatgcacctggccgaagtcccacaccctctggtctaatggcgtcctggaaagcgatatgattatccctaaatcccttgcggggcccattagccagcataaccaccggcctggatatcatacacaaaccgctggcccctggcacctggggaagctcgagctggactttaattactgcgagggaacgacagtggttatcaccgaaaactgtggcacaagaggcccttctctgcgcaccacaaccgtgtccgggaaacttatccacgagtggtgctgtcggagctgcacgctccccccgctgagatatatgggagaagatggctgttggtacgggatggagattcggcctatctctgaaaaggaggagaatatggtcaaatccctggtgagcgccggatctggcaaggttgacaacttcaccatgggggtgctctgcctggccattctttttgaagaggtcatgcgcggaaagttcggcaaaaagcatatgatcgctggcgtgttctttacattcgttctgctcctgagcgggcagattacctggagagatatggcccacacactgatcatgattggatccaatgcgagcgaccggatgggcatgggggtgacctatcttgctctgatcgccacgtttaaaatccagcccttcctcgccctgggatttttcctcagaaagctgacatctcgcgaaaaccttctgctcggcgtcgggctggctatggccaccacactgcaacttcccgaggatattgaacagatggctaatggaatcgccctgggcctcatggcgctgaaactcattacccagtttgagacctaccagctgtggacagcccttatctccctgacgtgtagcaacaccatgttcacactcaccgtggcttggcggacagccaccctgattctggctggcgtgtcccttctgcctgtctgccaatctagctccatgagaaagacggactggctcccgatggccgttgccgctatgggggtgccccctctgcccctctttatcttctctctgaaggatacacttaaacgcagaagctggcctctgaatgagggagtgatggcggtcggcctggtgtccatcctcgcctctagcctgcttcggaacgacgttcccatggctgggcctctggtggccggaggcctcctgattgcctgttatgtcatcaccgggacctccgctgatctcacagtggaaaaggccgcggacattacctgggaggaagaggctgaacagacaggagttagccataacctgatgatcacggtggacgatgacggcaccatgcgcattaaagatgacgagacagagaatatccttaccgtcctgctgaagacagccctcctgatcgtgtctggcgtctttccctactccattccggccacccttctggtgtggcacacgtggcagaaacagacccaaagaagcggggttctctgggatgtgccttctccccctgaaacacagaaggctgagctggaagagggagtctaccggatcaaacagcagggcattttcgggaagacccaagtgggagttggcgtgcagaaggagggggtctttcatacaatgtggcacgtgacccgcggagccgtgctcacatataacggcaaaagactggaacccaattgggcgtccgttaagaaagaccttatcagctacggcgggggatggcggctgtctgctcagtggcaaaagggcgaggaagtccaggtgattgccgtggagccggggaaaaaccctaagaatttccagacgatgcccggaaccttccagacaaccaccggcgaaatcggggccattgctctggattttaagcctggaacatccggcagccccatcatcaaccgcgagggcaaagtcgtggggctctatggaaatggcgttgtgacgaagaacgggggatacgtctccggcattgcccaaaccaatgctgagcccgacgggcctacaccggaactggaggaagagatgttcaaaaagagaaaccttaccatcatggatctgcaccccggcagcggaaaaacacggaagtatctccctgccattgtgcgcgaagcgatcaagagacggctgagaaccctcattctggcccccacgcgcgttgtggctgccgagatggaggaagctcttaaaggcctgcctatccggtaccagacaaccgccaccaagtctgagcatacagggagagaaatcgtcgacctgatgtgccacgccacctttacaatgcgcctcctgagccccgtgcgggttcctaattataaccttattatcatggatgaggctcatttcaccgacccggcgtccattgccgctagaggatacatctctacgcgcgtgggcatgggggaagccgccgctatttttatgacagccaccccccctggaacagcggatgctttcccccagagcaatgcccctatccaggacgaggagcgggacatccccgaaagatcctggaactctggcaatgagtggattaccgattttgccgggaaaacggtctggttcgtgccgagcatcaaggctggcaacgacattgccaactgtctgcgcaaaaatggaaagaaggtgatccaactctcccggaaaacctttgatacagaataccagaagaccaaactgaacgactgggatttcgtcgttacaaccgacatttctgagatgggcgcgaattttaaggccgatagagtgatcgaccctcggcgctgcctgaaacccgtgattctcacagatgggcccgagagagtcatccttgctggacctatgcccgtgaccgccgctagcgccgctcagcggcgcggcagagttgggcggaaccctcagaaggaaaatgaccaatatatcttcacgggacagccgctgaacaatgatgaggaccacgcccattggacagaagcgaagatgctgctcgacaacgtgaatacccccgagggcattatccctgccctgttcgaacccgagagagagaaatccgctgccattgatggggaataccgccttaagggcgagagccggaaaacctttgtcgaactgatgagacgcggagacctccctgtgtggctggctcacaaggttgcctctgagggcatcaaatatacagatcggaagtggtgcttcgacgggcagagaaacaatcagattctggaagagaacatggatgtggagatctggaccaaagaaggagagaagaagaaactccgcccccggtggcttgacgccagaacatactccgatccgctggctctgaaggaatttaaagacttcgcggccggccgcaagagcatcgctctcgatctggtcacggagattgggagagtgccttctcaccttgcccatcggacccgcaatgccctggacaacctcgtcatgctgcacacatccgaacatggaggcagagcttatcggcacgccgtggaggagctgcccgaaaccatggagacactccttctgctgggcctcatgatcctgcttaccgggggagcgatgctgtttattatcagcggcaaagggattggaaagacgtccatcggcctcatctgtgttattgcctctagcgggatgctgtggatggctgaaatccctctgcaatggattgcctccgctatcgtgctcgagttctttatgatggtgcttctgattcccgagcctgaaaagcagcgcaccccccaggataatcaactggcctacgtcgttatcggaattctcacactggcggccatcatcgctgccaacgagatgggccttctggaaaccacaaaaagagacctcggcatgagcaaggagccgggggtggtgtctcctacctcctatctggatgtcgacctgcaccccgctagcgcctggacgctctacgctgtggccacaaccgttattacacccatgcttcggcataccatcgaaaattctaccgcgaacgtgagcctggccgctattgccaaccaggctgtcgtgctgatgggactcgacaaaggctggcctatctccaagatggatctgggggtcccgcttctggccctcggatgctactctcaggtgaatcccctgacactgacggccgcggttctccttctgattacccactatgctatcatcggccctgggctgcaggccaaagctacaagagaggcccaaaagcgcaccgccgctggaattatgaagaaccccacagtggacggcatcatgaccattgatctcgaccctgtcatctacgatagcaaattcgagaagcagctgggccaggtgatgcttctggttctctgtgccgtgcagctgctgctcatgcggacgtcctgggcgctttgcgaagccctgacactggctaccgggcccattaccacactctgggagggatctcctggcaaattttggaataccacaatcgccgtcagcatggctaacatcttcagagggtcctatctggccggagcgggccttgcctttagcattatgaagtctgtggggacgggaaaacgcggcaccggctcccaaggggaaacactgggagagaagtggaagaaaaagctcaatcagctgagccggaaagaattcgacctgtacaagaaatccggcatcaccgaggtggatagaacagaggctaaggaagggctcaaacggggagagattacccatcacgccgtttctcgcggcagcgctaagcttcagtggtttgtcgaaagaaacatggtgatcccggaggggcgggtgattgacctgggatgtggccgcggcgggtggtcctattactgcgccggactgaagaaagtcacggaagttagaggctataccaaggggggacccggccatgaggagcctgtgcccatgtctacatacgggtggaatatcgtgaaactcatgagcggaaaggatgtcttctacctgcctcccgaaaaatgtgacacccttctgtgcgatattggcgagtccagcccgtctcctacagtggaagagtcccggaccatccgcgttctcaagatggtggagccctggctgaagaacaatcagttctgtatcaaagtcctgaacccctatatgcctacagtgattgaacacctcgagagacttcaacggaagcacggcgggatgctggttcgcaatcccctgagcagaaactctacccatgaaatgtactggatctccaatggaacgggcaacattgtggctagcgtcaatatggtgtctcggctcctgcttaacagatttacaatgacccaccgccggcctaccatcgagaaagacgtggatctgggggccggaacaagacatgtcaacgcggaaccggagacgcccaatatggacgttattggcgagcgcatcaagcggatcaaagaagagcacaacagcacctggcactatgacgatgaaaatccttacaagacatgggcctatcatgggtcctacgaggtgaaggctaccggatctgccagctccatgattaacggcgtggtcaaactcctgacaaagccctgggacgtggttcctatggtgacccagatggctatgacagataccacgcccttcggccagcaaagagtctttaaagaaaaggtggacacccgcacaccgcggagcatgcctgggaccagacgcgttatgggaatcacagccgagtggctgtggcggaccctcggcagaaataaaaagccccgcctgtgcacgcgggaggaattcacaaagaaagtgagaaccaacgccgcgatgggggctgtctttacagaggaaaatcagtgggattccgccaaggccgctgtggaggacgaagatttctggaaacttgttgaccgcgagagagagctgcacaagctcggaaaatgtggctcttgcgtgtataacatgatggggaagcgggaaaaaaagctgggcgagtttggaaaggccaaaggcagccgcgctatttggtacatgtggcttggggccagatacctggaattcgaggcgctcggatttctgaatgaggatcattggttctcccgggaaaactcttatagcggcgtcgagggggaaggactgcacaagctcggctacatcctgagagacatttccaaaatccctgggggcgccatgtatgctgatgacaccgccggatgggacacgcggatcaccgaggatgaccttcataatgaagagaagattacacagcagatggatcccgagcaccgccaactggctaacgccatctttaaactcacctaccagaataaggtggtcaaggtgcagagacctacacccaccggcacagttatggacattatctctcggaaagatcagcgcgggagcggacaagtgggcacctatgggctgaacacgttcacaaatatggaagcgcagcttattagacagatggagggagaaggcgtcctgtccaaggccgacctcgagaacccgcacctgcctgaaaaaaagatcacccagtggctggagaccaaaggggtggagcggctcaagcgcatggctatcagcggcgatgactgcgtggttaagcccattgatgacagatttgccaacgctctgcttgccctgaatgatatgggaaaagtgcggaaggacatcccccaatggcagccttctaaaggctggcatgattggcagcaggtcccgttctgttcccaccatttccacgaactcattatgaaggacgggcgcaaactggtggttccctgcagacctcaagacgagcttatcggacgggctcgcattagccagggcgccgggtggtctctgagagaaacagcgtgtctcggaaaggcctacgctcagatgtggtccctgatgtattttcaccggcgcgatctgagactcgccagcaacgccatctgctctgctgtgcccgtccattgggtgcctacctcccggacaacgtggagcattcacgcccatcaccaatggatgaccacagaggacatgctgaccgtctggaatagagtgtggatcgaagataacccctggatggaggacaagacacctgttaccacgtgggagaatgtgccctaccttggcaaacgcgaagatcagtggtgtgggtccctgatcggcctcaccagccgggcgacatgggctcagaacattccgaccgccatccagcaagtcagatctctgattggaaatgaggaattccttgactacatgcctagcatgaagcgctttcggaaagaggaggaatccgagggcgccatctggtga

SEQ ID NO: 20438 - RNA, 9873 nt, synthetic construct
  misc_feature 1..9873: note = derived and/or modified CDS sequence (opt5) from DENV-3__GU131874__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagctcattgagggcaaagttgtgcagtatgaaaatctgaagtacacagtcatcatcaccgtgcacacaggggaccagcatcaggttggaaacgagacgcaaggcgtgaccgctgaaattacaccccaggcctctaccacagaggctatcctgcctgaatatggcaccctcgggctggagtgctcccccagaacgggacttgacttcaatgagatgattctgctcaccatgaaaaacaaggcctggatggtccaccggcagtggtttttcgatctgcctcttccctggacaagcggcgccaccacagaaaccccgacgtggaatcgcaaagagctgctcgtgacatttaagaacgctcatgcgaaaaagcaagaagtcgtggttctggggtctcaggagggagccatgcacaccgctctgacaggcgccaccgaaatccagaattccgggggcaccagcattttcgccggacacctcaagtgtagactgaaaatggacaagcttgagctgaaaggcatgtcttacgctatgtgcacaaacacgtttgtgctcaagaaagaggtctccgaaacccagcatgggacaatcctgatcaaggtggagtacaagggagaagatgccccttgtaaaattcccttcagcaccgaggacggccaagggaaggcgcacaacggacggctgatcacagctaatcctgttgtgaccaaaaaggaggaacccgtcaacattgaggccgaaccccctttcggcgagtccaatatcgtgattgggacgggcgataacgcccttaaaatcaattggtataagaagggatctagcatcggcaaaatgtttgaagctacagccagaggggctcgccggatggccattctcggagacaccgcgtgggatttcggctccgtggggggagttctgaacagcctgggcaagatggtccatcagatctttgggtctgcctacaccgctctcttctccggcgtgagctgggtgatgaaaattggaatcggcgtcctgcttacatggattgggctgaattctaagaacaccagcatgtccttttcttgcatcgccattggaatcatcacactctatctgggcgctgtggttcaggccgacatggggtgtgtgattaattggaaaggaaaggagctgaagtgcggcagcgggatcttcgtcacgaacgaggtgcacacctggacagaacagtacaaatttcaagcggattccccgaagagacttgccaccgctattgccggcgcttgggagaatggagtttgtggcatccgcagcacaacccggatggaaaacctcctgtggaaacagattgccaatgagctgaactatatcctctgggaaaataacatcaagctgacggtggtcgtgggggacattatcggagttcttgagcagggcaaaagaaccctgacaccccagcctatggagctcaagtactcttggaaaacctgggggaaggccaagattgtgacagctgaaacccaaaactccagcttcatcattgatggacccaatacacctgagtgcccctctacctcccgcgcgtggaacgtctgggaagtggaggactatggctttggcgtgttcacgacaaatatctggctgaaactgcgggaagtctacacccagctttgtgaccatagactcatgagcgccgctgttaaggatgagcgcgccgtgcacgccgacatggggtactggatcgagtcccagaaaaacggatcttggaagctggaaaaagctagcctgattgaggtgaagacctgcacatggccgaagtcccacaccctctggtctaatggcgtcctggaaagcgatatgatcattcctaaatcccttgccgggcccatcagccagcataaccaccggcctggatatcatacgcaaacagcgggcccctggcacctggggaagctcgagctggactttaattactgcgagggaaccacagtggttattaccgaaaactgtggcacaagaggcccttctctgcgcaccacgaccgtgtccgggaaacttatccacgagtggtgctgtcggagctgcacactccccccgctgagatatatgggagaagatggctgttggtacgggatggagatccggcctatttctgaaaaggaggagaatatggtcaaatccctggtgagcgctggatctggcaaggttgacaacttcaccatgggggtgctctgcctggccatcctttttgaagaggtcatgcgcggaaagttcggcaaaaagcatatgattgccggcgtgttctttacattcgttctgctcctgagcgggcagatcacctggagagatatggctcacacgctgattatgatcggatccaatgccagcgaccggatgggcatgggggtgacatatcttgcgctgattgctacctttaaaatccagcccttcctcgccctgggatttttcctcagaaagctgacatctcgcgaaaaccttctgctcggcgtcgggctggccatggctaccaccctgcaacttcccgaggatatcgaacagatggccaatggaattgctctgggcctcatggccctgaaactcatcacacagtttgagacgtaccagctgtggaccgcgcttatttccctgacatgtagcaacaccatgttcacactcaccgtggcctggcggacggctacactgatcctggccggcgtgtcccttctgcctgtctgccaatctagctccatgagaaagaccgactggctcccgatggctgttgccgccatgggggtgccccctctgcccctctttattttctctctgaaggatacccttaaacgcagaagctggcctctgaatgagggagtgatggctgtcggcctggtgtccatcctcgcgtctagcctgcttcggaacgacgttcccatggccgggcctctggtggctggaggcctcctgatcgcctgttatgtcattacagggacctccgccgatctcacagtggaaaaggctgccgacatcacgtgggaggaagaggcggaacagaccggagttagccataacctgatgattacagtggacgatgacggcaccatgcgcatcaaagatgacgagacagagaatattcttaccgtcctgctgaagacggctctcctgatcgtgtctggcgtctttccctactccatcccggccacccttctggtgtggcacacatggcagaaacagacccaaagaagcggggttctctgggatgtgccttctccccctgaaacacagaaggccgagctggaagagggagtctaccggattaaacagcagggcatcttcgggaagacccaagtgggagttggcgtgcagaaggagggggtctttcatacaatgtggcacgtgacgcgcggagctgtgctcacctataacggcaaaagactggaacccaattgggcctccgttaagaaagaccttattagctacggcgggggatggcggctgtctgcgcagtggcaaaagggcgaggaagtccaggtgatcgctgtggagccggggaaaaaccctaagaatttccagacaatgcccggaaccttccagaccacaacgggcgaaattggggccatcgccctggattttaagcctggaacctccggcagccccattatcaaccgcgagggcaaagtcgtggggctctatggaaatggcgttgtgacaaagaacgggggatacgtctccggcatcgctcaaaccaatgccgagcccgacgggcctacaccggaactggaggaagagatgttcaaaaagagaaaccttaccattatggatctgcaccccggcagcggaaaaacgcggaagtatctccctgctatcgtgcgcgaagccattaagagacggctgagaacactcatcctggcgcccacccgcgttgtggccgctgagatggaggaagcccttaaaggcctgcctattcggtaccagaccacagctaccaagtctgagcatacagggagagaaatcgtcgacctgatgtgccacgccacctttacgatgcgcctcctgagccccgtgcgggttcctaattataaccttatcattatggatgaggcccatttcacagacccggcttccatcgcggccagaggatacatttctacccgcgtgggcatgggggaagctgccgccatctttatgacagctaccccccctggaacggccgatgcgttcccccagagcaatgctcctattcaggacgaggagcgggacatccccgaaagatcctggaactctggcaatgagtggatcaccgattttgccgggaaaacagtctggttcgtgccgagcattaaggccggcaacgacatcgctaactgtctgcgcaaaaatggaaagaaggtgattcaactctcccggaaaacctttgatacagaataccagaagaccaaactgaacgactgggatttcgtcgttacaaccgacatctctgagatgggcgccaattttaaggcggatagagtgattgaccctcggcgctgcctgaaacccgtgatcctcacggatgggcccgagagagtcattcttgccggacctatgcccgtgacagctgccagcgctgcccagcggcgcggcagagttgggcggaaccctcagaaggaaaatgaccaatatatcttcaccggacagccgctgaacaatgatgaggaccacgctcattggaccgaagccaagatgctgctcgacaacatcaatacacccgagggcattatccctgcgctgttcgaacccgagagagagaaatccgccgctattgatggggaataccgccttaagggcgagagccggaaaacctttgtggaactgatgagacgcggagacctccctgtctggctggcccacaaggtggcttctgagggcatcaaatatacagatcggaagtggtgcttcgacgggcagagaaacaatcagattctggaagagaacatggatgttgagatctggacgaaagaaggagagaagaagaaactccgcccccggtggcttgacgccagaacctactccgatccgctggccctgaaggaatttaaagacttcgctgcgggccgcaagagcatcgccctcgatctggtgacagagattgggagagtcccttctcaccttgctcatcggacccgcaatgccctggacaacctcgtgatgctgcacacatccgaacatggaggcagagcctatcggcacgctgtcgaggagctgcccgaaaccatggagacgctccttctgctgggcctcatgatcctgcttaccgggggagccatgctgtttctcattagcggcaaagggatcggaaagacatccattggcctgatctgtgtgatcgcgtctagcgggatgctgtggatggccgaaattcctctccaatggatcgcttccgccattgttcttgagttctttatgatggtgctgctgatccccgagcctgaaaagcagcgcaccccccaggataatcaactcgcttacgtggtcattggaatcctgacacttgccgcgattatcgccgctaacgagatgggcctgctcgaaaccacgaaaagagacctgggcatgagcaaggagccgggggttgtgtctcctacatcctatctggatgtggacctccaccccgccagcgcttggaccctttacgccgtcgctacaaccgtgatcacccccatgctgcggcatacaattgaaaattctacggccaacgttagcctggcggccatcgctaaccaggccgtggtcctcatgggactggacaaaggctggcctatttccaagatggatcttggggtgccgctgctcgctctgggatgctactctcaggtcaatcccctgaccctcacagccgccgtgcttctgctgatcacccactatgcgattatcggccctgggctccaggctaaagccacaagagaggctcaaaagcgcaccgccgccggaatcatgaagaaccccacggttgacggcattatgacaatcgatctggaccctgtgatttacgatagcaaattcgagaagcagcttggccaggtcatgctgctcgtgctgtgtgctgcccagctgctccttatgcggacctcctgggcgctgtgcgaagccctgaccctcgctacagggcccatcaccacactgtgggagggatctcctggcaaattttggaatacgaccattgccgttagcatggctaacatcttcagagggtcctatcttgccggagcgggcctggcctttagcatcatgaagtctgtggggacaggaaaacgcggcaccggctcccaaggggaaacactcggagagaagtggaagaaaaagctgaatcagctgagccggaaagaattcgacctctacaagaaatccggcattaccgaggtcgatagaacggaggctaaggaagggcttaaacggggagagatcacccatcacgccgtgtctcgcggcagcgctaagctgcagtggtttgtggaaagaaacatggttattccggaggggcgggtcatcgacctgggatgtggccgcggcgggtggtcctattactgcgccggactcaagaaagtgacagaagtgagaggctataccaaggggggacccggccatgaggagcctgtccccatgtctacatacgggtggaatattgttaaactgatgagcggaaaggatgtgttctaccttcctcccgaaaaatgtgacaccctgctctgcgatatcggcgagtccagcccgtctcctacagtggaagagtcccggaccattcgcgtcctgaagatggtggagccctggctgaagaacaatcagttctgtatcaaagttctcaacccctatatgcctacggtgatcgaacaccttgagagactgcaacggaagcacggcgggatgctggtccgcaatcccctcagcagaaactctacacatgaaatgtactggatttccaatggaaccggcaacatcgtggctagcgttaatatggtgtctcggctgcttctgaacagatttaccatgacacaccgccggcctacgattgagaaagacgtcgatctcggggccggaaccagacatgtgaacgcggaaccggagacacccaatatggacgtgatcggcgagcgcattaagcggatcaaagaagagcacaacagcacctggcactatgacgatgaaaatccttacaagacatgggcctatcatgggtcctacgaggtcaaggctaccggatctgccagctccatgatcaacggcgttgtgaaactgctgacaaagccctgggacgtggtccctatggtgacccagatggctatgacggataccacacccttcggccagcaaagagtttttaaagaaaaggtggacacccgcacaccgcggagcatgcctgggaccagacgcgtcatgggaattacggccgagtggctctggcggacactgggcagaaataaacgcccccggctttgcaccagagaggaattcacaaagaaggtgcgcaccaacgccgcgatgggggctgtttttacggaggaaaatcagtgggattccgccaaagccgctgtggaggacgaagatttctggaagctggtcgacagagagcgggagctccacaaactgggaaagtgtggctcttgcgtgtataacatgatggggaaacgcgaaaagaaacttggcgagtttggaaaggccaagggcagcagagctatctggtacatgtggctgggggcccggtacctcgaattcgaggcgctgggatttctgaatgaggatcattggttctccagagaaaactcttatagcggcgttgagggggaaggactccacaaactgggctacattcttcgggacatctccaagattcctgggggcgccatgtatgctgatgacaccgccggatgggacacacgcatcaccgaggatgacctgcataatgaagagaaaatcacacagcagatggatcccgagcacagacaactcgctaacgccatttttaagctgacctaccagaataaagtggtcaaggtgcagcggcctacacccaccggcacggtcatggacatcatttctcgcaaggatcagagagggagcggacaagtgggcacatatgggcttaacaccttcaccaatatggaagcgcagctgatccggcagatggagggagaaggcgttctctccaaagccgacctggagaacccgcacctgcctgaaaagaaaattgctcagtggctcgagacaaagggggtggagcgcctgaaaagaatggccatcagcggcgatgactgcgtcgtgaagcccatcgatgaccggtttgctaacgcccttctggctctcaatgatatgggaaaggtgcgcaaagacattccccaatggcagccttctaagggctggcatgattggcagcaggttccgttctgttcccaccatttccacgaactgatcatgaaagacgggagaaagcttgtggtcccctgccggcctcaagacgagctgattggacgcgccagaatcagccagggctctgggtggtccctccgggaaaccgcgtgtctgggaaaagcctacgctcagatgtggagcctgatgtattttcaccgcagagatctccggctggcctctaacgccatttgctccgctgtgcccgttcattgggtgcctacaagcagaacgacctggtccatccacgcccatcaccaatggatgacaaccgaggacatgcttgcggtctggaatcgcgtgtggattgaagataacccctggatggaggacaagacacctgtcaccacgtgggagaatgtgccctacctgggcaagcgggaagatcagtggtgtgggagcctcatcggcctgacctctagagctacatgggcccagaacatcccgaccgccattcagcaagttcgcagccttatcggaaatgaggaattcctggactacatgccttccatgaaacggtttagaaaggaggaggaatctgagggcgctatttggtga

SEQ ID NO: 20439 - RNA, 9873 nt, synthetic construct
  misc_feature 1..9873: note = derived and/or modified CDS sequence (opt5) from DENV-3__GU131875__SS-prME
  source 1..9873: mol_type = other RNA
accagcctgtgcctcgtgatgatcctgcccgccgctcttgccttccacctgacatccagagacggcgagcctcggatgattgtcgggaagaacgaacgcggaaaatctctcctgtttaagacggcgagcggcatcaatatgtgtacccttattgctatggatctgggggagatgtgcgacgatacagttacctacaaatgtccgcatatcacagaagtggagcccgaagacattgattgctggtgtaacctcacctccacatgggtgacctatggaacgtgcaatcaggccggcgagagacggcgcgacaagagatctgtcgccctggctcctcacgtggggatgggactggatacccggacacaaacctggatgagcgccgagggcgcttggcgccaggttgaaaaagtggagacatgggccctcagacatcccggcttcaccatcctggcgctttttctggcccactacatcgggacgtccctcacacagaaggtcgtgattttcatcctgcttatgctggttaccccttctatgacaatgcggtgtgtgggagtcggcaaccgcgactttgtggaagggctcagcggagctacctgggtggatgtcgttctggagcatggcgggtgcgtgaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtctgtaaacacacctacgtggatcgcggctgggggaacggatgcggcctgttcgggaagggaagccttgttacctgcgccaagtttcaatgtctggagcccattgagggcaaagtggtccagtatgaaaatctcaagtacacagtgatcatcaccgttcacacaggggaccagcatcaggtgggaaacgagacgcaaggcgtcaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtgcaccggcagtggtttttcgatctccccctgccgtggacaagcggcgccaccacagaaacccctacgtggaatcgcaaagagcttctggtcacatttaagaacgctcatgcgaaaaagcaagaagtggttgtgctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtcctgaagaaagaggtgtccgaaacccagcatgggacaatcctcatcaaggttgagtaccggggagaagatgccccctgtaagattcctttcagcaccgaggacggccaagggaaagcgcacaacggaagactgatcacagctaatcccgtggtcaccaagaaagaggaacccgtgaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgttgggggagtcctcaacagcctgggcaaaatggtgcatcagatttttgggtctgcctacaccgctctgttctccggcgtgagctgggtcatgaagatcggaattggcatcctcctgacctggattgggcttaattctaaaaacacaagcatgtccttttcttgcatcgccatcggaattatcaccctgtatctcggcgctgtggttcaggccgacatggggtgtgtgattaattggaagggaaaagagctgaagtgcggcagcgggatcttcgtcacaaacgaggtgcacacgtggaccgaacagtacaagtttcaagcggattcccccaaacgcctggccacagctattgccggcgcttgggagaatggagtttgtggcatccggagcaccacaagaatggaaaaccttctctggaagcagatcgccaatgagctgaactatattctgtgggaaaataacatcaaactcaccgtggtcgtgggggacattatcggagttctggagcagggcaagcgcacgcttacccctcagcccatggagctgaaatactcttggaagacatgggggaaagccaagattgtgaccgctgaaacacaaaactccagcttcatcatcgatggacctaatacccccgagtgcccgtctgcgtcccgggcctggaacgtctgggaagtggaggactatggctttggcgtgttcacaaccaatatttggctcaagctgagagaagtctacacgcagctgtgtgaccatcgccttatgagcgctgccgttaaagatgagcgggccgtgcacgctgacatggggtactggatcgagtcccagaagaacggatcttggaaactcgaaaaggccagcctgattgaggtgaaaacatgcacctggcctaagtcccacaccctgtggtctaatggcgtcctcgaaagcgatatgatcattcccaagtccctggcggggcctatcagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgattcacgagtggtgctgtagaagctgcacgcttccgcctctccggtatatgggagaagatggctgttggtacgggatggagatccgccccatttctgaaaaagaggagaatatggtcaagtccctggtgagcgccggatctggcaaagttgacaacttcaccatgggggtgctgtgcctcgccatcctgtttgaagaggtcatgagaggaaagttcggcaagaaacatatgattgctggcgtgttctttacattcgttcttctgctcagcgggcagatcacctggcgggatatgacacacaccctgattatgatcggatccaatgccagcgacagaatgggcatgggggtgacgtatctggcgcttatcgctacatttaagattcagcccttcctggccctcggatttttcctgcgcaaactcacctctcgggaaaacctgcttctgggcgtcgggctcgccatggctacaaccctgcaactgcctgaggatatcgaacagatggccaatggaattgctcttggcctgatggccctcaagctgatcacccagtttgagacataccagctctggacggcgctgatttcccttacctgtagcaacacaatgttcaccctgacagtggcctggagaaccgctacgctcatcctggccggcgtgtccctgcttccggtctgccaatctagctccatgcgcaaaacagactggctgcccatggctgttgccgccatgggggtgcctcccctccctctgtttatcttctctctcaaggataccctgaagagacggagctggccccttaatgagggagtgatggctgtcggcctggtgtccattctggcgtctagcctcctgcgcaacgacgttcctatggccgggccccttgtggctggaggcctgctcatcgcctgttatgtcattaccgggacatccgccgatctgaccgtggaaaaagctgccgacatcacatgggaggaagaggcggaacagacgggagttagccataacctcatgattaccgtggacgatgacggcacaatgagaatcaaggatgacgagaccgagaatatcctgacagtccttctgaaaaccgctctgctcattgtgtctggcgtctttccgtactccatccctgccacgctgcttgtgtggcacacctggcagaagcagacacaacggagcggggttctgtgggatgtgccctctcctcccgaaacccagaaagccgagctcgaagagggagtctaccgcattaagcagcagggcatcttcgggaaaacacaagtgggagttggcgtgcagaaggagggggtctttcataccatgtggcacgtgacaagaggagctgtgctgacgtataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagaccatgcctggaacattccagaccaccacaggcgaaattggggccatcgccctggattttaagcccggaacgtccggcagccccatcattaacagagagggcaaggtcgtggggctgtatggaaatggcgttgtgaccaaaaacgggggatacgtctccggcatcgctcaaacaaatgccgagcctgacgggccgacccccgaactcgaggaagagatgttcaagaaacggaacctgacaattatggatcttcaccctggcagcggaaagacccgcaaatatctgcccgctatcattagagaagccatcaagcggagactccgcacgctgatcctcgcgcctacacgggtggttgccgctgagatggaggaagccctgaagggccttcccattagataccagaccaccgctacaaaatctgagcataccgggcgcgaaatcgtggacctgatgtgccacgccacatttaccatgcggctgctcagccctgtcagagtgccgaattataacctgattatcatggatgaggcccatttcacggaccccgcttccattgcggcccgcggatacatctctacacgggttggcatgggggaagctgccgccatctttatgaccgctacacctcccggaaccgccgatgcgttccctcagagcaatgctcccattcaggacgaggagagagacatcccggaacgctcctggaactctggcaatgagtggattacggattttgccgggaagaccgtgtggttcgtccctagcatcaaagccggcaacgacattgctaactgtcttcggaagaatggaaaaaaggtgatccaactgtccagaaagacatttgataccgaataccagaaaacaaagctcaacgactgggatttcgtggtcaccacagacatttctgagatgggcgccaattttaaagttgatcgggtgatcgacccccgcagatgcctgaagcccgtgatcctgaccgatgggcctgagcgggtcattctcgcgggacccatgcctgtgacggccgctagcgccgctcagcgcagaggccgggttgggagaaacccgcagaaagaaaatgaccaatatatcttcacaggacagccccttaacaatgatgaggaccacgcccattggaccgaagctaagatgctgctggacaacattaatacccctgagggcatcattcccgccctcttcgaacctgagcgcgagaagtccgcggccatcgatggggaataccggctgaaaggcgagagcagaaagacatttgtggaacttatgcgccggggagacctgcccgtctggctcgctcacaaagtggcctctgagggcatcaagtataccgatagaaaatggtgcttcgacgggcagcgcaacaatcagattctggaagagaacatggatgttgagatctggacaaaggaaggagagaaaaagaagctgcggccgagatggctcgacgctcgcacgtactccgatcctcttgccctgaaagaatttaaggacttcgccgctggcagaaaaagcattgcgctggatctcgtgaccgagatcgggcgggtcccctctcacctggcccatcgcacaagaaatgctcttgacaacctggtgatgctccacacctccgaacatggaggccgggcctatcgccacgccgtcgaggagctgcctgaaacaatggagaccctgctccttctgggcctgatgattctcctgacggggggagctatgctttttctgatcagcggcaaggggatcggaaaaacctccattggcctcatctgtgtgattgcctctagcgggatgctgtggatggcggaaatccccctgcaatggattgcctccgctatcgttctcgagttctttatgatggtgcttctgattcctgagcccgaaaagcagagaacaccgcaggataatcaactggcctacgtggtcatcggaatcctcaccctggctgccattatcgcggccaacgagatgggccttctggaaacaaccaagcgggacctcggcatgagcaaagagcctggggttgtgtctcccacgtcctatctggatgtggacctgcaccccgctagcgcctggacactctacgctgtcgccaccacagtgattacccctatgcttagacataccatcgaaaattctacagctaacgttagcctggccgcgattgccaaccaggctgtggtcctgatgggactcgacaagggctggccgatctccaaaatggatctgggggtgccccttctggccctcggatgctactctcaggtcaatcctctgacgctgaccgctgccgtgctccttctgatcacacactatgccattatcggccccgggctgcaggcgaaggctacccgcgaggcccaaaaacggacagctgccggaattatgaagaaccctaccgttgacggcatcatgacgattgatctcgaccccgtgatctacgatagcaagttcgagaaacagctgggccaggtcatgcttctggtgctctgtgccgttcagctgctgctcatgagaacatcctgggctctttgcgaagccctgaccctggcgaccgggcctatcacaaccctctgggagggatctccgggcaagttttggaatacaacgattgccgtgagcatggctaacatcttccgcgggtcctatctggccggagctggccttgcctttagcattatgaaatctgtcgggaccggaaagcggggcacaggctcccaaggggaaaccctgggagagaaatggaagaagaaactcaatcagctgagcagaaaggaattcgacctgtacaaaaagtccggcatcacagaggtggatcggaccgaggcgaaagaagggctcaagcgcggagagattacgcatcacgccgtgtctagaggcagcgctaaacttcagtggtttgttgaacggaacatggtcatccccgaggggcgcgtgattgacctgggatgtggcagaggcgggtggtcctattactgcgccggactgaagaaggtgaccgaagtccggggctatacaaaagggggacctggccatgaggagcccgttcctatgtctacctacgggtggaatatcgtgaagctcatgagcggaaaagatgtgttctacctgcccccggaaaagtgtgacacacttctgtgcgatatcggcgagtccagcccttctcccaccgtcgaagagtcccgcacaattagagtgctcaaaatggttgagccctggctgaagaacaatcagttctgtatcaaggtgctgaacccttatatgcccaccgtcattgaacacctcgagcggcttcaacgcaaacacggcgggatgctggtgagaaatcctctgagccggaactctacgcatgaaatgtactggatctccaatggaacaggcaacattgttgctagcgtgaatatggtctctagactcctgcttaaccgctttaccatgacccaccggagaccgacaatcgagaaggacgtggatctgggggccggaacgcgccatgtgaacgctgaacccgagacccctaatatggacgtcatcggcgagcggattaaaagaatcaaggaagagcacaacagcacatggcactatgacgatgaaaatccctacaaaacctgggcctatcatgggtcctacgaggttaaggcgacaggatctgccagctccatgattaacggcgtggtgaagctcctgaccaaaccttgggacgtcgtgcccatggttacacagatggctatgaccgatacgaccccgttcggccagcaacgcgtgtttaaggaaaaagtcgacacacggacccctagaagcatgcccgggacacgccgggtgatgggaatcaccgccgagtggctgtggagaacgctcggccgcaataagaaacctcggctgtgcacaagagaggaattcaccaagaaggttcgcacaaacgctgccatgggggccgtgtttaccgaggaaaatcagtgggattccgcgaaagctgccgtcgaggacgaagatttctggaagcttgtggacagagagcgggagctgcacaaactcggaaagtgtggctcttgcgtttataacatgatggggaaacgcgaaaagaaactgggcgagtttggaaaggccaagggcagcagagctatttggtacatgtggcttggggcccggtacctggaattcgaggctctcggatttctgaatgaggatcattggttctccagagaaaactcttatagcggcgtggagggggaaggactgcacaaactcggctacatcctgcgggacatctccaagattcccgggggcgccatgtatgcggatgacacggccggatgggacacccgcatcacagaggatgaccttcataatgaagagaaaattacccagcagatggatcctgagcacagacaactggctaacgccatctttaagctcacataccagaataaagtcgtgaaggtccagcggcccaccccgacaggcaccgtgatggacattatctctcgcaaggatcagagagggagcggacaagttggcacgtatgggctgaacacattcaccaatatggaagctcagcttatccggcagatggagggagaaggcgtgctgtccaaagccgacctcgagaaccctcacctgcccgaaaagaaaattacccagtggctggagacaaagggggtcgagcgcctcaaaagaatggcgatcagcggcgatgactgcgtggtgaagcccattgatgaccggtttgccaacgctctgcttgccctgaatgatatgggaaaggttcgcaaagacatccctcaatggcagccgtctaagggctggcatgattggcagcaggtgcccttctgttcccaccatttccacgaactcattatgaaagacgggagaaagctggtcgtgccttgccggccccaagacgagcttatcggacgcgctagaattagccagggcgccgggtggtctctgcgggaaaccgcttgtctcggaaaagcctacgcgcagatgtggtccctgatgtattttcaccgcagagatctgcggctcgccagcaacgctatctgctctgccgttcctgtgcattgggtccccacatccagaacgacctggagcatccacgcccatcaccaatggatgacaaccgaggacatgctgacagtgtggaatcgcgtctggattgaagataacccttggatggaggacaagacccccgtgacgacctgggagaatgttccgtaccttggcaagcgggaagatcagtggtgtgggtccctgatcggcctcacaagcagagctacctgggcccagaacattcctacagcgatccagcaagtgcgctctctgattggaaatgaggaattccttgactacatgcccagcatgaaacggtttagaaaggaggaggaatccgagggcgctatctggtga

SEQ ID NO: 20440 - RNA, 9873 nt, synthetic construct
  misc_feature 1..9873: note = derived and/or modified CDS sequence (opt5) from DENV-3__GU131877__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaattccgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtaccggggagaagatgccccctgtaagattcctttcagcaccgaggacggccaagggaaagcgcacaacggaagactgatcacagctaatcccgttgtgaccaagaaagaggaacccgtcaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgtggggggagttctcaacagcctgggcaaaatggtccatcagatttttgggtctgcctacaccgctctgttctccggcgtgagctgggtgatgaagatcggaattggcgtcctcctgacctggatcgggcttaattctaaaaacacaagcatgtccttttcttgcattgccatcggaatcattaccctgtatctcggcgctgtggttcaggccgacatggggtgtgtgatcaattggaagggaaaagagctgaagtgcggcagcgggattttcgtcacaaacgaggtgcacacgtggaccgaacagtacaagtttcaagcggattcccccaaacgcctggccacagctatcgccggcgcttgggagaatggagtttgtggcattcggagcaccacaagaatggaaaaccttctctggaagcagatcgccaatgagctgaactatatcctgtgggaaaataacattaaactcaccgtggtcgtgggggacatcattggagttctggagcagggcaagcgcacgcttacccctcagcccatggagctgaaatactcttggaagacatgggggaaagccaagatcgtgaccgctgaaacacaaaactccagcttcattatcgatggacctaatacccccgagtgcccgtctgcgtcccgggcctggaacgtctgggaagtggaggactatggctttggcgtgttcacaaccaatatctggctcaagctgagagaagtctacacgcagctgtgtgaccatcgccttatgagcgctgccgttaaagatgagcgggccgtgcacgctgacatggggtactggattgagtcccagaagaacggatcttggaaactcgaaaaggccagcctgatcgaggtgaaaacatgcacctggcctaagtcccacaccctgtggtctaatggcgtcctcgaaagcgatatgattatccccaagtccctggcggggcctattagccagcataaccacagacccggatatcatacacaaaccgctggcccttggcaccttgggaaactggagctcgactttaattactgcgagggaacgacagtggttatcaccgaaaactgtggcacacgcggcccctctctgcggaccacaaccgtgtccgggaagctgatccacgagtggtgctgtagaagctgcacgcttccgcctctccggtatatgggagaagatggctgttggtacgggatggagattcgccccatctctgaaaaagaggagaatatggtcaagtccctggtgagcgccggatctggcaaagttgacaacttcaccatgggggtgctgtgcctcgtcattctgtttgaagaggtgatgagaggaaagttcggcaagaaacatatgatcgccggcgttttctttacattcgtgcttctgctcagcgggcagattacctggcgggatatggctcacacactgatcatgattggatccaatgccagcgacagaatgggcatgggggtcacctatctggcgcttatcgctacgtttaagatccagcccttcctggccctcggatttttcctgcgcaaactcacatctcgggaaaacctgcttctgggcgtggggctcgccatggctaccacactgcaactgcctgaggatattgaacagatggccaatggaatcgctcttggcctgatggccctcaagctgattacccagtttgagacctaccagctctggacagcgctgatctcccttacgtgtagcaacaccatgttcacactgaccgtggcctggagaacagctaccctcattctggccggcgtctccctgcttccggtttgccaatctagctccatgcgcaaaacggactggctgcccatggctgtggccgccatgggggtgcctcccctccctctgtttatcttctctctcaaggatacactgaagagacggagctggccccttaatgagggagtcatggctgtgggcctggtttccatcctggcgtctagcctcctgcgcaacgacgtgcctatggccgggccccttgtcgctggaggcctgctcattgcctgttatgtgatcaccgggacctccgccgatctgacagttgaaaaagctgccgacattacctgggaggaagaggcggaacagacaggagtgagccataacctcatgatcacggtcgacgatgacggcaccatgagaattaaggatgacgagacagagaatatcctgaccgtgcttctgaaaacagctctgctcatcatttctggcgtctttccgtactccatccctgccaccctgcttgtgtggcacacgtggcagaagcagacccaacggagcggggttctgtgggatgtgccctctcctcccgaaacacagaaagccgagctcgaagagggagtctaccgcattaagcagcagggcatcttcgggaaaacccaagtgggagttggcgtgcagaaggagggggtctttcatacaatgtggcacgtgaccagaggagctgtgctgacatataacggcaagcggctcgaaccgaattgggcctccgttaaaaaggacctgattagctacggcgggggatggcgcctttctgcgcagtggcaaaaaggcgaggaagtccaggtgatcgctgtggagcctgggaagaaccccaaaaatttccagacgatgcctggaaccttccagacaaccaccggcgaaattggggccatcgccctggattttaagcccggaacatccggcagccccatcattaacagagagggcaaggtcgtggggctgtatggaaatggcgttgtgacgaaaaacgggggatacgtctccggcatcgctcaaaccaatgccgagcctgacgggccgacacccgaactcgaggaagagatgttcaagaaacggaacctgaccattatggatcttcaccctggcagcggaaagacacgcaaatatctgcccgctatcattagagaagccatcaagcggagactccgcaccctgatcctcgcgcctacgcgggtggttgccgctgagatggaggaagccctgaagggccttcccattagataccagacaaccgctaccaaatctgagcatacagggcgcgaaatcgtggacctgatgtgccacgccacctttacaatgcggctgctcagccctgtcagagtgccgaattataacctgattatcatggatgaggcccatttcaccgaccccgcttccattgcggcccgcggatacatctctacgcgggttggcatgggggaagctgccgccatctttatgacagctacccctcccggaacagccgatgcgttccctcagagcaatgctcccattcaggacgaggagagagacatcccggaacgctcctggaactctggcaatgagtggattaccgattttagcgggaagacggtgtggttcgtcccttccatcaaagccggcaacgacattgccaactgtcttcggaagaatggaaaaaaggtgatccaactgtctagaaagacctttgatacagaataccagaaaaccaagctcaacgactgggatttcgtggtcacaaccgacattagcgagatgggcgctaattttaaagccgatcgggttatcgacccccgcagatgcctgaagcccgtgatcctgacagatgggcctgagcgggtgattctcgcgggacccatgcctgtcaccgccgcttccgccgctcagcgcagaggccgggtggggagaaacccgcagaaagaaaatgaccaatatatcttcacgggacagccccttaacaatgatgaggaccacgcccattggacagaagctaagatgctgctggacaacattaatacccctgagggcatcattcccgccctcttcgaacctgagcgcgagaagagcgcggccatcgatggggaataccggctgaaaggcgagtctagaaagacctttgttgaacttatgcgccggggagacctgcccgtgtggctcgctcacaaagtcgcctccgagggcatcaagtatacagatagaaaatggtgcttcgacgggcagcgcaacaatcagattctggaagagaacatggatgtggagatctggaccaaggaaggagagaaaaagaagctgcggccgagatggctcgacgctcgcacatacagcgatcctcttgccctgaaagaatttaaggacttcgccgctggcagaaaatctattgcgctggatctcgttacggagatcgggcgggtgccctcccacctggcccatcgcaccagaaatgctcttgacaacctggtcatgctccacacaagcgaacatggaggccgggcctatcgccacgccgtggaggagctgcctgaaaccatggagacactgctccttctgggcctgatgattctcctgaccgggggagctatgctttttctgatctccggcaaggggatcggaaaaacgtctattggcctcatctgtgtcattgccagctccgggatgctgtggatggcggaaatccccctgcaatggattgccagcgctatcgtgctcgagttctttatgatggttcttctgattcctgagcccgaaaagcagagaaccccgcaggataatcaactggcctacgtggtgatcggaatcctcacactggctgccattatcgcggccaacgagatgggccttctggaaaccacaaagcgggacctcggcatgtctaaagagcctggggtcgtttcccccaccagctatctggatgtggacctgcaccccgcttctgcctggacgctctacgctgtggccacaaccgtcattacacctatgcttagacataccatcgaaaatagcaccgctaacgtgtccctggccgcgattgccaaccaggctgttgtgctgatgggactcgacaagggctggccgatctctaaaatggatctgggggtcccccttctggccctcggatgctacagccaggtgaatcctctgacactgacggctgccgtcctccttctgatcacccactatgccattatcggccccgggctgcaggcgaaggctacacgcgaggcccaaaaacggaccgctgccggaattatgaagaaccctacagtggacggcatcatgaccattgatctcgaccccgttatctacgattccaagttcgagaaacagctgggccaggtgatgcttctggtcctctgtgccgtgcagctgctgctcatgagaacgtcttgggctctttgcgaagccctgacactggcgaccgggcctatcaccacactctgggagggaagcccgggcaagttttggaataccacaattgccgtttccatggctaacatcttccgcgggagctatctggccggagctggccttgccttttctattatgaaatccgtggggacgggaaagcggggcaccggcagccaaggggaaacactgggagagaaatggaagaagaaactcaatcagctgtccagaaaggaattcgacctgtacaaaaagtctggcatcaccgaggtcgatcggacagaggcgaaagaagggctcaagcgcggagagattacccatcacgccgtgagcagaggctccgctaaacttcagtggtttgtggaacggaacatggttatccccgaggggcgcgtcattgacctgggatgtggcagaggcgggtggtcttattactgcgccggactgaagaaggtgacggaagtgcggggctataccaaagggggacctggccatgaggagcccgtccctatgagcacatacgggtggaatatcgttaagctcatgtccggaaaagatgtgttctacctgcccccggaaaagtgtgacacccttctgtgcgatatcggcgagagctctccttcccccacagtggaagagagccgcaccattagagtcctcaaaatggtggagccctggctgaagaacaatcagttctgtatcaaggttctgaacccttatatgcccacagtgattgaacacctcgagcggcttcaacgcaaacacggcgggatgctggtcagaaatcctctgtctcggaactccacccatgaaatgtactggatcagcaatggaacgggcaacattgtggcttctgttaatatggtgagcagactcctgcttaaccgctttacaatgacccaccggagaccgaccatcgagaaggacgtcgatctgggggccggaacacgccatgtgaacgctgaacccgagacgcctaatatggacgtgatcggcgagcggattaaaagaatcaaggaagagcacaactccacctggcactatgacgatgaaaatccctacaaaacatgggcctatcatgggtcttacgaggtcaaggcgaccggaagcgcctccagcatgattaacggcgttgtgaagctcctgacaaaaccttgggacgtggtccccatggtgatccagatggctatgaccgatacaaccccgttcggccagcaacgcgtttttaaggaaaaagtggacacgcggacccctagatccatgcccgggacacgccgggtcatgggaattaccgccgagtggctgtggagaacactcggccgcaataagaaacctcggctgtgcaccagagaggaattcacgaagaaggtgcgcacaaacgctgccatgggggccgtttttaccgaggaaaatcagtgggattctgcgaaagctgccgtggaggacgaagatttctggaagcttgtcgacagagagcgggagctgcacaaactcggaaagtgtggcagctgcgtgtataacatgatggggaaacgcgaaaagaaactgggcgagtttggaaaggccaagggctccagagctatctggtacatgtggcttggggcccggtacctggaattcgaggctctcggatttctgaatgaggatcattggttctctagagaaaacagctattccggcgttgagggggaaggactgcacaaactcggctacatcctgcgggacatttctaagatccccgggggcgccatgtatgcggatgacacagccggatgggacacccgcattacggaggatgaccttcataatgaagagaaaatcacccagcagatggatcctgagcacagacaactggctaacgccatttttaagctcacataccagaataaagtggtcaaggtgcagcggcccaccccgacaggcaccgtcatggacatcatcagccgcaaggatcagagagggtccggacaagtgggcacatatgggctgaacaccttcacgaatatggaagctcagcttattcggcagatggagggagaaggcgttctgagcaaagccgacctcgagaaccctcacctgtctgaaaagaaaatcacacagtggctggagaccaagggggtggagcgcctcaaaagaatggcgatttccggcgatgactgcgtcgtgaagcccatcgatgaccggtttgccaacgctctgcttgccctgaatgatatgggaaaggtgcgcaaagacattccccaatggcagcctagcaagggctggcatgattggcagcaggttccgttctgttctcaccatttccacgaactcatcatgaaagacgggagaaagctggtggtcccctgccggcctcaagacgagcttattggacgcgctagaatctcccagggcgccgggtggagcctgcgggaaaccgcttgtctcggaaaagcctacgcgcagatgtggtctctgatgtattttcaccgcagagatctgcggctcgcctccaacgctatctgcagcgccgtgcccgttcattgggtgcctacatccagaaccacatggagcattcacgcccatcaccaatggatgacgaccgaggacatgctgacagtctggaatcgcgtgtggatcgaagataacccctggatggaggacaagacccctgtcacaacctgggagaatgtgccctaccttggcaagcgggaagatcagtggtgtgggtctctgattggcctcacgagcagagctacctgggcccagaacatcccgacagcgattcagcaagttcgctccctgatcggaaatgaggaattccttgactacatgccttctatgaaacggtttagaaaggaggaggaaagcgagggcgctatctggtga

SEQ ID NO: 20441 - RNA, 9873 nt, synthetic construct
  misc_feature 1..9873: note = derived and/or modified CDS sequence (opt5) from DENV-3__GU131878__SS-prME
  source 1..9873: mol_type = other RNA
accagcctgtgcctcatgatgatcctgcccgccgctcttgccttccacctgacgtccagagacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcacatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacagacctggatgagcgccgagggcgcttggcgccaggtggaaaaggttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacagctggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagctcattgagggcaaagttgtgcagtatgaaaatctgaagtacacagtcatcatcaccgtgcacacaggggaccagcatcaggttggaaacgagacgcaaggcgtgaccgctgaaattacaccccaggcctctaccacagaggctatcctgcctgaatatggcaccctcgggctggagtgctcccccagaacgggacttgacttcaatgagatgattctgctcaccatgaaaaacaaggcctggatggtccaccggcagtggtttttcgatctgcctcttccctggacaagcggcgccaccacagaaaccccgacgtggaatcgcaaagagctgctcgtgacatttaagaacgctcatgcgaaaaagcaagaagtcgtggttctggggtctcaggagggagccatgcacaccgctctgacaggcgccaccgaaatccaaaattccgggggcaccagcattttcgccggacacctcaagtgtagactgaaaatggacaaacttgagctgaaaggcatgtcttacgctatgtgcacaaacacgtttgtgctcaagaaagaggtctccgaaacccagcatgggacaatcctgatcaaggtggagtacaagggagaagatgccccttgtaaaattcccttcagcaccgaggacggccaagggaaggcgcacaacggacggctgatcacagctaatcctgttgtgaccaaaaaggaggaacccgtcaacattgaggccgaaccccctttcggcgagtccaatatcgtgattgggacgggcgataacgcccttaaaatcaattggtataagaagggatctagcatcggcaaaatgtttgaagctacagccagaggggctcgccggatggccattctcggagacaccgcgtgggatttcggctccgtcgggggagttctgaacagcctgggcaagatggtccatcagatctttgggtctgcctacaccgctctcttctccggcgtgagctgggtgatgaaaattggaatcggcgtcctgcttacatggattgggctcaattctaagaacaccagcatgtccttttcttgcatcgccattggaatcatcacactctatctgggcgctgtggttcaggccgacatggggtgtgtgattaattggaaaggaaaggagctgaagtgcggcagcgggatcttcgtcacgaacgaggtgcacacctggacagaacagtacaaatttcaagcggattccccgaagagacttgccaccgctattgccggcgcttgggagaatggagtttgtggcatccgcagcacaacccggatggaaaacctcctgtggaaacagattgccaatgagctgaactatatcctctgggaaaataacatcaagctgacggtggtcgtgggggacattatcggagttcttgagcagggcaaaagaaccctgacaccccagcctatggagctcaagtactcttggaaaacctgggggaaggccaagattgtgacagctgaaacccaaaactccagcttcatcattgatggacccaatacacctgagtgcccctctgcgtcccgcgcctggaacgtctgggaagtggaggactatggctttggcgtgttcaccacgaatatctggctgaaactgcgggaagtctacacacagctttgtgaccatagactcatgagcgctgccgttaaggatgagcgcgccgtgcacgctgacatggggtactggatcgagtcccagaaaaacggatcttggaagctggaaaaagccagcctgattgaggtgaagacctgcacctggccgaagtcccacacactctggtctaatggcgtcctggaaagcgatatgatcattcctaaatcccttgcggggcccatcagccagcataaccaccggcctggatatcatacccaaacggctggcccctggcacctggggaagctcgagctggactttaattactgcgagggaacaaccgtggttattacagaaaactgtggcaccagaggcccttctctgcgcacaaccacggtgtccgggaaacttatccacgagtggtgctgtcggagctgcaccctgcccccgctgagatatatgggagaagatggctgttggtacgggatggagatccggcctatttctgaaaaggaggagaatatggtcaaatccctggtgagcgccggatctggcaaggttgacaacttcacaatgggggtgctctgcctggccatcctttttgaagaggtcatgcgcggaaagttcggcaaaaagcatatgattgctggcgtgttctttaccttcgttctgctcctgagcgggcagatcacatggagagatatggcccacaccctgattatgatcggatccaatgcgagcgaccggatgggcatgggggtgacgtatcttgctctgattgccacatttaaaatccagcccttcctcgccctgggatttttcctcagaaagctgacctctcgcgaaaaccttctgctcggcgtcgggctggctatggccacaaccctgcaacttcccgaggatatcgaacagatggctaatggaattgccctgggcctcatggcgctgaaactcatcacccagtttgagacataccagctgtggacggcccttatttccctgacctgtagcaacacaatgttcaccctcacagtggcttggcggaccgccacgctgatcctggctggcgtgtcccttctgcctgtctgccaatctagctccatgagaaagacagactggctcccgatggccgttgccgctatgggggtgccccctctgcccctctttattttctctctgaaggatacccttaaacgcagaagctggcctctgaatgagggagtgatggcggtcggcctggtgtccatcctcgcctctagcctgcttcggaacgacgttcccatggctgggcctctggtggccggaggcctcctgatcgcctgttatgtcattaccgggacatccgctgatctcaccgtggaaaaggccgcggacatcacatgggaggaagaggctgaacagacgggagttagccataacctgatgattaccgtggacgatgacggcacaatgcgcatcaaagatgacgagaccgagaatattcttacagtcctgctgaagaccgccctcctgatcgtgtctggcgtctttccctactccatcccggccacgcttctggtgtggcacacctggcagaaacagacacaaagaagcggggttctctgggatgtgccttctccccctgaaacccagaaggctgagctggaagagggagtctaccggattaaacagcagggcatcttcgggaagacacaagtgggagttggcgtgcagaaggagggggtctttcataccatgtggcacgtgacacgcggagccgtgctcacgtataacggcaaaagactggaacccaattgggcgtccgttaagaaagaccttattagctacggcgggggatggcggctgtctgctcagtggcaaaagggcgaggaagtccaggtgatcgccgtggagccggggaaaaaccctaagaatttccagaccatgcccggaacattccagaccaccacaggcgaaattggggccatcgctctggattttaagcctggaacgtccggcagccccattatcaaccgcgagggcaaagtcgtggggctctatggaaatggcgttgtgaccaagaacgggggatacgtctccggcatcgcccaaacaaatgctgagcccgacgggcctaccccggaactggaggaagagatgttcaaaaagagaaaccttacaattatggatctgcaccccggcagcggaaaaacccggaagtatctccctgccatcgtgcgcgaagcgattaagagacggctgagaacgctcatcctggcccccacacgcgttgtggctgccgagatggaggaagctcttaaaggcctgcctattcggtaccagaccaccgccacaaagtctgagcataccgggagagaaatcgtcgacctgatgtgccacgccacatttaccatgcgcctcctgagccccgtgcgggttcctaattataaccttatcattatggatgaggctcatttcacggacccggcgtccatcgccgctagaggatacatttctacacgcgtgggcatgggggaagccgccgctatctttatgaccgccacaccccctggaaccgcggatgctttcccccagagcaatgcccctattcaggacgaggagcgggacatccccgaaagatcctggaactctggcaatgagtggatcacggattttgccgggaaaaccgtctggttcgtgccgagcattaaggctggcaacgacatcgccaactgtctgcgcaaaaatggaaagaaggtgattcaactctcccggaaaacatttgataccgaataccagaagacaaaactgaacgactgggatttcgtcgttaccacagacatctctgagatgggcgcgaattttaaggccgatagagtgattgaccctcggcgctgcctgaaacccgtgatcctcaccgatgggcccgagagagtcattcttgctggacctatgcccgtgacggccgctagcgccgctcagcggcgcggcagagttgggcggaaccctcagaaggaaaatgaccaatatatcttcacaggacagccgctgaacaatgatgaggaccacgcccattggaccgaagcgaagatgctgctcgacaacatcaatacccccgagggcattatccctgccctgttcgaacccgagagagagaaatccgctgccattgatggggaataccgccttaagggcgagagccggaaaacatttgtggaactgatgagacgcggagacctccctgtctggctggctcacaaggtggcctctgagggcatcaaatataccgatcggaagtggtgcttcgacgggcagagaaacaatcagattctggaagagaacatggatgttgagatctggacaaaagaaggagagaagaagaaactccgcccccggtggcttgacgccagaacgtactccgatccgctggctctgaaggaatttaaagacttcgcggccggccgcaagagcatcgctctcgatctggtgaccgagattgggagagtcccttctcaccttgcccatcggacacgcaatgccctggacaacctcgtgatgctgcacacctccgaacatggaggcagagcttatcggcacgccgtcgaggagctgcccgaaacaatggagaccctccttctgctgggcctcatgatcctgcttacagggggagcgatgctgtttctcattagcggcaaagggatcggaaagacctccattggcctgatctgtgtgatcgcctctagcgggatgctgtggatggctgccattcctctccaatggatcgcttccgccattgttcttgagttctttatgatggtgctgctgatccccgagcctgagaagcagcgcacaccccaggataatcaactcgcgtacgtggtcattggaatcctgacccttgccgctattatcgccgctaacgaaatgggcctgctcgagacaaccaaaagagacctgggcatgagcaaggaaccgggggttgtgtctcctacgtcctatctggatgtggacctccaccccgccagcgcttggacactttacgccgtcgcgaccacagtgatcacccccatgctgcggcataccattgaaaattctacagccaacgttagcctggctgccatcgctaaccaggccgtggtcctcatgggactggacaaaggctggcctatttccaagatggatcttggggtgccgctgctcgccctgggatgctactctcaggtcaatcccctgacgctcaccgcggctgtgcttctgctgatcacacactatgccattatcggccctgggctccaggctaaagccaccagagaagcccaaaagcgcacagctgccggaatcatgaagaaccccaccgttgacggcattatgacgatcgatctggaccctgtgatttacgatagcaaattcgagaagcagcttggccaggtcatgctgctcgtgctgtgtgcggttcagctgctccttatgcggacatcctgggccctgtgcgaggctctgaccctcgccaccgggcccatcacaaccctgtgggaaggatctcctggcaaattttggaatacaacgattgctgtgagcatggccaacatcttcagagggtcctatcttgcgggagccggcctggcttttagcatcatgaagtctgtcgggaccggaaaacgcggcacaggctcccaaggggagaccctcggagaaaagtggaagaaaaagctgaatcagctgagccggaaagagttcgacctctacaagaaatccggcattacagaagtggatagaaccgaggccaaggaggggcttaaacggggagaaatcacgcatcacgctgtgtctcgcggcagcgccaagctgcagtggtttgttgagagaaacatggtcattccggaagggcgggtgatcgacctgggatgtggccgcggcgggtggtcctattactgcgctggactcaagaaagtgaccgaggtcagaggctatacaaaagggggacccggccatgaggaacctgttcccatgtctacctacgggtggaatattgtgaaactgatgagcggaaaggatgtgttctaccttcctcccgagaaatgtgacacactgctctgcgatatcggcgaatccagcccgtctcctaccgtcgaggaatcccggacaattcgcgtgctgaagatggttgagccctggctgaagaacaatcagttctgtatcaaagtgctcaacccctatatgcctaccgtcatcgagcaccttgaaagactgcaacggaagcacggcgggatgctggtgcgcaatcccctcagcagaaactctacgcatgagatgtactggatttccaatggaacaggcaacatcgttgccagcgtgaatatggtctctcggctgcttctgaacagatttaccatgacccaccgccggcctacaattgaaaaagacgtggatctcggggcgggaacgagacatgtgaacgccgagccggaaacccccaatatggacgtcatcggcgagcgcattaagcggatcaaagaggaacacaacagcacatggcactatgacgatgagaatccttacaagacctgggcttatcatgggtcctacgaagttaaggccacaggatctgctagctccatgatcaacggcgtggtgaaactgctgaccaagccctgggacgtcgtgcctatggttacacagatggccatgaccgatacgacccccttcggccagcaaagagtgtttaaagagaaggtcgacacacgcaccccgcggagcatgcctgggacaagacgcgtgatgggaattaccgccgaatggctctggcggacgctgggcagaaataaaaagccccgcctttgcacacgggaggagttcaccaagaaagttagaacaaacgcggctatgggggccgtgtttaccgaagagaatcagtgggattccgccaaggctgccgtcgaagacgaggatttctggaaactggtggaccgcgaaagagagctccacaagctgggaaaatgtggctcttgcgtttataacatgatggggaagcgggagaagaaacttggcgaatttggaaaagctaaaggcagccgcgccatctggtacatgtggctgggggcgagatacctcgagttcgaagccctgggatttctgaatgaggatcattggttctcccgggagaactcttatagcggcgtggaaggggagggactccacaagctgggctacattcttagagacatctccaaaattcctgggggcgctatgtatgccgatgacacggctggatgggacacccggatcacagaagatgacctgcataatgaggaaaagatcacccagcagatggatcccgagcaccgccaactcgccaacgcgatttttaaactgacataccagaataaggtcgtgaaggtccagagacctacccccacaggcaccgtgatggacatcatttctcggaaagatcagcgcgggagcggacaagttggcacgtatgggcttaacacattcaccaatatggaggcccagctgatcagacagatggaaggagagggcgtgctctccaaggctgacctggaaaacccgcatctgcctgagaaaaagattacccagtggctcgaaacaaaaggggtcgagcggctgaagcgcatggccatcagcggcgatgactgcgtggtgaagcccatcgatgacagatttgctaacgcccttctggctctcaatgatatgggaaaagttcggaaggacattccccaatggcagccttctaaaggctggcatgattggcaacaggtgccgttctgttcccaccatttccacgagctgatcatgaaggacgggcgcaaacttgtcgtgccctgcagacctcaagacgaactgattggacgggcccgcatcagccagggcgcggggtggtctctcagagagaccgcctgtctgggaaaggcttacgcccagatgtggtccctgatgtattttcaccggcgcgatctcagactggccagcaacgctatttgctctgccgttcccgtgcattgggtccctacatcccggacgacctggagcatccacgcgcatcaccaatggatgacaaccgaagacatgcttacagtgtggaatagagtctggattgaggataacccctggatggaagacaagacccctgtgacgacctgggagaatgttccctacctgggcaaacgcgaggatcagtggtgtgggtccctcatcggcctgacaagccgggctacctgggcccagaacatcccgacagccattcagcaagtgagatctcttatcggaaatgaagagttcctggactacatgcctagcatgaagcgctttcggaaagaagaggagtccgaaggcgctatttggtga
